United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 8

SEQ ID NO: 35812 - DNA, 371 bp, Glycine max
  Peptide Sequence Number=SeqID_127497
tggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgataggaatcttcttaaggaagcttctcaaggaggtgaacttagctattatagggg

SEQ ID NO: 35813 - DNA, 261 bp, Glycine max
  Peptide Sequence Number=SeqID_127498
atggaaaatggtgggttacactccttcaagctttgcggatttggtcttcgtcgggcaaatgaagagggtgagaatgagggagaagcccatgctttgactgtcattcctatacagccaagtttcccaccaacccaacaatgtcattactcagccaataaacaaaccttctccttacccactgcccagttatcgacaaaggccatccctaaatcaaccacaaagtctgtctactacacttccaatgacgaacatcacctttag

SEQ ID NO: 35814 - DNA, 207 bp, Glycine max
  Peptide Sequence Number=SeqID_127499
atgtacagactatgtttgtctttaccagctgagcctcagcatgcagagccagggcttcgcttcttttcatgccctactccagaccagttcagggcaaaggtcgcatggtccgcggattggcccgaggcccaagcaggagaggcacccccagaggctccgatgatggagaggaggccacgaggacgaggagatggccgatttgcttga

SEQ ID NO: 35815 - DNA, 315 bp, Glycine max
  Peptide Sequence Number=SeqID_127500
atgggtgaagcagaggaggtgcaagagaagatgaaggctgacatggaggccatgaaagagcaaatagccacaatgatggaggccatgatgagcatgaagaagataatggaagccaatgcggttatagttccgctactagcgctgtcgctaaggcaaagatttgggaagtacggacgaccccatgatgtgcaaattcaaaacgagcacgccttcccatcctatggcttgcctcccaactatacaccacccaatgtggcatacactctcaatgaaaatctcaataactccactccgatactcattgagaaccaataa

SEQ ID NO: 35816 - DNA, 90 bp, Glycine max
  Peptide Sequence Number=SeqID_127501
atgaaggaaggacatactcctccagagttaggtgctatgttcggaaatacaagtaatccaagggatgaagagagtggacaagatctctaa

SEQ ID NO: 35817 - DNA, 1014 bp, Glycine max
  Peptide Sequence Number=SeqID_127502
atggcggtatgcactgagaatgtttttctcactcctactcagcctatctcgctaggaggaatggcggtaccccgtgcctgtcccgctgttgctactagcggtatccactatcccgccattgccactggcgtgcctctgacccagtttggcggtggtgatggctttgacgaggaggcattgtttttgatatacccggaactgcaagtgttggagtgggaagaaaccctcgttcacctttctcccctgttttcccctaggattcttcctcagaaaccctcgatcaccttcccccctgtcactgtcaaagaacacttccccaaagcttcttcccctaccgactccgatattgttgcaagagttgttggagtgggaagacaccctcaaacatcttcctccccttatgggaaggtgtggcaagtttacatcgccaggaaaagggataagtgggggaatcattatggttttgtgagatatttggaggtgggagatgtcaagagcttgaaaacaaaattggatgaaatcaaaattgagaatgttaagatgaatgctaatgttcctcattttgaaaataattctaacattggagtaaggaggggtgtgatgactaagaatggtagggcacaatctgacatgaaacctaaaggtccacaactagggacatatcgtgttgcaagggaacaaacctacaatgtccctaacaacaaaggaaaaggggtagtagatactctttatgcaaatgtagtaagatgtccaccgacagatgtcgggcaaaaatggagagtacataaaaggaaggaaaacattgacaatcacattaaggagtggaccacaaaaatgaaggttgatggagagacaaaggggtggctagtggatagatgggccaggagattgaaggatctgaccctctttgaaaggctcaacgacatctacttgtcagaagaaggagatagagttaaacttagatacctcaacagcgatgcaattttatctttggtgcctcccaagagatgttga

SEQ ID NO: 35818 - DNA, 795 bp, Glycine max
  Peptide Sequence Number=SeqID_127503
atggaagccttggggagtttggtggattgtccttttgagcaagagtttgatgactgccttatgaagtttgaaattgcttgctcaccatggccaatggttgagtctactcattgggccttaaagagactactccagaatagccttggagacctttgtagtgtttgggaagccatgaacaacatgatcacgctgtatgctttaaaccagattgctgttgagtttcagtgtgtaaattatgttggcattgacagttcttgttgtggatgtgtaatgagaactactcacgatcttccatatgcatgtttatctgagcctgaagtcaccataacaaaagagatgaaagccacatccaagctgtttgaagagcttgatgtgaaaacaaaaggtgctcaaaagaaacatatgaccaaacatcaaagattaacaaagcgtgatttgtcttattgggagtatgtggatgctttacattctatgcaaaatagcaattcttcagtgaaacgggctgcatcatcatctgaacaaccaaaaccaaaaaggaactttctgatattggatcaatttcatccatgcattcatgatttcattgaaaacattgtcaatgtcaaagctgatgttaattgtggatattgtgcaattgctgccttattagatatgggtgaagactcatggtctttggtttgtaaccatttgctgaaagaacttgcaaaatggtctgatgagcatatgaacctgcttggtggcatagatagacatgaggagttaaagcgcttgctacttgttgatggattatccatg

SEQ ID NO: 35819 - DNA, 585 bp, Glycine max
  Peptide Sequence Number=SeqID_127504
atggaagaacaagactgtaaatgtaggaatataggttttgatgatgccaagcttttgcctcaaacacattgtttccaacaaatcaaggcattagtaatcgactaccagaagaaaagtttgcaatctactctaaaggagagaaatctttatattcatcttgaactcaattgtaatcgagagactggttgtctcttggattgtgagaattgtaatcaagagattggttgtctcttggagaatcttgaacacaagggtgagggatccgaagatgatgacaacattgatgctttgctctccaagccaattgttaaggagtccatgtttacttggctacaagctaatagcattttcaatgaaggaaaacatctaacatatgtgcaattcataacaaagtttacatatgtagccaaggatagatgttggaagccacgcaaaggaggttatacaattgaaaggcttaattgggtgcctccaagtactggagaattatattatcttaggatgatgttcgctatggttaaaggaccaaccggttatgaacaaatttgtacaatgaatggtcaattatatccttcatttagataa

SEQ ID NO: 35820 - DNA, 87 bp, Glycine max
  Peptide Sequence Number=SeqID_127505
atggatacaaggatgaaattaagaatgaggaaaaatgaaagaggggaggttgttggtagcagctgcaagattcccatgctatcataa

SEQ ID NO: 35821 - DNA, 246 bp, Glycine max
  Peptide Sequence Number=SeqID_127506
atggggaagaacaagggtcgtcaatcgcactcagctgcaaaccaaattatggtgaagggtactacctcaagttcagcaaatcagaatgcttatactgcttcacaggataatcttgtaggcaaggtgctcgtaaaaaagacagggacagttctgcaaaaactgatgatgtcgcacaccaagtgtttgataatttgtcagaatgcagtgctgaatctgaatcttccccagaggtttcttgcaccttag

SEQ ID NO: 35822 - DNA, 150 bp, Glycine max
  Peptide Sequence Number=SeqID_127507
atgggggatttacaaaataaaagacttcgacgctcaaaagatgaagaaatgaaacagaagagggaagctgaagagatgggagataccatgaaaacgttggattctaaaagggagatggtcatccttgctgcattcgatgagatgaagtga

SEQ ID NO: 35823 - DNA, 201 bp, Glycine max
  Peptide Sequence Number=SeqID_127508
atggagaagagaatgggagggaaaagacgaatgggagggaaaagacgagagggaaaagacgaatgggagggaaaagacgagagggaaaatagaaatttgggacaccacccgctccctcataatttggagccggagcctggggttaaaaaaagagggaatatccgtttgaggcccataatatgtcaaaacgctcgaaattga

SEQ ID NO: 35824 - DNA, 210 bp, Glycine max
  Peptide Sequence Number=SeqID_127509
atgtttggaaggttgtgcaactacccaaagacaaacaaattttcaagaggctcttcgttatgcgaaggtatgggggagggatgttgtacgcagccttacccttgtatatgcaaagaggctgtttccggattcgaacccatgaccaacaagtcaccaaagcacaactttaccgctgcaccagggctcgccctcatgaacacaaacaactaa

SEQ ID NO: 35825 - DNA, 288 bp, Glycine max
  Peptide Sequence Number=SeqID_127510
atggaagccatttcttgtgtgacgaagaagtggttgaggcaccaccagcgtccacagaagttcagaaatgcacctctccaacgatggccaggccattggaaatcgcccaaagagggagagatgctgaaccacgaagaggaatcagattgggctgcacaatgcacaaggcaagataaaatgtcaaatgaagaattgaagctgcaggatccacgatgtcggatacaatgtccaggacatcctgcccgaaaatactggacacataaatctgttatatctttaacagattaa

SEQ ID NO: 35826 - DNA, 1134 bp, Glycine max
  Peptide Sequence Number=SeqID_127511
atggaagtggatatgtgggacacagaagacgacaccaaggttgtgaagaaatccaagcagaagcagcgaaagaggaaggtggagaaggatgggaagcgagagaaggaggcaaaaagaatcttcttgtctctgacgaagcctttacttgttttgggattggatcccaaacctcttaggctggaacaccgtgcaaggctgcgccacctgctgcggaggctcgtcaaccggcaacaatgggttgcagccagtggtgttctcagtgcctacatgaagggaacacttaatgacacctctccccacaccaaccgtcttaagttttggttagtttctgaacaggctttattggagcttcttaagcatgtggaaaaccattctattaatacaacacgaatcaaaaacctctatgatatttggtccaagaaaattggatcaatgaagacatggccagttgagagcagatatgcagtccatttggagttcatggttttctgtcttttgcgaggccatgctgaggatgcataccatcttgctctatgccttgagcaagaaaaaggtgatattggtcctatgttaaagatgatgatgggtttgacattctatgagttgtggtattcttctatccccaaagaattccaggtgagaaattcagaccagtttcacttgcaagagaactcagatatggaggaggcctcattcagcaatgaaaatgtgcagtcagagaggtataattctgttgaatcccacatggctgactcccaatctcgacgtgattcggatgcctctgtcatgaatgggggacttgatttgtggttgctgcccttgcgtttttctgatgagcacagttttgaggattttgtgtattcgcaaagaaatcagcctaatcaccattacaaaaatgcagtgaaatatttgcaactagctctgcgctcagaaccttccgcttcagcagcattacttccattgatacagtgcaggccctatgaacttccaaaggaatggaaaaagaacacaaagggtgagattggctccaggcacgtaagcactaccccgttcttatccatgcatagccccatgcatggggcatgcataatggccggagctctgaactttaagcgcaatctcgtgcttaactaa

SEQ ID NO: 35827 - DNA, 219 bp, Glycine max
  Peptide Sequence Number=SeqID_127512
atggcccaggctttttatcgaacacctagggtgcctagcaaggtttgcaggtttgcttctgctaggaataggcagaaaatccgaggccccaagaagagtggaaggagcgtagaaggagaatctctacctaggcgcaggttatgtcaggatcgtcctggtcaaatcaagaatgatgagaataattcatggtcaacaatcgtggctggagagaaagattga

SEQ ID NO: 35828 - DNA, 195 bp, Glycine max
  Peptide Sequence Number=SeqID_127513
atggcgactttgctctgtgaatctcacgtggcctgcaaaccgccagtggtattggcaactcaggcgcagtgcaaatcgccagtttgtctgacgagtccggtcacaggtttccagtttcacttttcagagggaggcagcttttccggaaggcacgtttttcaggtaagggagttgcaattcccaccagcgagttag

SEQ ID NO: 35829 - DNA, 408 bp, Glycine max
  Peptide Sequence Number=SeqID_127514
atgatgccgactttttttagggttttatggtgggttgtggtgataaatgttgttgaggatgacgtcactagtgaggcacttctgctagttgagagggacgtcaagtttgtcaaagtagcggagaagctcgggccttctcgagcatctcaagatgttcttggggggcttaagcaagaaaaggacgccctcgatagtgttggcgatgacgagaagaggctggtgttgaaagcggtgagggtggtggcggggtttgaagggtttgaggggtgtgaggtgaggaatgtgaagaagaaaatgatgatgagagtcgaggagaagagaaggaacagtggagagagaagtctcgtgggcttatttcttttccagacatttgccatagaaaaggactgtgttcgttatggaagctga

SEQ ID NO: 35830 - DNA, 752 bp, Glycine max
  Peptide Sequence Number=SeqID_127515
ggtacatcctttgtggcacaagtaaatggtacatctacttgggtttgactgagaacaagagagggtacatctcttgtgaatcagttctagtggagggtacatccactaggttcaaagagaacaagggagggtacatcccttgtggatcttttcttgtaaaaggtgttgtgaggttctcggaggatgggaacctttatagtgaccatgtactcacttctcttgttctatcatgggcgcctcttgagatggattggttcaaagtgaacatcaatagggttatacgacgagcacgaatggaggctgcttgtggtggtgttgttggagatcaccatggaaagttcttgataggctacgtaattgagggtgaagggaggttgtggggttgtggttatcgcacaaagggattatggggttggggttacaagatggctatgatgggtgaagggacactatggggggtcgaggtgatgaggttgtctctttctcttgcaactttctctattctcatctcaatttctaatttaggtgaacatgtggggaccattgttatggtgaaatcgaggcccaaggtgaacccctttggggatgccaagcctagggaggaactttatattcacattggatggccattgtatcgcaaatatggtcatgcttttgaggtgactaaggtggtgccaactgtatcagaagaagtgaaggattatgttgtgaagaatactagaagacaaatgaccccaacccttgaaaattag

SEQ ID NO: 35831 - DNA, 357 bp, Glycine max
  Peptide Sequence Number=SeqID_127516
atgggtacgacttctaggtcaggtgaaactcaggtgttcgataaaaagcctgggtcattttctgcatcaaccagagttccagtacaccaagtgtttgttgaaatgcctggctgtcccgcagatactgaaacatccccaaatgactcctgtagtctcggagaagacgactcgtccacggaagaagacacctctccttctagtggctctgattctaatcctcaagttggcaatggagaggcttccacgccttggattaatctgttcaaggacagcagaaagccttccaagggatttggcctgaaattttcccctctatctcctgaagatgtagtgttgcttgatgaagatgatttttag

SEQ ID NO: 35832 - DNA, 303 bp, Glycine max
  Peptide Sequence Number=SeqID_127517
atgaacccaaaagcggttagtcttttgagtccagtgataacaaccaagaagttgtacccacttcttgcaatgaacccaaaagcagttagtcttttggatccagtgatcaaccaagaagcaaatccgcttcttgtaatgaactcaaaagcggttagtcttttgagtccagtgtttaaccaagaagaccttctcttgaaaatagtcaccaatagtaggtctcttgaaaagattttttcactggtaatcgatcaccattatagtgtaatcgattacacatcaacagttgtgactcttcatgtttag

SEQ ID NO: 35833 - DNA, 1593 bp, Glycine max
  Peptide Sequence Number=SeqID_127518
gagaagttgttgtcgaagagagaagagtactcaaacaatggttgtagagacctcaacacgagagaagcgaagaaaatgttgacaggtctcgtcatcacctccatgctggtgcaaaggtgtgaattacctccacgctggttcaaaggtgacacaaaacacgagaagcaaaagaggttccaaaactctaatcagtaccactcccccactttgagattcactcaatgccaaccaaaaccaaatgttcctcacatccaacaaggacttgacatcaacctcaatgaaacacaacaactccatggccacttcatcaaaaccagttccaattgcagttatcgagtccctcttgcagcacttgaatcctattctagcaatgcagcaattcatagcttcctaataacgtcttacatcaagaacaacttccctgcagatgcagcgaaaatctacgcctatatgcatagaatagacactgaagtggacaattttatcataccaccggttctcaaaccatgttgtcttatcccttcaatcctactaggacaagaggttcatggttttgtggtgaaaaatggatttcacggtgatgtttttgtgtgtaatgctttaatcatgatgtacagtgaggttggaagcttggcatcagcacggctagtatttgataagattcataaaaaagatgttgtttcttggagtactatgattaggagctatgataagagtgggttgcttgatgaagctttggaccttgtgagagatatgcatgttatgagagtgaagcctagtgaaattgcaatgataagcatcacacatgtcttggcagaaattgctgatttgaaattggggaaagccacacatgcttatgtaatgagaaattggaagtgtggaaaatcaggagttcctctaagtactgctttgattgatatgtatgctaaatgtaaaaatttagcttatgcaagaagggtttttgatggcatgtctgagactagtatcatttcatggactgctatgattgcaacctacattcattgcaataatttgaatgaaggtgtaggactgtttgtcaaaatgctaggagaaggtatgtctccaaatgaaattacaatgcttagttttgtcaaagagtgtggcacagcaggagctctggaattaggaaaattgttacatgctttcacattaagaagtggatttaccatgtctttggttctagccactgcttttattgatatgtatggcaaatgtggtgatgttagaagtgcaagatctgtttttgatagcttcaagagcaaagatttaatgatgtggagtgccatgatttcagcttatgcacaaaacaattgcatagatgaggcttttgatatctttgttcacatgactggttgcggaataaggccaaatgagagaaccatggttagccgccttatgatatgtgcaaaagctggatcacttgaaatgggtaagtggatccattcctacatagacaagcaaggaattaagggaaatattattcttaaaacttctttggtggacacgtatgccaagtgtggagacatagatgcactgcttgctgcggccatggaccgtgatgtttcaatgtga

SEQ ID NO: 35834 - DNA, 744 bp, Glycine max
  Peptide Sequence Number=SeqID_127519
atggctgcaaccagggctcgagttagtagcttctctcgcaatgtatcaactgtgacttctcagaatcatggacttaagcatggccctaatgggacaatgttcatttcatctgggattccagatctggacaagattttaggtggtggtttttctctgggtagccttgtcatggttatggaagatcctgaagcacctcatcatatgcttctattgagaaattttatgtctcaaggacttgtgcaaaaacagccactcttgtatgctagtgcatctagagatcctaaaagttttctcggtactttgcctagtccggcgtcacccaaaggggataataaatcttcagatcttagccatgaaaaggatctaagaatcgcttggcaatacaaaaagtattttggtgagcctcagctaaatctgaacactaataatgtgttgttaaatggcggccatggcggcgccatggcggatttaggtggcggctttgcgaaaaaacgccaccgaatagcggtggcgtggcgggtttgggatggcggcgccatggcggccgtggcggttatggcggggtggcggaaatggcgggattttgcttggtttttgtccgcgaatagtccctgcgtccctcccgcacctctgcgtcctccctcaccccgccgcacccagccgccgccgcgacaggcgacacccgcagtccgcacacccagccgccgccgcccgcgacaccccttacacgaagatgaaggctga

SEQ ID NO: 35835 - DNA, 282 bp, Glycine max
  Peptide Sequence Number=SeqID_127520
atgactctatttatagctaggggcaggttcgggttcaaagtcggggcagatattagtaatcttatacccatacttgttcctacttctggttatcatgaaaaacccgaactcaaacccatacctggtcaactcgggtattacccgtcaaaacagtggtatttctttgtcgtgcaattggatagtgtttttagactattgaaatggataaaatttatcatttttagaaaaactctactttatccttttgtagttagttttggaaaagtgcaagaagccatataa

SEQ ID NO: 35836 - DNA, 615 bp, Glycine max
  Peptide Sequence Number=SeqID_127521
atggttaaatacaacaataataaaggggatcggtgcctgctgcatccaggggagttgcatgatgtagaaatgtgctcagtatccaaggagttgttgcatggattgatagatgaaggtcgaattgaaattggtcgtgtaaggagggaggaaggagaggtgttcatgcagtcaagcgacaccaacctgggtaagcctaaacctttggtaattcattttaccaaagatgttaccactcaagtacctcgaggtttccaacccgctatggtgaggataccatcaccattcccttacaaaagtgataaggtggtgccatggaggtatgacgtacagggatccaacagaaggcaggacgcgcccgtcatgcgtgttggggctagcataccgactgctaaggtcacgaatatttccggtataagtggcatgacacatagtggacgtatttttgctcctcccgaacaactgacaaagtcgaaggacaagggaaaggcgaaggaggatgtagttgaaagggataaaataggccctgtgatgtataacgaggccccaatcggaaagcttgcggaggaagacggaaattttggcaagagggagatatttgatgaggcagcaacataa

SEQ ID NO: 35837 - DNA, 1410 bp, Glycine max
  Peptide Sequence Number=SeqID_127522
atgatagaagtctccatagaggccatttcctccctcgcccagtattatgatcaaccgttgagaagctttacatttggggacttccagctgtcacccatggtggaagaatttgaagagatcctaggatgtcctctagggggaaggagaccatacctcttctcagggttttatccctcattagctagaacttcaaagatagtccaaatctcggcgcaggaattagaccatggaaagcaagtcagaaatggggtggttggaataccgagaaaatgtttggaggcaaaagcaagatccttggcaggtagaggcgaatgggccccgttcatagacattctcgcactattgatcttcggaggagtcctctttccaaatgtggatgggttggtggatctagcagtgatcgacgcttttctcgcctatcatgaccacaaggaaagcccggttgtcgctatgctagccgacctatatgacaccttcgaccggagatgtgagaagagcagtacgaggattgtttgctgtactccagctctttatgtatggttggtttcacacctttttcgccaagaggtgagacatgcttgcccgctagaaagccatcgttcatgcacagagaaaggaggggcaaattgggaccaactcttagcaaacaaagaaggagtgtctatcaactggttccctcgatggaaagaaggaagaaccagggttcttatttcatgcagaggatttccgaatgttcccttgatggggacaaggggttgcatcagttacaatcctattcttgctataaggcaacttggctaccctatgagaggggcaccgctagaggaagagctcgcgcctaaggtccgcaaggcatgggaggtggtgcaaaagaaggataaagaactcaggggcagtaacaatgggcccatcggtggctaccgaaggtggttgaaagcccacgtgcaaggtttggattggctcccgagtttgagaaccgctaaaagggaggaagttgaggcaccggaggaagacgaagaggtgcaggcccttagggcagaactcgagaaggcccaaatagtcaaagaaagaggaaaaagaccaatcacgagtacatggcatggtcttaaaggaggagttaactgtttgctcaagatccaagaaaagtttggcccaacacttagaagccatggagcaaagcatgttatagctataatagggcagtacatagaagagttaaaccaatctttgacccatgagaaaaagctagtagaggacttcgcacaagcatacgccgagaaggaagcaagagggagggtgattgatgcattgcatcaagaagtgaccatgtggatggataggttcgccttgaccttaaatggaagtcaagagctcccgcgactactagccaaagcaagggccatggccgaa

SEQ ID NO: 35838 - DNA, 612 bp, Glycine max
  Peptide Sequence Number=SeqID_127523
atggcctccaggaagaggaaagccacaacatcccggccccaggagccttatgacaccactagattcatctctaagacttcctgggagaggtattcccagaacgttcactcctggaacatctttctagagaggaacgttattctctatgtcacagattacgatgagttttgtcgggagctcgataggcgatgctggcataaatctttgaccaggcagatggatgggcacatagatgtagccttagtcaaggagttttatgcaaacctttatgacccagaagacaagtcccccaagcaagtccgagtgcaggggaagctgatcaagtttaatccagcctctctgaacgccttcctagagacgccaccagtcattcagccaggggagaagtatacttcttattctcttttctgcaggatgcgcggcgaggttagtctatgggctaggcatgaagatggacatggacttgggctcactcatctcaggctagatctcacaaatggtccagtccaactcctcgcggctcggcttcccagcccttatcaccgccttatgcatcgcccgaggagttatattagactcactcacattcgagtccataagccctgccattaa

SEQ ID NO: 35839 - DNA, 381 bp, Glycine max
  Peptide Sequence Number=SeqID_127524
atgcacaaaggtggttctattagcttgcaggatcacaccattcgcttggctagactatctcaagctaggtctaatgttgcatcaagtgttggtgaatcacaactcactcctttagaccttgctgaagaacaaagacttagaacttggtgttgggttgcagctgcgggaccaaagcgtaagggacgtctttctggtactggagaccttgctcatacttataaatgtggagatgaaaacttcatgcaacatacacaaggatcttccagtcgtgctaaagatgccacaaagattaacctactaagggaggagcttcgtcaatcaaaggaggagatgcgtgtatttcagtcagttgtccttcagttcctacttcctaaagcgtga

SEQ ID NO: 35840 - DNA, 123 bp, Glycine max
  Peptide Sequence Number=SeqID_127525
atggcagcagaatggagaaggaggaaaggtaattggagatgccacttcaaggagaagatgagtcaagtcatggataagagattgaaggtaggagaagatgagtggagggagagggagagatga

SEQ ID NO: 35841 - DNA, 441 bp, Glycine max
  Peptide Sequence Number=SeqID_127526
atgtactctcaactatgggttcccaaactactagcgaaaattcatcttggccttccgacaaagaaagagattgtagtgacatcaaatgcaagttccaagaaggaccataggcgtgtgagacccttcgtagagaaaacactttactccggtttcattagatgtaggactgacgtgagggtactaaggcagtttggcctggatgggcacaatgtagtcctgtgcgtttaccacccattccatgacagtcacaacctgggcagtcattggcaaacaggattgattccagatgttgtcaacagttatgcagagcttgttagacctcaaagttgtactaaagggtatgagtcatcattaactcatacaacaaactttgcaattgttgtaggagggtttagtagccaagtgcaacttagacacacagaacctcaagaagaggactag

SEQ ID NO: 35842 - DNA, 324 bp, Glycine max
  Peptide Sequence Number=SeqID_127527
atgggggggggtgcaaatagcaattttgaaattttgaaattggaccttccagagtattttcgaagctggattgcttctggaggaagcaacccagctcgtctgggcgagctgggcggcaagctcctccccttttttcctataaatatgttgaagggggttgttctaagggtcccggatccccctgaaaatccaagccgaggtgcttccgtaacgctttcgagatgtttccgtaagcaaatccgtgaaggttttcctccgttattcgtcgttcttcatccgttcttcgttcttcaacgggtaagtttccaaatcggagacttttaa

SEQ ID NO: 35843 - DNA, 294 bp, Glycine max
  Peptide Sequence Number=SeqID_127528
atgggctcaaaaatctaccctaaggttcatgagaaccctaggaccttctttagtagctctagcccaagcctcttggaatcttctatccaatacccttggggggtaggattgcatcagtttccatctcttcctttatggtcacttggggctcagataacccttggtctgaaaaactcaatctcctccaaaacatatggattgaatctagtgggatgctaccaagaatggtgtaatcgattaccagtttcctgtaatcgattaccagtgtcaaagtttgatttcaaaatcttttaa

SEQ ID NO: 35844 - DNA, 273 bp, Glycine max
  Peptide Sequence Number=SeqID_127529
atgtatgtagggtattcttcgagccacacttcgaagagcagtgtagggggttctgtgggttcggccgaggggtttccggcagtattgagaacaatgtgggtgtcgagggagcgcccaccaaaccagtctcagaaaaacgacgatctcgaacccgttcaccgttggatcgtcgtgaaatttgagtatcatgttcgcaacagaattccgagcattctcaccgttgggaatttcgatatcatgtctgaactgagagaaacacccttcgcattgtag

SEQ ID NO: 35845 - DNA, 936 bp, Glycine max
  Peptide Sequence Number=SeqID_127530
atggaggcatcggacggtattcagagatcagcttttttttttttcttttcaaaagaagactacatcttggtccttgagtgttttggcgaagaacttagattcatatccccaagtgaacaccttgtgctggattgggctctagggaaagaacattcagttcttctcagaagatcagagttgaagacatttgtggacttacatgcaaatgaggcagggaaaggtggagagttatcacatcatgaaacttctataatcactggtgctatagatttgactgggaagacagctaaagatgcaatgacacccatatctgaaactttttctcttgatataaattcaaaatttgacatatgttttgctcccaatctatcatctataaatgcagttcacctatacattctgggcacccaagaaatattattggcctcatattgggtttatgaaagttggcaactatatgagatattgaatcaattccagaaggttcacagccatatggctgttgtcttgaaatccaacaaagacacagagagcactatgggcgcaccaacctttttgaatataattactaataaaatatcaaacccgtctcaagttgttgtagaatctgattcttcctttgtcctggaaataagtcagagaagttctgtacatgaatccagtgtaaactctagtgatgcagaatttcgtaatccaacattaaaaaatctaatggaactagatggtgaagtacatcaagaatccaaccagtgggaacaagaaaatgaatatttctcacaagaacaaatagagtctcttccagatgttaaggaggttattgacatcatcataatggaagatgtcatggaggaattgttccaggctttctacatcgctacattaacatcggttatttcaaaaaccgatgttaacgaaagcgcggtgacatttttgtaa

SEQ ID NO: 35846 - DNA, 165 bp, Glycine max
  Peptide Sequence Number=SeqID_127531
atgaagctctggattctctatacggtaaccaccgtcactgtccctgattttggggaagaaggagaaggggaggcagaggccgaggtcagcgccaagggcagagtcgacggtgcggttggtggtggtggtggtgtagggttattttctgttggagaaggggaataa

SEQ ID NO: 35847 - DNA, 1593 bp, Glycine max
  Peptide Sequence Number=SeqID_127532
atggcacctgcaggtgcactgataggtccaattgcatttgccattattgtcattggaaattctgctattatccttggactttggagtgcacatgctgtttggacatactactgtgtggcaaggttgtattttctttccaaattgcaacgtttgtgttcttctcttgatctttctcttcaatttcttttcacccttttgaaaactttggcctttgacaatagaaaaaataggttcggactggtcttcaagcttgtggtgctcatgggtttgccagttcctctgctactttggccaatagtgggtattgttggaagccttttaggtggaattggatatgggttttttgctcctcttcttgcaacttttcaggctgttggggagggagagaatgttaaccagaaattttaccattgcttcatcgttagtgtgaatttctgcttgtgtaatgtatctttcagtgccccttttggtcatttaactttgcttgtggaagtatctttcaattctaacccttttcatgatctagagcttctggacttgagcagaatgcaggaagctttaatgccacttaactctgatatcaggatggttgttggtcaacaattgaaagaagctgcacagtgtccatacatgctgttcaaagggtggaaaagactgttagaagatttgattggaataaagggaccattcttggaaactgaatgtgtcccatttgctggccttgccatcattctctggcctttggctgttgtagtggctgtattagcagctaccattttcagcttttttatggccctatatagtggagttgttgtccatcagatcaactcagtggagatggggtttatatacattgtgtctgtggtttcgctttttgatgaatatgtaagtgatttactctacctgagagagggatcctgctttcccaggccgatataccgtagaaacatgagccatgctgttgaggggaaaaaccttggaggaggtgacaatgacttgaaaaaccggagggatgggtcacagaattcgaaacattccatacaacaatccagaagtatgaaatggggaattcagcaatgtagacctgtgcagtcatgtgaggtgaatggaaggatactcctccgtggtggtctgataagcgttggggaagttgagaaatgcattttgaaaggcaattgcaaaaagttaagcatcaagttaccggcttggtccctgctgcaatgtcttctaacatctgcgaaatccaattcagatggatcggtgatctcctatgaagtagtgttgacgaggacgaatggaccgaaggatagagtgtttgagtggtttattggacctctactgattatgaaagagcagctaaagaaccttgagttagaaggaactgaagagacttgcctgaaagaactagtcatgaaatgcaaaaatgaagtgctggaggagtcggatagcactggattcccatctgataatactgttaggagagcgcaattacaagccataattagaagactttatcataacttaatgcatcctaagcttttgattgcttgtgtctacaacactgagcttacccaagcattactctatgtatga

SEQ ID NO: 35848 - DNA, 1125 bp, Glycine max
  Peptide Sequence Number=SeqID_127533
atggagatggttgaggggaaggagcaccaagatggttgtggtggcagcgacaacaatttaggagacgatgtggttgtgagagtggataaccgtgcttcttcttccttcgttggtgttctagtttgtgtcatgtcgtcgttgttaggtgcttccattgccggatttgaggaactgtccaccaccactatgccgtttccgtcgtcgaggtttaggtcgagcagtttccatctttcaataggagaggtggccatcacccgcgatgatttacttgaagtcaatggagatgaagctagagctgagatagtacagtgtcatggggcacatagtggaagctatgcatggggagctgccgccctagtgcatatgtacgataatttgaatgatgcttgtaagggtgacgggagacaacttgctgaatatatcacactattacagggaattcgttggatttatgagcattttccatctattgttaaggcttttacaaactcagactatgaggaaaggtcaccacgtgccttccgctggacatctacgaagacattactagcatcgacgtatgggaagcgtctagatcgactgacaactgctgatatttgctggatgccttacggtaaccactatgcacaatttggatatgttcaaaccattcctccacggtcttcgggttcaaggttatccttcgaagatattgacaataaatggatgcatttctctaagtaccttgcaccggtgggccagatttgtgttgtgcctagacaatgtgcatcggactacatctattggttctacatgatttcacatcaattcatgacattgacacagcttggggatccacccagacatccacctatcatgcaagatgagacatatgtggaaccggatatgcctgagttcccgatggcgacaacagctatagaggaagcagctgcacatgcaccttctgatgtggatcagccaagacatgtagtggaggcttgccaagcaattgcaaaaaggttggagtggttgctcaacctaaggatagtgactgaaggcacaaaagcacacgatgtcatgcaagattgcctaaggatcgctaagggtgtcactgtacaacgcaatgtatatgtgaggtcgcgatga

SEQ ID NO: 35849 - DNA, 804 bp, Glycine max
  Peptide Sequence Number=SeqID_127534
atgggtccacagccatcgttgtcacagtacgctgattacgatccaggaaacatagcctgtttaactccaaccaaaaggattagtagtcagcaaaccagttctgattttgattctgatgagtatacacaatatcagctatcaactagcaaacatatcaaagctgaatggttattactttacgaaggatgcagcttgcagtatgcctttgaaacaaatgtgagtaacaactctttcatcgttcttccaacaccaaaatcaaactctgcccgcacaatgagttccgtaatatccactgccttcaccgtcgttagaagagacggtaacaaattctattttgcggatggattgaaggacttcagaagagtgttgggtattcatgaaggcctggtggttcattttgctgcacccgatagaaatacaagcttttatctgcattttatgccaccactagacagacaaacatctggcaggccttacagtaccaccagaacatatgtctttatcgttgatattactaatcatatcatctctactcctacacctctggtgttgccacctgatgctgtggatatcattgggtatagatctcaatatcttactgttgaaccaccccgtggtcgtcagatttggtggatgtctatccaagatgggctgcaaactctcactacaccttggtaccaattcctaaaggacaacaacttgatggctcgagatgaggttatcttttattaccaaccaaaccaaggtgtatgggaaatcatcctgaggaaggagatcggatggaatgaagacgagtccacctaa

SEQ ID NO: 35850 - DNA, 1128 bp, Glycine max
  Peptide Sequence Number=SeqID_127535
atgctggcaacagtgaaggagggaaggacgacgacgagtgtggtggcggctgaggaatacacgacggagttccgagcctacaatgacgacgcctggtacacggtgcgcgttttgctcgaaggagagagactcatagtgaagtaccagaacttctccgacgaaaacgacgaggcgtttgagccctcgcggtttggggattgtgaggacctcgaggacttcaaggagcgcttcaggccgctctccagacagctccaggacgccgagtgtcgtcggttcggtcccggcgctagggtctgcgcttgccactccttcgcccccgacgacgttcgcttctacgacgccgtcatcgacggggtgcaagaaaacgagcattcttgggaaataggagaggaagaatgcttgtgcacctttctactttactggttgcatgggccaaatgcaagaaacttgactgctgaaccaattgataatatctgtgaagttcagtctgcatgggagctagatcctgcagtgacttcatttctggatatggcagggaagaaaatacatttgttttcttctcgttatgttttagcatcatcaggagtttctggcctagaaatggggccgtactgcaacggaagctcaaacactactcatagaatgagctattttgaacgaatggaaaaggcaacacagcgtgctatgcagtctgttgacaatgtttgttcacctggagtgtcaaagaaaggctttgaaatgatgccatattgccccaaaagctcaaacactactcatagaatgacttattctggacaaatgataaaggcaagtagtatgaaagagaacgtgttaggcggtctgttgtcgatgcatgttcacatgaagcttatgaatgaccctcgagaaaggcatatgcaagtagttgataggatcctccaatacatgaaggcaagtccagggaaaggcctattattcagaagagaaggctccttgtctatggagatttatgctgatgcatattatgcaaggacagtcattgatcctggaagtaaccaaaacacattgtcgagtgtcatagagtgtgattcatcaggacatcaacaatcaggagcgttacacaagtcccagccaacatgggctgcttga

SEQ ID NO: 35851 - DNA, 645 bp, Glycine max
  Peptide Sequence Number=SeqID_127536
atggcggttcatggcggaaagccaaaaatccaccataaaaatatggcggatggcgtagcggaaaatggcagacgtcatgacggtagcgctgttgctgccgctgtcatcgccgtccgtgctcgcatgcgtggtgcgctgatgcggggtgccgtgtcgcgtgcatggtgctggtgtggggtgccaagttcgccgtcgtggtgcaggtcgggtcagcccaacacctatcccgcaaaaaacaaaaaaaatagccgcaattccgccatagctatggcggccgccatggcgccaccatccacaacccgcaacgccaccgctatttggtggcggtttttcaaattcccgcaacgctattccgccatggcgccaccatggtcgctatttgataacactgatagtgtcaaaagagcaagggccgtagcatcagtgcaaaaatgtagtgttaaatgtgcaaggactctcacattttcttggacgaatctgggttttaagctatggtacaccgggaaagttagaggaaagaatggagtaggtactatggtagacaagactataaatatcatcaatgcttatgcaccacaagtaggaacagaggcacatgtgaaggaaaagttttggggaagacttggagggattgatattccatga

SEQ ID NO: 35852 - DNA, 243 bp, Glycine max
  Peptide Sequence Number=SeqID_127537
atgtcgtcatcgatgagcttgttggagtccaagcacgcttccttaaccttctgcattatcaacacgaatagcaagaagaactcattcatggcttcatcatcatcgtcattgacaacattgtttaacaaaggaatgaaggctcgtggtgaaagggtgcctaaaggaagaggcgtgtgggtggaaaggagaagggggatcagcatagaagagaaaaggaaagagaaagtgaaagagaaagaatga

SEQ ID NO: 35853 - DNA, 159 bp, Glycine max
  Peptide Sequence Number=SeqID_127538
atgggtgagtatggcggtgatcacgcacttagcgcgaagttcgcgctacgcatgccttcaagtttctttgtgggcctacttcgcgttaagcttgagctggtcgctaagcgaggcatcgcactgggcgtgtcttgtgcgctaagcaagatgctctcttaa

SEQ ID NO: 35854 - DNA, 1026 bp, Glycine max
  Peptide Sequence Number=SeqID_127539
atggctgcacgggtccatggaccttggttgatgaattctgcagcgcgtttcatatcttcaaaattgttacttaaatcttcctctcgtgcccctccacttcaaattagtgctcttgttggctctatggtccctaaaattcaaggcccgaagaacagttctggtttccctagatcatacatgtcagctaccttagcttctctggccaaggaagaggaagtgccaagtaaagccattgatacactcagagcagttgaagaccaacatgggggtgtaattgtgaacattgaggagcctatggattcctcagtttttgcttctttgctagaagattcaatattacaatggagggaaaagggaaagaagggagtgtggatcaagctgtccagagaacattcaaatcttgtggattctgcagttaaggctggattcagattccaccatgctgaaccagattacttgatgcttgtgaattggattcccaatactcctgatacccttcctgcaaatgcttcacaccgcgttgctgttggtgcttttgtcatgaatgccaacagggaggtgcttgtggttcaggaaagcaatggcaggtttagtggccaaggaatctggaagttgcctactggaggcgttgatgaaggtgaagatatttgtactgctgcagttagagaagtcaaagaagagactgggatagatacacagtttgtggaggtcatagcatttaaggaaaggcataaatctttcttccggaaatcagagttgttctttgtttgcatgttgcaacctcattcctttaaaattcagagacaagtttcagaaattgaggcagctcagtggatggcaattgaggactacatggcccagccttttgtccgagaaaatgagctatttgactttcttaccaaaatagggttatcaaaatttgatggcaaatacaatggcttttctaccgtactgtctagcacttcctctcgcaaaaaatcttacttttacttcaacaacaaggacgctggtcacatgttagcttga

SEQ ID NO: 35855 - DNA, 150 bp, Glycine max
  Peptide Sequence Number=SeqID_127540
atggaggttgaggaaccttggctagggttatggctaccattgcattatcaagtagatatgggagcaggccttatgggtgatttaggggtggcctttgtggttgattgggtgttcttggctgatagggtggtgggtaatgagaagggctga

SEQ ID NO: 35856 - DNA, 240 bp, Glycine max
  Peptide Sequence Number=SeqID_127541
atggcgtggaatttccttttcaaatgcaagtatgtgcatgatgaaatggccccgaggaagcttgcctcaaagagatctaggaaggacgccgcggccgcagggactagtgctgctcctgagttcgatagccatcgtttcaggagcgctgagcaccagcagcgtttcgaagccatcaagggatggtccttccatcgagagagacgcgtccaactcagggacgacgagtacacggatttctag

SEQ ID NO: 35857 - DNA, 651 bp, Glycine max
  Peptide Sequence Number=SeqID_127542
atggcgagccaagagaagtggggcccgtttgcggatgttttagctttgctgattttaggggttgtcctctttccgaacgttgacggcttggtagacttagccgccattgatgctttcctcgcatatcaccatagcaaggaaagtccagtggtggctatcttggcagatttgttcgacacctttgaccggaggtgcgagaaaaacagtgcacggattgtctgttgtttacccgctctctgtggggcagcacgatcaattgggtttcctcgttggaaggaaggcaaggaaggagttcttttcttgtgtggggactatcctaatgttccactgatagggactaggggttgtattaattataatcccgcactcgccataagacagctagggtatcccatgaggggagtgccaaccgaagaaagtctctcgcctttccttgtgagggatctaggcgcgcaaggtctcaaagttatacaaagaatccacaaggcgtggaggagtccgttgaggaaagacaaggagcttaggggcatccgaaacggcgtcattggaggttatcatggatggctaagaattcacacgcgggggttagattggctctccaagttgaaagttatcgacgagggagaacttcgaagctccggaggaagatga

SEQ ID NO: 35858 - DNA, 528 bp, Glycine max
  Peptide Sequence Number=SeqID_127543
catcggctaactctgtgccagcagccgcggtaagacagaggatgcaagcgttatccggaatgattgggcgtaaagcgtctgtaggtggctttttaagttcgccgtcaaatcccagggctcaaccctggacaggcggtggaaactaccaagctggagtacgatcggaaagaacaccaacggcgaaagcactctgctgggccgacactgacactgagagacgaaagctaggggagcgaatgggattagataccccagtagtcctagccgtaaacgatgggatactaggcgctgtgcttatcgacccgtgcaatgctgtagctaacgcgttaagtatcccgcctggggaagggggtgccttcgggaacgcggacacaggtggtgcatggctgtcgtcagctcgtgccgtaagactggccggtgataagccggaggaaggtgaggatgacgtcaagtcattcatgccccttatgccctgggcgacacacgttgctacaatggacgggacaaaggatcgcgatcccgcgaggg

SEQ ID NO: 35859 - DNA, 760 bp, Glycine max
  Peptide Sequence Number=SeqID_127544
agcttcccgtatcacagggacaccaggattatttattctgcgaagtgatcttccgtcacactggcctctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggcgaattggagctccacccgcggtggcggccgctctagaactagtggatcccccgggctgcaggaattcgatgtcttttgaccactggataaactccatgacgattaagaagtaccccgggaaacccatttgggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaaatggcttacgaacgggcggagatttcctgggagatgccaggagatacttaa

SEQ ID NO: 35860 - DNA, 192 bp, Glycine max
  Peptide Sequence Number=SeqID_127545
atgaagatgttaggtgcacgagtgatttacaaaagagggtggaccactcaaaacattcatcataccacctattttacgaatgatgcaatcctacccccaagggcattggatagaagactccaagaagattgggccaaagatgcaagaaaaggccctagggttctcatgagccttaggggctccataatgtag

SEQ ID NO: 35861 - DNA, 267 bp, Glycine max
  Peptide Sequence Number=SeqID_127546
atgtctgaagaggatagaaaacgagtacatacactaaagccaaaaacatatacatctgccctaggaatggatgaatatttcagagtttcaaattgcaagagtgctaaggaaatgtgggacactcttcgattaacacatgaaggaactacagatgttaaaagatctaggataaatgcactaactcatgagtatgaattatttagaatgaatacaaatgaaaatattcagagaacacgagatggaactattgagattgcaccaaaatga

SEQ ID NO: 35862 - DNA, 252 bp, Glycine max
  Peptide Sequence Number=SeqID_127547
atgttgatgcgcacgatccgcactcgtctttttgcagcggcacgggtgaaatcttgccccggtatgcatagcagatgcgtgatagcctccctctctggatgtgctcgcacagttggtcgccctccaatatcagggggcgaggatgtgagccctctgatggcgaggacatatagtcctctaaaggtgataggtactagtacccaagggtccacctttatgagaaagcaagagatcggctcatcgagagggccg

SEQ ID NO: 35863 - DNA, 405 bp, Glycine max
  Peptide Sequence Number=SeqID_127548
tccccaaatcctttccacagccctcaatctttcctcaaggagatcgagcttcctcctttcttcagttgccgggggcggcccttccatagacaaaactattggcgatgctgcgatgttgggttgaggcaacgtgcctggtgccggcccttcggggatcgggggataaaactcgacatccctccgagcataatcttgagggtctttatggacttcgtagtcgggcgcaatgatggaggctctttttcatggacggggagaagcaatgtggccttcgctcgttcttggcaagagggggtcgagtggtgccatcgtgccccagttggaacttgggatcccttccccgccctactatgtttgagggaggtgggtgcgcttagttgccaagagagtcgggtgttgaactag

SEQ ID NO: 35864 - DNA, 918 bp, Glycine max
  Peptide Sequence Number=SeqID_127549
atgcaattaggaggattcgatgaaaggacatcaattcaaatcctggattttcgaattgagagagatattgagagaaatcaagaattctcgctatttcttagattcatggacccaattcaattcagcgggatttttcattcatatttttttccatcaagagagttttataaaactcttggactcccgaatttggagtatcctactttcacgcaattcacagggttcaacagcaatcgatatttcacgatcaagcttcttactatacctatgaattccattggacccaaaaatgatacattggaagaatcatctgagtcttccaatatcaataggttgattgttccgctcctgtatcttccaaaaggaaaaaagatctctgagagctatttcctggatccgaaagagagtactcgggttctcccaataactaaaaagtatatcatgcctgaatctaactggggttcgcggtggtggaggaactggataggaaaaaagagcgattctagttgtaagatatctaatgaaaccattgctggaattgagatctcattcaaagagaaagatatcaaatatctggagttcctttttgtatattatatggatgatccgatccgtaaggaccatgattgggaattttttgatcgtctttctccgagaaagaggcgaaacataatcaacttgaattcgggacagctattcgaaatcttagtgaaagactggatttattatctcatgtttgcttttcgtgaaaaaataccaaaggaagtggagggttttttcaaacaacaagggactgggtcaattattcaatcaaatgatattgagcatgtttcccatctcttcttgagaaacaagcgggctatttctttgcaaaattgtgctcaatttcatatgtggcaattccgtcaagatctcttc

SEQ ID NO: 35865 - DNA, 307 bp, Glycine max
  Peptide Sequence Number=SeqID_127550
aaaaatcaaatcgaagtacttccgtaacgcttccgtaagcgattctgtggaaattcttcatcgttcttcgtcgttcttcaccgttcttcatccgttcttcgttcttcaacgggagcaaaagccccgcttttgtcgaccaccccaagagatcgttaatggtccaaatgccttaacgtttctctcctttcaccccaagagatcgttaatggtccaatgccttaacgtttctctcctttcaccccaagagatcgttaatggtccaatgcccttaacgtttctctcctttcaaaatcaaaagaccgtttaa

SEQ ID NO: 35866 - DNA, 219 bp, Glycine max
  Peptide Sequence Number=SeqID_127551
atggtgaaagttggaacctcttacgtgccgatcaacgtctcattttcgccaaaagttggcccagggcttcccggtatcaacagggacaccaggatttatttattctgcgaagtgatcttccgtcacagctgcattaatgaatcggccaacgcgcggggagaggcggtttgcgtattgggcgctagcggagtgtatactggcttactatgttggcactga

SEQ ID NO: 35867 - DNA, 438 bp, Glycine max
  Peptide Sequence Number=SeqID_127552
atgcatgcgttgtatgttggtctcatcttttgtcacgggaagtcggaaggtccatgtcaactgcacacatggggcactgcgcctccgaatgcgcaagtaagaagagatgattttccgggctctcgtgttcgtaaatgcattcatatcattcatcgcataagcatttcttcatggcatcatgatgaacatatcgttcctgcatttgtccgttatcatattccaagttgcttccgaacagctcgcctgggcaagcttggcggcaacctcctcaccgtttttcctataaataggcaaaagggggttgttccaaatatccctcatccccctggctatgaatttcagctgttttgggtgaaaaaaattgtttccgtgaagaaaatcgaagctgaggtgcttccgtatcgctttcgagacgtttccgtgagcaaatccgtgaag

SEQ ID NO: 35868 - DNA, 585 bp, Glycine max
  Peptide Sequence Number=SeqID_127553
atgtcacatctcccaagatatttgaagcatttaatgttgctagtccttgcttgggaactagtcttaggagtggatttctctatggtcttacccttatcttctttgggttttgaagttgttgctccattcttatacaaagttggactagctcatctaggtccttatatggaagggttccatttgttgtctatattcttcaacactcatagtcccttgtctaagcctttggagcttgtccataaactccctttcatagtaagagggaatgtgcctcttcctaagggcactcttaagatcattctaatactctactggaggatccccatgaatcattttttccctaacaagggaagtccaccaatagagggtatacccttgaaagctaagggtagccaatggaactttgtagaagcaaagcttcatgatgaatcaaagttgattcaaagagttcaagaaaagaatcaagaagaattcaagattcaagaagaaagcctagaatcaagaatcaaggttcaagatctcaagaatcaagatcaagattcaagactcaagactcaagactcaagactcaagattcaagaatga

SEQ ID NO: 35869 - DNA, 345 bp, Glycine max
  Peptide Sequence Number=SeqID_127554
gattgtcatcataaaaatgggggagattgtggaagcaatatcttccaaggttattttgatgatgccaaagaatcaagagtcaagcaaaatccaaagattcaagaatcaagtttcaagaatcaagattcaagattcaagaatcaagattcaagactcaagattcaagaatcaagagaagactcaatcaagataagtattaaaaagtttttcaaaacattgagtagcacaagaaattttcacaaaatcattaccgaagagttttactctctggtaatcgattaccagaaggtagtaatcgattaccagtgttttaaaacattagatttcaaatttcaacagttttaa

SEQ ID NO: 35870 - DNA, 360 bp, Glycine max
  Peptide Sequence Number=SeqID_127555
atgtcaggatttacacgcaattctcctcaaatttcagccagcccgcatcaattagaccttgcaccttacgcttcaaagccctacaatgctcaatggaacgccccggggcttctccgtgacaagcacacgttgcgttcgagtcgtattcttggagaaatggaggttgatgaaccttggctagggttatggctaccattgaattatcaagtagatatgggatcaagtttagcatatgacaacggaatttggggtgaaccctacaggctttttgctgcaaaattcacttcttggttggtgtttttggtttgtgctaaaggtggtgttcgtcattggaagtgcggtagacagactttgtggtag

SEQ ID NO: 35871 - DNA, 258 bp, Glycine max
  Peptide Sequence Number=SeqID_127556
atggatatggcatggggaagtgccgaacatgccaacagtctctcaagcttagccgagatgcgtaattgtcccataggtggggtatcatggtacagagcaaaccatggcgaatatagtgttgatgcaatcataaacaatagtcgtccaacaaagacggccggaaaagtgatggattcctccgacatccgactgatagtctacaatggaaggcaattgatagtctatatcctgattttggggacaagccaagaaatctaa

SEQ ID NO: 35872 - DNA, 483 bp, Glycine max
  Peptide Sequence Number=SeqID_127557
atggttgattatgagtatttgaagatcgttgttgggggtggagtttctagcgggaataattttatatcagtcgatccagatgatactgatgcaacaacttttgagccagaaaatagaactgttgggatagaagaattttcatatgatcctaatagtgatacattcataacaccaaataactatgaaccagcatatcagcctccatcaccaaaccaaccaagtccaccatcccacccccctttagattcagaggttcccatagaaaaacaaaactgtcacaagcgaaggagatccgagtatggagggagttcaagcgctgttgggatcaacaatcaaggcaacgttctggaaaatctttctgttggcattgggactattgctgtgaattttgaaaaaatatccaacatgatggagaaaagagaaaaagatagagatagagggtattatttggaatgttataaaagaaattccaaatttggatga

SEQ ID NO: 35873 - DNA, 159 bp, Glycine max
  Peptide Sequence Number=SeqID_127558
atgaccaagttcgaccctgagatagtcctagagttctatgctaatgcctggcccacggaggagggagtttgggacatgcgctcgtgggtatggcgcctactaggcatctctctggactcaggtaagttccaacagggccctttgggtttccggcactga

SEQ ID NO: 35874 - DNA, 504 bp, Glycine max
  Peptide Sequence Number=SeqID_127559
atgatttttctaagctcgaaattaaccctcactaaagggaacaaaagctggtaccgggccccccctggaggtcgacgatcgactcgaggttcgacagcttttgcaagagtttatggagcgtgttggagatcgaattcctgcagcccgggggatccactagttctagagcggccgccaccggggaggtgctccgattcgccctatagtgagtctgattacaattccctggccgtcgctttacaacgtcgtgactgggaaaaccctggtgttaccctacttaatcgccttgccaaacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 35875 - DNA, 220 bp, Glycine max
  Peptide Sequence Number=SeqID_127560
tcgccctaagcggaccctatgggctcagcgcgcatccaccgctaagtgcagcttcagtgcgcttagcgtgacaagggaatctggcagagcacaagtatcaaggctgcatgctaagcatgagatcaactcgctaagtgagatagctgcatattttggcacagacttcaagaataatgctctggaggcagcaaagaggagcagctgtgtagagaaggctaag

SEQ ID NO: 35876 - DNA, 159 bp, Glycine max
  Peptide Sequence Number=SeqID_127561
atgacaatgctaacaaaggcaaccattaggtccttccaagaatggactcgggaaggttccaagttagtgtaccagatgggtcttgggacaagtagtccccttgtacttgtcaaagttccagcacctgaacttgggaggggtgatgatattgggtactag

SEQ ID NO: 35877 - DNA, 540 bp, Glycine max
  Peptide Sequence Number=SeqID_127562
atggatgacaatataactttaatattgcaccatggaggaagattcactcctgtgccagtgatggaaaggagttgtacaactgatggagatatattacacttagtgagggatgcttttgaaaatgagaatgagataaatgtttattttcatcatgaagtagatccaattttagaagtcccacagatgttgtacttggaatgtcatccaattccagaagctgttgagaataaggatgatttagatgatgtacctattgctggccatgaggaagatgttggtggtggagagagagaggttggtgacggtgagcagagagatgttggcgagcagagggatgctgatgctagtgagcagagagatgttggtgagcaaatggatgctgatgctgatttctcttgtatgaggaatgaagttgaagttgaagttgagagagatggttatcattcagaggagctgaaaatccccattagtagtgatgatgaagatgaggatgttgaagtttatcctcaatatagtcaaagtagtggatttggtcaatag

SEQ ID NO: 35878 - DNA, 558 bp, Glycine max
  Peptide Sequence Number=SeqID_127563
atgctgaacgaaggaagcgtaggaaaactattttgcaagaacgaaaaagacaacgttcagctactaatgtgtatctcacaatgtagtccaactattaaccataataataaccctgctacaagcttccaatctacaccaccatcgcacgggactttatctatagatgattctgaacgatgctcaaaaagacatgcagtcaataatgccaaattggctgtttattatccagatgaacatcagagaccaactgacactacacagcatgatcaatttgtcggctatgacagctcaaattctagtgatgatgatgtaaatatgacacaggaaaacattgatatagaatactcattaaatgacccaacaatagatgatcttgatgattatgatgaacagacctttctatctgcctcatctacataccaaaatacaggtggtacttacattgatatcggagatcctgtatgggaatgcccacattgtaaggctatgatgtggtatgatgagaggataaatagacaaacaaacaaacaaaccaaggttttcattatgttgttctga

SEQ ID NO: 35879 - DNA, 171 bp, Glycine max
  Peptide Sequence Number=SeqID_127564
atgcatgatgcgatcaaggaacaagccagaggagtatcagcaacaatgcatcaccaaaagaggaaaactctagatgaggcttcactattatcaagcaagtcggagacccagcatgaccacagatcgacctctactccttatggctcacatagacctgggtataaggcctaa

SEQ ID NO: 35880 - DNA, 278 bp, Glycine max
  Peptide Sequence Number=SeqID_127565
gggttgtccaatcgggtgcctggatgatgggggtggtagtcagcgctcttttgaggcaatcaaaagcctctttgcatctgtcattaaagtcaaactccacctccttttgcaacaagttggacagtggaagggctactttgctaaaatcccttataaagcgcctgtagaatcctgcatgaccaagaaaagattgcacctctcgcacacaagaggggtaccagggggcattgcacaggctgaaaggcatcctcctataggcaaaagtgccgaaggggcag

SEQ ID NO: 35881 - DNA, 252 bp, Glycine max
  Peptide Sequence Number=SeqID_127566
atgcatctacgtgatcaaggtggccttgttcatgctcgtgcgcttagcgcacttattgatgaggacatgttcaagagcaagggaaaggatccacttgaaggacttggaggacctatgacaagggctagagcaaggaaagccaaggaagctcttcaacaagtgctgtccatactatttgaatacaagcccaagtttcaaggagaaaagtccaaggttgtgagttgtatcatggcccaaatggaggaggactaa

SEQ ID NO: 35882 - DNA, 532 bp, Glycine max
  Peptide Sequence Number=SeqID_127567
aaaggacagagagcttaggggaagcagtaatgggatcatcggcggctatcataagtggctgagagtccgaaaacaaggattggattggctcccaaatctaaagactgtgagagacgatgaggttaaagcttcggaagaaagtgatgaggtacaagcccaaaaggcagagcttgaaagagcctgggtagtcgaagagaagttcaaggcagcaatagtgagctcaagctccgaagaggcgaaaggaatcatcacgggtcaaaggcatgatcttgaaggacgagctaaagggaatatgtgggccatcatcgataagtgcaaagagaagctaaatctagcggcgactcacgagcaaaggctagaggatgagtacgccaagatatcagcagaaagggaagagtcaagaacttcccccattgctagccaaggcaaagcagtggcggacacctactccgcccccgaggagatccacggacttctcagctattgtcagcatatgatagactcaatggaccatatgattagaaaccgctag

SEQ ID NO: 35883 - DNA, 54 bp, Glycine max
  Peptide Sequence Number=SeqID_127568
atgggtgttgatgaaaaaaggctagagcttcaagaacctcgggagagggaatga

SEQ ID NO: 35884 - DNA, 879 bp, Glycine max
  Peptide Sequence Number=SeqID_127569
atggacggtttggtggacttagccgccattgacgctttcctcgcgtatcaccatagcaaggagagtccagtggtggctatcttggcagatttgtttgatacctttgagcggagatgtgagaacaacagtgcacgaattgaaggcaaggaaggagttctcttctcgtgtggggactaccctaatgttccattgatagggactaggggttgtattaattataatcccgcactcgccataagacagctagggtaccccatgaggggagcgccaaccaaaggaagtctctcgcctttccttgtgagggatctaggcgcgcaaagtctcaaggtgatacaaagagtccataaggcatggagaagtccattgaagaaagacaaggagcttagaggcctccgaaacagcatcatcggtggagacgaagaagtccgagctctcaaattagagctagggaaggcaagactcgccaaggagaagttcaaatcagccgctacacacatccggaaagagtgcaccgacaacaatgagctcaagctccgaagagaggaaagagaccggtcacaggtgcatggcatgatcttaaaagaagagttagctgcttgcgcaaggtccaagaggagtttggctcaacacttggaagccacggagcaaagcatgctagctatcatagggcaatacaaggaagagttgaaccagtctgtggcccatgaacaaaagctagcggaggattttgcacaagtgtacactgaaaaagaagcaagagggagggtgattgatgcattgcatcaagaagcgactatgtggatggataggttcaccttgaccttgaatggaagtcaagacctcctgcttctattagccaaagcaaaagccatggctgaa

SEQ ID NO: 35885 - DNA, 150 bp, Glycine max
  Peptide Sequence Number=SeqID_127570
atgactaaagcacgtcaaaagggggtacggaaagaaaatgagggaggagcttgccacccaactcgcccaggcgagctaggttgcttcctggagaacttcctggaaggcccaagtgggcctggttgctatttgcacccccctatttactaa

SEQ ID NO: 35886 - DNA, 378 bp, Glycine max
  Peptide Sequence Number=SeqID_127571
atggggtcaagtaaaacgccttctcttaaaaagaggttctatcaagtcaaggtcaagagcctaggaatcaccagtctaaaagagttagggcagttgatgggtcagctccagcgacaagcttttcacaaagcttacggtaaaatctgggacctagccatggcagaagtctccacagaggtcattgcctccctcgcccaatattatgaccagccgttgagatgcttcacttttggggacttccagctatcacccatgatggaagaatttgaagagatcctaggatgtcctctagggggaaggagaccatacctcttctcagggttctatccctcattagctagaatttctaagatagtccaaatcttggcacaggaataa

SEQ ID NO: 35887 - DNA, 132 bp, Glycine max
  Peptide Sequence Number=SeqID_127572
atgaagttgttgatgcttttcacaaacttgccaagattattccaaatggatgtgaagaacacctttctcaatggttacattgaagaagaggtatatgtagaccagccaccaagcactaagatcttggtatga

SEQ ID NO: 35888 - DNA, 348 bp, Glycine max
  Peptide Sequence Number=SeqID_127573
atgagttttgcagccaaaaaaaaacctgtagaattcacccaaattccggtgtcctatgttgacttgctcccatgtccactcgataatgcagtggtagccataaaccctgctaggtttcctcaatctccattttttcgaggatacgactcaaacgcaacgtgtgctcgtcatgaagaagcctcggggcgttccattgagcattgtagggccctaaagcgtaaggattttcaagtgcaagccattggtcagtttgctcaagcgacctgtgctcctgagtttggacttccaagaccgttcaatcatagattactcgtcttgcacattggtgggggtgccgtaaaacaatga

SEQ ID NO: 35889 - DNA, 354 bp, Glycine max
  Peptide Sequence Number=SeqID_127574
atgattttcaagaaccacccgtttgatcctgaaaagagaaggactacaccagggactacaccatccatatgtagcagttgcatgtggaggtcaacaccaggttgtctcatgaacgacaactccattagccatcttccggcggtcaatgacatggtgtgcatgcaacgggactcgagaaatttgaacaccttgcaatacatgttctgggggtggtcggctatgtacataataaacatcatactagacagctcaaaagaacaattacacggcatgaatatgaaggcattaaacgaatacatgctttcaggcatcatacatgtttgtgatttgtggaatttcaaaaacatattttaa

SEQ ID NO: 35890 - DNA, 550 bp, Glycine max
  Peptide Sequence Number=SeqID_127575
ggcgtgcaggaacagatgaaggtcgatctatcggccttaaaagatcaaatggcttccatctcggaggtcatgttaaaactccagaaaaccatagaggataaagccaccgcaaccgcctccagtacagttagggaagcggagccagtgctgcagcccgccttgaatctgggcctagatagaaacacggccgtgttcggtcgaaggtatagtccgcaagcttatccttatgacctgcctccggacttcaccccccgtgccaccccagaagatttaaaccaagcccctacttttgaggggcaactcccaccttatgaagactatcccgggcaagacgatggggaaggagatacccatcttggcccctgctccacctcaaagatccgtccccgcatgaactaccccaaccgaacatatttggccggggcagctgtagcatggtataccaatctggaagcttcccagatccgatcatggaaggacttggcaactgccttcattaggcagtaccagtacaatacggacatggctcccgatcggaaccatcttcagg

SEQ ID NO: 35891 - DNA, 180 bp, Glycine max
  Peptide Sequence Number=SeqID_127576
atggctggaagaaaaattggaggcgagggttttcgagagagaaaggagttgcagggacgcgttgtaatcgattacaccaatctgtatttcaatgatgctagaccactggaaccagagagattgaaggcacttcgcatccagtgggcaaagtattatttgaaagttagaaatgaaacttag

SEQ ID NO: 35892 - DNA, 654 bp, Glycine max
  Peptide Sequence Number=SeqID_127577
atgtctctgaaattacctgtctattctgagttagttaaagctttttattcaaatttagaaattcatgaagatgttctaatgtctaaaatctatgggattaagatggtcattgaccaatccctattctatgatttaacaaaattgcctagtgaaggtgtgcctcttgagggtgcactaattgatgaatggaaattcgatttctctgtgcatgatgcccgccggttggtttgcaccaaccaagcggatatgaccggaagacttcttgccggttcattggcttttgaaagccgcatcctccattaccttattgttcgcattttgcttcctagatcttcaaaccttgcccaggtttctgaagaagatctcattgtcatgtgggcctttcataaagagcatgatggatcttggataaagaagggtgctaaaaatgttggtgaagaaggacatgagggagaagattcatctcttctttctaaaattttggaaaggtttgatggtcttcaaacctttgttggtgagaggtttgacactttggaactacaagtggatatgcgcttcaatgaaatggagtcaagaatgactaaggttgaagaagatgtatcttacatccggtcaagctttgatcttccaccgccgccgccaccatcatcttag

SEQ ID NO: 35893 - DNA, 1345 bp, Glycine max
  Peptide Sequence Number=SeqID_127578
atggccaatcaaggagattgggtcccgtttatggatgtgttagctttgctaatttttggggtcgtcctctttccaaacgtagatggtttggtgggcctagcagcaatcgacgctttccttgcataccaccatagcaaggaaagtccggtggtagctgtcttggcagatttatttgacacatttaaccgaaggtgcgaaaagagtagcgcacggatcatctgttgcttgcccgccctctgtgtttggttggtttcacacctgttccagcaagacacgaggcatccatgtccgctccagagccatcgctcgtgtactgaaaagagaagaatagattgggaccagcttttggctgggataggaggtagaacaatcaattggttcccccgatggaaggaaggaaaggagggagtccttttctcatgtggagggtacccaaacattccgttgataggaatgaggtgttgtattaactacaatcccgcgctcgctataagacaactagggtaccccatgaggggagcaccgacggaagaaagcatgtctcctttccttgtaagggatttcggcgcgcaaaatttcaaggctatacaaagaatccataaggcatgggaaaccccgttaaggaaagatcaagaacttaggggcgttcgtaatggcatcattggtggttatcatgaatggctgaaattaaaagtcgtcagcgaagagagttttgaagcatcggaagaggacgaagaagtccaagctctcaaaagcgagttaggaaaggcaaaacttgccaaggagaagttcaagttgaccgctacacacgttcggaaggagtgtgccgggttacgggaagagaatgcaattaccgcaagagcccttgaacaagagaccaagagggctcgcaaggaagagtatggccggaacaaatttcgcggagctctatggggtagcaatagtgaactcaagttgcgaagggaagaaagagaccaatcgcgagcacatagcatggttctgaaagaggagttaattgcttgttcgaggtccaaaagaagcttgtctcagcgtttatgcgagacgaagaccaacatgctagctatcatcactaagtaccaagaagagttgggtctagccatggcccacgagcatagaatcgcggacgagtatgctcaagtatacgcggaaaaagaggctagaggaagggtgatcgactctttacaccaagaggcaaccatgtggatggaccggtttgctcttaccttgaacgggagtcaagaacttccccgcttgttagccaaggccaaggcgatggcagacacctactccacccccgaagagattcatgggcttctcggctatt

SEQ ID NO: 35894 - DNA, 297 bp, Glycine max
  Peptide Sequence Number=SeqID_127579
atgtcagttattatccgcccatcacaacctgatttgaattttcaatcacaaaaccaagttattaacggcaatcacctgcattcaatgaatcatcctttcaccctgaacagcaccaaaaacataaagcagtattccataagcccggcgacatcagggtcgatcatgtacctgatccaacgtctcccgcctgtgagaattcaaactttaaacattacgggccccacagcattccacttgctgaagctgcgcacggttatcagattttcaacgagaaagaagacgattgcgttaaagtag

SEQ ID NO: 35895 - DNA, 675 bp, Glycine max
  Peptide Sequence Number=SeqID_127580
atggccctgaggaaacttgcctcaaagagatccaggaaggataaggcggccgaaggaactagttccgctcccgagtatgatagtcaccgctttaggagcgttgaacaccagcagcgcttcgaggccatcaagggatgggatgacgagtataccgatttccaggaggagatagttcgccggcggtgggcatcgctggtcatccccatggccaagttcgatccagacatagtcctcgaattttatgccaatgcttcaccaacagaggagggcgtgcgtgatatgaggtcctgggtgaggggtcagtggatcccgtttgatgcagatgctatcggccagctcctgggatatccttcagtgctggaagagggcctagagtgtgagtatggccagaggaggaaccggtctgatgggttcgatgaggaggccatcgcccagttgctatgtataccggggcaagattttgcccggactgctgccgggagacgggttcagatcatgcgcaccaacatgaccaccctgactcagatctggatgactttgctgctcagcaacatcctgcccagcgaccataatttcgacctccccctgccgaagtgtcagctggtgtacgccatcctgacgcggatgagaattcatgtggctcagttgatcgctgatgccatctatatattgcag

SEQ ID NO: 35896 - DNA, 210 bp, Glycine max
  Peptide Sequence Number=SeqID_127581
atggtagccataaccccaaccaaggttcctcaacctccatttctccgagaatacgactcgaacgcaacatgtgcttatcatggaggagccccgaggcattctattgagcattgtaaggccctgaagcataaggtgcaaggtctaattgatgcgggctggctgaaatttgaggagaatcgtgtgattttcaagtttatgccattattataa

SEQ ID NO: 35897 - DNA, 264 bp, Glycine max
  Peptide Sequence Number=SeqID_127582
atggcgtctagagtttttgaaggagcaaaagatatgggcaatgcaaaaagcgaaggcccacttgggccctccagaagattcctccagaaggctgttgcttctggaggaagcaaccctgctcgcctgggcgagctgggcagcaagcatctcccctattttgctataaataggggaggaagtgaagtggaaaagggttcagcccctgaggcacttctctctctttcgaatttgcttggaaaaattgtttccgtgaagaaaatctaa

SEQ ID NO: 35898 - DNA, 285 bp, Glycine max
  Peptide Sequence Number=SeqID_127583
atggactcgggaaggttccaagttagtgtaccaggtaacagctaccctagtaagactttcttggaagaaatcccccttgtacttgtcaaagtccagcaccttgaactgggaggggtgagatctcattgggtacttggaagtcaacactcgagcgttctaggctcttcccaccaaaattgccccaatggtggtctgcttgtgggcgaaactgagggccttaccacaaggttttcaaaggtggtcttcgtcattggaagtggtagacaggctttgtggttgatttag

SEQ ID NO: 35899 - DNA, 421 bp, Glycine max
  Peptide Sequence Number=SeqID_127584
atggcctctggtaatcgattaccaagggtgggtaatcgattacaaggcttaaaaagtgaagacaggaagctaagatggcctctggtaatcgattaccaaggggtgcaacatgttgtggaggcctctggtaatcgattaccaggctgtgtaatcgattacacaggggaacatgccactggtaatcgattaccagtgcctagagggagcttgggagaccctcgaaggcaacacgaggtgtcgatttcggggcacgattcgatttacagctacttcattgtccaagtgatcgaggtgacgtcatccgaggaagaccctgaggaggatcccgaggaggtacctcctgagcctgctgtggatgctcttgactttctagagggtgatgaggacccactccctgagtggattctcccgaggacgtcat

SEQ ID NO: 35900 - DNA, 231 bp, Glycine max
  Peptide Sequence Number=SeqID_127585
atgggcaccatcaagtgcaatgaccatggacaaattaaagcgcctaagcatccccacagcgaatgcttagattctttaaccactctagtccgccacgaatgggccgtccaacaaggtcaaagcaacccccccatgaacatacccaacatgcacatgtcaatgcatttccaagatcaatcaacattccatttccatatcattctcaacataaatatcatctcgtctcaatga

SEQ ID NO: 35901 - DNA, 432 bp, Glycine max
  Peptide Sequence Number=SeqID_127586
atgaagcacttcactgacaccctcatcagtgccaacataagcatagtaaaaaattcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 35902 - DNA, 315 bp, Glycine max
  Peptide Sequence Number=SeqID_127587
cgtccgctaagcgcaacactcatgggctaagcgccaggaagactctagaagaagatgaactatacaggttcactaagcgcaccgcttcagttcatctgctaagcgagaaggcacacgctaagccgaaattcactaatgattcagagctttgcatgtctagggtttctagagagataaaggtccaagttctagagagttttgagagattttgctgtgtgaagatctgcagagacaagagcttgaatggaaactggtctgactctaaagtccttgatagtgcagggctaagttattgtactatcacgaggaatcagg

SEQ ID NO: 35903 - DNA, 315 bp, Glycine max
  Peptide Sequence Number=SeqID_127588
atggtgggttacacaccttcaagctttgcggatttggacttcgccggcagaaggatcaaagcgggtctaaaaagaggcaaatttaatcatcccacttggacgaatgagaaaactggggcaaatgaagagggtgaggatgagggagaagcccatgctgtgactgccattcctatacagccaagtttcccaccaacccaacaatgtcattactcagccaataacaaacctttctccttacccaccgcccagttatccacaaaaggccatcccctaaatcaacccacaaagttctggtcctaccgacacttccaatga

SEQ ID NO: 35904 - DNA, 817 bp, Glycine max
  Peptide Sequence Number=SeqID_127589
atcgcgtcttttccggtttttccgacgttttcctcgaataaacgttggtggcgactccgcgcgtattcctttcgtggaacacgcatcccgcgagtctcgcgtcgccctcccgccgaagggtaggttgcgacagttggcgactccactggggattgtttttagagagagtggaggtgaatctgtgatcatgctagtctccgacttgcttgattacagtgaaccctcatctagagcttttctctttgaaaacctattgttgctagtagtccctactgctacatatgttcttcaaggggatgatacctctagaaccatcagagagatatactacttggggattattgctaaaagcctagcattgcatatgggttctgtcttgatccctactgtaaacaaaccaacggagggtccgtgtcgccttcttaaaaacgtgcgttggggcatttcgctacccctagacgtcgtatctaagaaggggacaaattccccggacccccgcattcctagattgcatctgtgtcatatgcattccatcatgcattcatccatcccacccatgagatatcggagttttgatttgcaccagcttttgtctcactttagtaagcatgggaacaaatcaaaccggcaagaggttctaccaagtcaaggtcaaaagcctagataccaccagcatcaaggaatgagggcggttgatggaacccctccaaatgcaagccttccgcaagacttacggaaagatcttagagttgaccatagcagaggtgtccatagaagccattgcatcacttacccaatactacgaccagcctttgag

SEQ ID NO: 35905 - DNA, 270 bp, Glycine max
  Peptide Sequence Number=SeqID_127590
atgtccaaatcttgtggatttgggatgaccggccctctcgatgagtcgatctcttgctttctcataaggaggactacacgtccttgccaacagagggctgcacgccctcaccttcagaggactacatttaccctcaccgttgagaggactacacgtcctcgccttgagaggactacacgtcctcaccatcagagggctgcacgccctcacctccagaggactacatgtcctcgccttgagagggctacacgccctcaccttgggtactag

SEQ ID NO: 35906 - DNA, 357 bp, Glycine max
  Peptide Sequence Number=SeqID_127591
atgcactgcaggcgcagacgcaccgccaccacgcatcaggctgatcccgttgggtcattaggcatggagcggtatctacagcacttggttcgccaacaggcggccaaccaccgggggcaggtgcagatacatgagtgtctctaccagctcagcctcagtcagcagggccagggtttcgctccttttgcgtgccctactccagatcagtttaaggctgaggttgcatggcccggagattggcccgaggcccaggcaggggaggcgcctgcaggagctcccggcgatgcagaggaggcccgcatggatgaggagatgacagacttgctcggtttcttgggaggaagcggagccacgtga

SEQ ID NO: 35907 - DNA, 577 bp, Glycine max
  Peptide Sequence Number=SeqID_127592
gtatatcatgaattcaattattacagtgttgtatttcaacggaagagtatatgaagataatgatggtgtaatatttgaaggcagtaaaaaggtcattcagattaaacgcggaattagtttcaatgctttgaaaaaaaaaattggagataaggtggttcgatgtttccatgctgcaaattctgttacgtcatgtggacgtaatgtatctcatcatgagtcggaactaccaagaaatataagtaatttacatgatgatgaagatgatgattctaactcatacgttgaagagtctttcgatgaagatgatagtgatgatggaatatctgatacagacgatgaagtcactgacatcgttgaaccagtttcaattgttcacccaagcgaaggtgtaccacaaattcaaaatccattttggaatgatgctatgcattataataatatcaattggagtcatccggacgaggaggacatttgtgatctggacataccaacgacttttaatgttggacaagaattatatgttggcatggattttgacagtaaagatgcggtaaaaaatgcactaaacaatatgtga

SEQ ID NO: 35908 - DNA, 318 bp, Glycine max
  Peptide Sequence Number=SeqID_127593
atggccaagaaaaggggttttcagtccttaccgtactctaacatacccaacatcactaatacatatagggatgaggaagaaaaacttgaaaaacaaaagaaaaagaaggatagtaaggccttgtcttcaaaggccaagaggaaggaaaaggaggaaaaggattcctccaagaatattgttaacaaggaaaatcattttgcaacaaaatgtgatattaaaagagcactccttcttaaacaatctttctaccttctcctatcaagggaaacatcccttagcaccaccatacctcttgagcttgagttattcctcaagtaa

SEQ ID NO: 35909 - DNA, 565 bp, Glycine max
  Peptide Sequence Number=SeqID_127594
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccacttttccaacctctgaccatattccctgctttggcttgtaaagctgatccgaggcgcaagaaagattctcacttgggtcaaaaggggaaagaagatataagacggaacttcataggggaaaaagatcttggcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 35910 - DNA, 243 bp, Glycine max
  Peptide Sequence Number=SeqID_127595
gggaggaggcaggtgagacaggtagctactaccactcctgagagatctcttgaggccactttagagcctcctacaccagtggtggacctaccctcacctgagagtacagcagacccctccactcctattctagagataccagaggacccgaccacaccagtcttggctatggacacttctcctttagctactcaagtactttatctgacagataaggaggatgttcagacacaagatacctag

SEQ ID NO: 35911 - DNA, 333 bp, Glycine max
  Peptide Sequence Number=SeqID_127596
atgtgcgtagcaggatacttggcgcgtatgcacgctggaaatggcttcgaaaagctttccgcgaagagatctaggagggacgccgcggctgaagggaccaatgccgctcccgagcatcagcagtgtttcgaggccatcaaaggatggtcgttccaccgagagagacgcgtccagctcagggacgatgagtacaccgactttcaggaagagatagctcgccgacgttggacgttgttggtcactcccatggctaagtttgacccagatatagtcctagaatttcatgccaatgcttggcccacagaagagggagtgcgggacatgcgatcatgg

SEQ ID NO: 35912 - DNA, 411 bp, Glycine max
  Peptide Sequence Number=SeqID_127597
atgactgatcttcactctaatctgcatgcttgtcactcttcatgcattgaatctgaatttgtacttaatcatatgtctgaatttgatgctgagagcgaatctaaatttgatattgattacatgtcaggtgatgttttaccttttgagattgattttctagagtcagatagaactaaccatgtttcaggaagcacatatacctctgactttttttatgaggtacaggctgagaaactatctctttctaccactatccagccacccacaccagaattgaagcctcaaccacccacatatgcttacttggatgatagcaaaagttttccagtaattatatttgcctcccttgttgatgagcaagaggagaagttgttatcagttctcaagaagcataagaaggctataggctag

SEQ ID NO: 35913 - DNA, 270 bp, Glycine max
  Peptide Sequence Number=SeqID_127598
atgataatcaaatttcacgatgatccaacggtgaacgggttcgagatcgttgtttttctgagacagatttggtgggctgcgggaaaaagaaagggttttgagaggagaaggggaaaaacgaaaatgaggccaaaaaggaggtttcagctgacaattcaaatactatttataacctttgggtcacgctcaacacatagcatatcaatttcggcgggagggcaacaattgggatgctgttcccaaacatatatacattcgccaccaacgtaa

SEQ ID NO: 35914 - DNA, 441 bp, Glycine max
  Peptide Sequence Number=SeqID_127599
atgtcggcaatgctagccaagcggatgggcgcgaagaaggtcatggtgctgatccagcgtcgcgcatatgttgatctggttcagggaagcgtgatcgatattgcgatatcaccgcaacaagccacgatttctgccttgctgagccacgtacgtaaagctgatattgtcggtgtttcgtcgctacgccgcggcgttgccgaagccattgaggccgtcgcgcatggcgatgaaagcacctcgcgggtagtcggccgttcaattgatgaaattaagctgccgccaggcaccattattggcgcggtggtgcgcggcaatgacgtaatgatcgccaataataatttacgtattgagcaaggcgaccacgtaattatgttcctgaccgacaagaaatttatctccgatgttgagagactattccagccgagtccgttcttcctgtaa

SEQ ID NO: 35915 - DNA, 186 bp, Glycine max
  Peptide Sequence Number=SeqID_127600
atggatttaacaacagttattaatgaatttgacacttccaatgatttcaaaaagactgtaatcgattacacaaaagcaaagcttcatggtgaatcaaaggtgattcaaaggtgttttgatgataacaatgatgatgacaaaggtgatgacaaaaagctcaagatcaatcaagaacaactcaagtga

SEQ ID NO: 35916 - DNA, 447 bp, Glycine max
  Peptide Sequence Number=SeqID_127601
atgccacctactaggcaccctctagacccagataagtctaacagggccctgggttttccggcattgatcacaggtctctgccagtcgttcggggttcctgccacacctagtaaggtgattcgaccaccgatcacccgggctttcatagagaagtattgcacgcccaaacaggcgcaggccccagacgcaccgccgccacctcctcaggctgacccagctgggtcatttgacacggagcggtatttatggcatttgagtcagggtttccctccttttccatgccctactccagatcagttcagggcagaggttgcatggctcggggattggcctgaggcccaggcaggggaggcacccgcagaggctcccggcgatgcagatgaggcccgcatggacaaggagatgaccgatttgctcgatttcttgggagggagcggagccacatga

SEQ ID NO: 35917 - DNA, 214 bp, Glycine max
  Peptide Sequence Number=SeqID_127602
atgtatgagggaaagcctagacatttatagtagccaagatgaggctactacttcaccttcctctagtgaaagtgaagaagcaaaaagggaagaatctagtgaagaaatctacccccaagaagatggacaaccattagtggttaaagagaagtgtaaggaggcacttgctagcattgccacacctcttgggcttgagtttattcctcatgtataa

SEQ ID NO: 35918 - DNA, 165 bp, Glycine max
  Peptide Sequence Number=SeqID_127603
atggttatgttgggtaatggggatatcactagtgcatcttcttctagctcttatagttcttctagtgagagtgaaagtgaatgtgatgtacaacccctgctagccatctttttcttggaaggccttggcaatatgataagggatgttgtacataaagagcaaaag

SEQ ID NO: 35919 - DNA, 535 bp, Glycine max
  Peptide Sequence Number=SeqID_127604
attacccagtcaaggtgcaccttttgagggcaccattgttgatgactggaaattcgactattctagtcatgatgctcactgtatgatcgactgggctcacttggttatgtaccaaatgcataaggcattacgggccaatgcacctcttccatatcctcaattggtcactctttttctccgtcattttcaaattcctcttgatgatgaaccttttgttcaagtcaagcgatcttttgccattggtgctggtgcagtaactttatttggttatagtaaggatcgtgatggacaatggctaaagaaggacacgctacctctgcaagacgagcgtactctctctcctcctcctcagcgggatgattcctcagcccttatgaatgaagttctttcggaattaaggggcctccgcacctatgttggcgaacgctttgattccttggatggtcgctttgaaggcatggatacccgcatcacccaacttgaagaggatgtgacttatcttcgtcggtgctttgatcttccaccactgtcttag

SEQ ID NO: 35920 - DNA, 131 bp, Glycine max
  Peptide Sequence Number=SeqID_127605
atggcggaaccatcaaagaagtgcaaaggttcttcaagtagaatccaatggcattctgaggctcaggatactccaattccttcctttatttcctcctcctcattgttctcattggaagaacaacgtatatg

SEQ ID NO: 35921 - DNA, 560 bp, Glycine max
  Peptide Sequence Number=SeqID_127606
ggaagaatatcaagacagttccaacagtgaggaagatgctgaaaacttcaacttgacgttaagaaaatttggaaaatttctcaggaaatcaaaggacaaaaaattcttcaaatcctccaagaaggttgacaactccaacaacaacagctacacatgttttgaatgtgcctacatagcatgggaagatagtgcatcaacaccttgcaactctttaagtgatgaagaaattgctaatgtgtgcttaatggaaaaatccatgaatgatccgtcaacaagtgaagaaattgaggtaaattttgattttgaagaactttcagaagcatttaatgaggaagctcaaaggctgcctgtgttaaacaaaatgctgaagagtgaactaaagttgcatgacaataattcaacacaagaagagctaaacaaaatgaagcaagaaaatgaaaagcttgtttcagagtgtaaagccattacttgtgattatacctctaattcctttaacatggatgattacaagtttttgctagcagagtttgaaaatttcaaaaaggatcgccctgttgaat

SEQ ID NO: 35922 - DNA, 876 bp, Glycine max
  Peptide Sequence Number=SeqID_127607
atgatctcaaacgggatatgccagcttcaagatgatggtcgagtgattataccgttccatatcattgttcaggttctgaagagaccattgaatgaaagggtcggtctgaaccaatttgaaacagcactcctatcatcgttgaatagtttgtcgcttgacgttggttatccattttttggtataccttgttggctattgtgggagtattttggtgctagtttctactgtatcagaatcaactcgtttcttgtattgggaatatcgatagtttctttgtctgatatactgcatggatcgcggtttgattcaggtattttcaatactcaagttcacatcagaattgctgaagttttccaatcaaacgagcaatatggacctgatatgccacggatgatcactcggaaacacgacagctattattccgttgactgggttgacggcgagacattgcaaattgtgctcaatggtgagaatggaccaggagtggatatatactttattctgaaacgcgcaaaatactctggctatatcatagttttggatcaacgaaaacgacttggttctgatattacaaactcggatctgaccactttccgatcaaaattaccgaacccgccagcatgtttaaacaagttcaagttggactctgtttttggtttgatgagcatatattcagagattaacattaaccatgttccagattcaacgtattttgtttctgcatcagattctctgtattttcatggttcactctatgatcatccaaggtgttctatggccattgatgtcaattctgcattgaaaatctcgatcaaacagatattctgtggtaccaatcatgagcaaacggatttagcaaacaaggtcattgaatag

SEQ ID NO: 35923 - DNA, 382 bp, Glycine max
  Peptide Sequence Number=SeqID_127608
gatttggcccgaactgttcggcagattcccacgcattacgcacccgttcgccactttgttttcaactgttcccacctcctgggcgagacaagcaaccttcacgctaggagcctcttttccttctgcccagctccccgaaaacaacgttcgacttgcatgtgttaagcatatagctagcgttccttctgagccaggatcaaactcttattttgagtatgattgggccctgcagtgggcgaatcatacatccactcagaatgccgaggatcctcagacgagatcctatactaggttccacgggattcatcaggacactggcttaatcgttctagcgggttactggacaagactgtattggcaataccggaacatgccgcgttga

SEQ ID NO: 35924 - DNA, 270 bp, Glycine max
  Peptide Sequence Number=SeqID_127609
atggtgaaagttggaacctcttacgtgccgatcaacgtctcattttcgccaaaagttggcccagggcttcccggtatcaacagggacaccaggatttatttttttctgcgaagtgatcttccgtcacagtggcttctgtttctatcagctgtccctcctgttcagctactgacgggggtggtgcgtaacggcaaaagcaccgccggacatcagcgctggcaaagtgtagcggtcaccgctgcgcgtaaccaccacacccgccgcgcttaa

SEQ ID NO: 35925 - DNA, 519 bp, Glycine max
  Peptide Sequence Number=SeqID_127610
atgcctgatgtggaagccgcagaggagtcattagaaaccgctttccaatcttttgaggtggtaagcatttcctccgtggactcattctctgggcaagcttgcctgtccgatgcagcagtaatgatggctcgagttatgttgggaaacggttacgaacccggaatgggtttgggcaaagacaacggcgacataactagcctgataaatgccaaaggaaatcgtgggaagtatggtttaggctataaacccactcaggcggatatgaagagaagcatcgcgggaaggaaaagcggtggtcaaagctcgcagttgaggcaagaaagtgaaggaagcccaccctgccacataagtagaagctttataagcgcgggtctgggagacgaaggtcaagtggttgcgatatacgaagatgatgttctgagtacattggatttggtacgaccatgccctcctgatttccagctgggaaattggcgattggaggaacgccccggcatttacgcaacgagcataatgtaa

SEQ ID NO: 35926 - DNA, 729 bp, Glycine max
  Peptide Sequence Number=SeqID_127611
atggccaaattcgacccagacatagtcctcgaattttatgccaatgcttggcctacggaggagggcgtgcgagatatgagatcctgggtgaggggtcagtggatcccgttcgatgcggatgctatcagccagttcctaggatatcctttagtgctggaagagggccaggagtgcgagtatggccagaggaggaaccggtccgatggttttgatgaggaggccatcgcccagttgctgtgtataccggggcaggattttgcccggactgctgcagggaggcgagtgcgaattatgcgcaccaacatgaccaccctgacccagatatggatgacgttgctgctcagcaacatcctgcccagcgatcataattccggacctccctctgccgaagtgtcagctggtatggcgccgaccaggcaccctagacccggatcagtccaacgggccctgggatttcccgctttgatcataggactctgccagtcgttcggagtccccgtcgcacctagcaaggtgattcggccgcccatcacccgagcttttattgagaagtattgcacgcaaagacaggcccagggggatgctcgcaggccgcagacgcgccgccacctcatcaggctggcccagctggatcatttgatacggagcagtatttacggcatttggttcgccagcaggcggccaaccaccgggcgcatgtacagacccatgattgtatttaccagttga

SEQ ID NO: 35927 - DNA, 174 bp, Glycine max
  Peptide Sequence Number=SeqID_127612
atgggggcatacgcaaaagatgaggaattgctgatccattccttccaagaaaatcttactggggtagctgttacctggatgcaacaacagaacatgtgcaaaaaggggcacagatctctcaaagaatacgcccaaaggcggagcgacctagcagctcaagtggcacctcaatga

SEQ ID NO: 35928 - DNA, 332 bp, Glycine max
  Peptide Sequence Number=SeqID_127613
ggatcacgcccacgagacacctagtggacccgaagaagtccaacagggccccggggtttccagctctggttatgggcctctgtccatcctacagggcgcccgtccccccagcaagttcatgccatcgtgacatagggatcacacccgcaagacattcagtggacttggagaagtccaatagggtcttggggtttctagctctgattatgggcctctgtcagttctacggagtgcctgtcacccgcagcaaggtcatcaagccccctactaatcgagctttcatcaagaagtactgcgtccccaagcaggcgcagggcgagacaccacagtag

SEQ ID NO: 35929 - DNA, 405 bp, Glycine max
  Peptide Sequence Number=SeqID_127614
atgcatataggaggaataaaaaatcattcaagaagggtcaggttgagacctcaccccctcctccacgtttgtctagtcttgacatttggaatagagttacacatttatcgctctgcatcgaattcctgcagcccgggggatccactagttctagagcggccgccaccgcggtggagctccaattcgccctatacacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 35930 - DNA, 252 bp, Glycine max
  Peptide Sequence Number=SeqID_127615
atgaagcttggatggaacctagtaaccggtctagaaaggtttttgtcatcttcgaaaaatgaaaatgatccttctaaggtagattattctttgaagtttgatcttagaggatatccacaaatttttggatatgagggggatacaataagatttggagtagactcatggaatggactggctttggaaatgttagatctgagaagttattttttcatatttttgggacaaaaaatggacataggcaacacataa

SEQ ID NO: 35931 - DNA, 399 bp, Glycine max
  Peptide Sequence Number=SeqID_127616
atggacgaagatcaatggaggtatgactttgcgatgtcacaagaagttcatatggattatgattatgataatcaagaagaatgtggggtgaatgaaccacatgtggattgttcaaatgcttttaatacgtctcaggtatttgctactcgagataatgttttgcaatgggctcgaacagttgcccatgaaaatggatttgttgcattgattatgaggtctgacacagagaccggtagcagaggaagaagttcatttgtcttaattgggtgtgaaaggagtggtacgtacaagtgtagaaataaagaattcgttagaaaagacaccgggagtaggaaatgtggttgtcccttcaggctttcgtgggaaaccagttgcatggaggggaaggttggatggtga

SEQ ID NO: 35932 - DNA, 64 bp, Glycine max
  Peptide Sequence Number=SeqID_127617
atggtgaaagttggaacctcttacatcaagcttatcgataccgtcgacctcgagggggggcccg

SEQ ID NO: 35933 - DNA, 300 bp, Glycine max
  Peptide Sequence Number=SeqID_127618
atgactaaagcacgtcaaaagggggtatggaaagaaaatgagggagatgcttgtcaccctgctcgcccaggcgagcaaggtggcttcctccataagcaacctccttctagaggaatcttctggagggaccaagtgggcctgaaccttgcagattacataatcatcccctttttgacttacggaatgttacggaacgtcacgaattgtgcaacgatgctttctttcgagtttcgacatgtcacggaacttcacgaattgcctaacgatgggtgccaagtacctcaaaatggtacagtgaag

SEQ ID NO: 35934 - DNA, 402 bp, Glycine max
  Peptide Sequence Number=SeqID_127619
atggttgtggttgtggggaaagaggctctccacttaagtgcttttcaaagggtataccaccaactgcttggaatgccggcttcagtggcatatagccaaggctcgaagtcagctagattaaaatgtgctcccccatggtttgagagatatgtgcctgataggttagggttctcaatgagtatcggagtggagttattgagattttcgagtggcatatgggatcaagctttagcatatgacactggaactgggggaatctacaggttttctcgttgcaaaattcatttcttggttggtgctcttgggatggcctttgtggataactgggtggtgggtaaggaggaggtttgttattggctgagtaatgacattgttgggttggtgggaaacttggccgtatag

SEQ ID NO: 35935 - DNA, 294 bp, Glycine max
  Peptide Sequence Number=SeqID_127620
atggagaggagtatgattgatgctgccagtggtggagctcttggtgatatgactccagttgaggctaggaatttgattgagaagatggcttccaactcccaacaattctgtgcaagaaatgatgctattgtccttagaggagtccatgaggtggccacagattcatcttcatctgctgaaaataaaaaactggagggaaaacttgataccttggtcaacctaatcaccatacagatctttgtccttctttgtagcaatcgggagtcaatgaacaacctgaagcttatgctgtaa

SEQ ID NO: 35936 - DNA, 642 bp, Glycine max
  Peptide Sequence Number=SeqID_127621
gaacgtcctgatttgaagttagtgtcacatgggaggaaggtggcactgattgggaggccagtgcctgagattgaaggcctggtggctgccacaggattaagtccactgatcgattgttcagttatttactggcgatcctggactgatatccgcattcgtggagaggtgggcacgcgccttgcacagtttccatgctctttctacggaggaggccagattttttctaacagagttgctcgaggagtctgccgaggaggccagagccgagacaacactcacacgtggggcatatctcgcgcttatctgctgcaccttgtcggttgcgctctttttgctaataagagtgcaacatacgtgcatgtggttcaccttgacgctttccgggacctcgctcagagtggtggttacgcttggggagttgccgcgctggttcatatttatgaccaattagatgaggcttgtaggatcaccacccgacagcttgcggggtacttgacgctacttcagatctatgagcacttccctagtgtgcaccagtgcgtgacagacgatacataccaggagacgtccccacgtgcttctcggtggttgacgtcgaaggcgcacatgaatcgaattcctgcagcccgggggatccactag

SEQ ID NO: 35937 - DNA, 126 bp, Glycine max
  Peptide Sequence Number=SeqID_127622
atgagcaagaggctccaagaagattgggctagagctgctgaagaaggccctagggttctcatgaaccttagggtagggtaccctagaaatataggattttcagcccttgtatttttgggcacctag

SEQ ID NO: 35938 - DNA, 115 bp, Glycine max
  Peptide Sequence Number=SeqID_127623
gtcgacggtatcgataagcttgatccgacaagtcataaggcgtccagctaaagacgttaaagaagcgctgctaggaggcaacctagtaccttttgaatctatgcttgttatttga

SEQ ID NO: 35939 - DNA, 186 bp, Glycine max
  Peptide Sequence Number=SeqID_127624
atgtctgcttgctattgggctttgagtctacagatagcaaatgagactttttcgctgtctcgatcagaagacgttgacatcctcgggaaagcaaatgagactttatcgcagtctcggctggaagacgctaacatctccgggaaaggtgtaggtgacgacgttagtcacttcgctatcgggctttga

SEQ ID NO: 35940 - DNA, 138 bp, Glycine max
  Peptide Sequence Number=SeqID_127625
atgttgtgtttaaacagagtttgtgaaaataaaaataatagggaaactaggttggccattcctaaggatttggattctgcattggctattcctaaggatttggtgttggtagaagcagaggttaacatccatatgtga

SEQ ID NO: 35941 - DNA, 540 bp, Glycine max
  Peptide Sequence Number=SeqID_127626
atgaaggagaagaagatgagtatgacctgtgatgcaagctccattggagcttgtaggcctaggatcttcttcatcaatggattcctttgcttcttggaagatgaatggcagcggaatggagaaagggaaagagagaggagacgccacttcaaggagaagatgacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 35942 - DNA, 354 bp, Glycine max
  Peptide Sequence Number=SeqID_127627
atgcttttcaatggaaatggccccgaggaagcttgcctcaagagatccaggaaggataaagcgctgaggaaccagttccgctccgaatatgacaaccaccattttaggagcgctgagcaccagcagcgcttcgaggccatcaagggatggtcatttctccgggagcgacgcgcccagctcagggacgacgagtataccgacttccaggaggagatagttcaccgggcggcggggcatcactgggttaaccccatggtcaaattcgacccagacatagtcctcgagttttatgccaatgcttggcctacagaggagggcgtgcgagatatgcgatcctgggtgaggggtcagtga

SEQ ID NO: 35943 - DNA, 726 bp, Glycine max
  Peptide Sequence Number=SeqID_127628
gaaagcccgttaaggaaagataaagaacttaggggcatccgtaatggcatcatcggtggttatcatgaatggctaagagttcatacacgagggttagattggctctccaagttgaaaattatcaacgaggagaacttcgaagctccggaagaggatgaagaagtccaagctctaaaaacagagctaggaaaggcaagactcgccaaagaaaaattcaagttagtcgctacagacatccggaaagagtgtgtcgagttacgagaggaaaatgcggctaccgcaagagccctcgaacgagaaaccaagaggactcgcaaggaagagcatggccgagataaattccaaggagctttgtggggcagcaacaatgagctcaagctccggagagaggaaagagaccagtcacgagtacatggcatggtcttaaaggaggagttagctgcttgctcaagatccaagaggagtttggtccgacacttagaagccacggagcaaagcatgctagctataatagggcagtacaaagaagagttaaaccagtctttgacccatgaacaaaagctagtagaggacttcgcacaagcgtacgccgagaaggaagcaagagggagggtgattgatgcattgcatcaagaagtgaccatgtggatggataggttcgccttgaccttaaatggaagtcaagacctcccgcgactactagccaaagcaaaggccatcgccgaa

SEQ ID NO: 35944 - DNA, 456 bp, Glycine max
  Peptide Sequence Number=SeqID_127629
atgcattcgcagggacttgcactgcctccagagccaaaggttggtccctcaggtgctcgtgtcagcacaaaggagagttgtgttgctccctcagggaacgatccagagacgagtgactcagacaaatacgggttatacattgaagaaaatccttcccgcctggttgccctaggaagactttatgagggatccacagcagttcacaacgtccctttgttgcatggccaagtcaaggttggtgttgaggaggttaaagatgcggaggctttcgttcctatacccactgacgaggcaactgtgtctccagaaaaacctccagaaagcccggatcatgaggtcgatgatcccctgtacctgatgacattgaccatcccgcaactgtttttgaagcctctccaggttatgtgggatgctaccatgttcgggtgtttaatcaaaatttcccgttatacataa

SEQ ID NO: 35945 - DNA, 1164 bp, Glycine max
  Peptide Sequence Number=SeqID_127630
atctatgaaaacgaagcggccgtcggccaggctatcgccgctagcggtgtgccgcgtgacgagttgttcatcacgaccaagatctggatcgcgaatctgactaagggcgccttaattcccagtctgcgagacagcttggccaagctgcagaccccgtatgtcgatctgacgctgattcactggccatcgccaaatgatgaggtgcctgtcgcagagtttatggctgaactgctggaagccaagcgattggggctgacccgtcagattggtgtatctaacttcaccatcgatctgatgcagcaggcgattgatgcggttggcgccgatcagattgcgactaatcagatcgaactgtcaccgttcttgcagaatgaaaaagtggtggcgttcgcacggcaacatggtatcgccatcacctcttatatgacgctggcgtatggcaaagcgttgcaggatgagacgatcaaaagcattgccgcccgtcacaatgcgacgccggcacaggtggttctggcttgggcgttgaaactgggctacgcggtgatcccttcttcgaccaagcgcgaaaacctggaaagcaacctgttagcgcagcaactgacgctgagtgacgaagatatggcgcagattgcggcgcttgaaagcaacggccgattgccgctcgctgataaaatcgataaagctgcgcaggcggttactgacagcgctatcgctgtagtacaccgcgttgatcggcatttcgagtggcagcgtgtctcctaccagaaggggaaccaggttcccgcgtttgacgtcttcatcactcataaagtccgacaggcaggcgatgccgttgccgtgcaggcacaggtggcgctgggtttcaccgctgttggtggtcagccccggaacgatctccagttgtcgaccatcggcacaggtcagcggccagcggttcagattgggcagatcgttaaagccgatgcagcaatggtgctccaggtcggctaccgtctttggcgcgccatattgcgccaggtaggcgggggaggccaggatgcgtcgatagctggccatcagcttgcgcgctttcagcgtagagtccgtcagctcgccgacgcggattgcgatatccacttttcgttcgatcaaattgatgaagttttccgaagagaccagcgatag

SEQ ID NO: 35946 - DNA, 95 bp, Glycine max
  Peptide Sequence Number=SeqID_127631
gaattcgattcataaggaaaggagagaggctctcttctatcggtgctatcctcatggggtaccctaactatcttatagcaagtgcgggattgtag

SEQ ID NO: 35947 - DNA, 395 bp, Glycine max
  Peptide Sequence Number=SeqID_127632
atggccccgaggaagcttgcctcaaagaggtccaggaaggataaggcggccgaaggaactagttccgctctcgagaatgacagtcaccgctttaggagcgctgtacatcagcagcgcttcgaagccatcaagggatggtcatttctccgggagcgacgcgtccagctcagggacgacgagtatactgatttccaggaggagataggtcgccggcggtgggcatcactagttacccccatggccaaatttgatccagacatagtcctcgaattttatgccaatgcttggccaacagaggagggcgtgcgtgacatgaggtcctgggtgaggggtcagtggatcccgtttgatgcagatcaagcttatcgataccgtcgacctcgagggggggcccg

SEQ ID NO: 35948 - DNA, 360 bp, Glycine max
  Peptide Sequence Number=SeqID_127633
atgggtaccgtcggccttgccgcaccaggtggtcgagtagacaacgatcatagatgtgaggctttgcgtgtccgcttcacagcagacagggaagctgatgcgtccgaaggagcaggaggaggaggaggagaagatggaggaggaggggaggcagacaattatcaacatcaagagttctttatgtgtgtgtgtgtctctttctctctctgtgtctgtgtgtgtctctgtgtgtatgtgtgtgtcgcaatgtgcccttttgcggacgagcgaggcgaggctcacgggtgcgctttccaaaggaggaaaagatgcgcggagtcgccaccaatgtttatttgtggaaaacatcgggaaaactga

SEQ ID NO: 35949 - DNA, 327 bp, Glycine max
  Peptide Sequence Number=SeqID_127634
atggaagctgacatacctataggttggaaaccactcaacctagagtgggatgatcggaccaccgatcccgatgaacatctggatgccttcctgactcagggaaatctgtacaccaatgacaatgcaatcctatgttgtgtcttccccatgttcctcaaaggggtggcattgacctggaggatttcaactcggaggtacccatctagctacctcggtcccgtccttccaggccggggttggacaaccaccaagcatgagcaagacttgaaggacaccaagagaatcagcataggaatcacgatgcggatagaagaagagacaaagtag

SEQ ID NO: 35950 - DNA, 318 bp, Glycine max
  Peptide Sequence Number=SeqID_127635
atgaagaagatcctaggcctacaagctccaatggagcttgcatcaatttccatggctctttattctgtttcagcattgctcgttgctaccatgttctgtgttttggctttggtaaccaagttaccccatacaagaggaaaatcaggatatcctagtcaaaagattcttagagagcctaaaagtgagcctcaaattaggcaaaatattccactaggagtgataggtgccattgttgatcctgcgctcattgctggaaagtcaattgtgccgaagcctccaactcaagtttttatatctttgattcaaaaaatactttga

SEQ ID NO: 35951 - DNA, 399 bp, Glycine max
  Peptide Sequence Number=SeqID_127636
atgccgatctccccttgtggaagtatcaattggtctgtgtcgttccgacgtagggatcgtgccacaagacacccagtaggacccggagaagtccaacagggccctggggtttccagctctaggatcgcgcccgcaagacacccagtggacccgaagaagtccaacaaggtcttggagtttccaactctgattacgggcctctgtcaattctacggagtgcctgtcgcccctagcaaggtcatcaggccccctactaatcgagctttcatcaagaagtattgcacccccaagcaggcgcagggcgaaacaccacagcagcctggggatggccgacagtgggcaacagatgcaccgccaccacctctagagttcacctcagctcatccacaaaaaggttag

SEQ ID NO: 35952 - DNA, 471 bp, Glycine max
  Peptide Sequence Number=SeqID_127637
atgttggtgcgcatggtccgcactcttctctttgtagcggcacgggtgaaatcttgccccagtatgcatagtagctgtgtgatagcctccctctctggttgtgctcgcatagttggccctcctccaatatcagggggtgtggatggagcccatctgaaagtgaggacgcgtagtcctctaaaggtgagggcgtgtagccctacagttcgaggacgtgtagtcctttcaagtcctctgatggcgagggcgtgtaaccctctgaaggtgaggacatgcagtcctctgatggcgagggcgtgtagccctctgaaggtgaggacacgcagtcctctgatggcgagggcgtgtagccctctgaagtcctctgaagaccagggtactagtacccgagggtccatccttatgagaaagcaagagatcgactcatcgagggagccggtcatcccaaattcaaaagatttggacatttag

SEQ ID NO: 35953 - DNA, 354 bp, Glycine max
  Peptide Sequence Number=SeqID_127638
atggtgaaagttggaaacctcttacgtgccgatcaacgtctcattttcgccaaaaagttggcccagggcttcccggtatcaacagggacaccaggatttatttattctgcgaaagtgatcttccgtcacagtggcttctgttttctatcagctgtccctcctgttcagctactgacgggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagtgttttcccagtcacgacgttgtaa

SEQ ID NO: 35954 - DNA, 770 bp, Glycine max
  Peptide Sequence Number=SeqID_127639
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgcgggtttccgctggcattgaggaacttctccaggccgagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 35955 - DNA, 836 bp, Glycine max
  Peptide Sequence Number=SeqID_127640
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcgacagcatccggaacgtcagctgctcggggtcggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 35956 - DNA, 636 bp, Glycine max
  Peptide Sequence Number=SeqID_127641
atgagcctaagtgaagaacttggtgactattacgaaggaaggcacaagtcacatcttagacctcactcccatagaagagaaaaggaaagaaagcctcaagaggctaacattaacctcccatacttccatgggaaggacaatgtagaggctaacttagattgggaaataagggtagagcaacaacttaaaaggaagtcaacttcaaaatattatggctcttactcttatctaaagaaagaccaaggtcaaggcatcctaggggtgacaccttctaagcccgaagatgatacggggaagacaatagaaaatcaaccccttaaggctagtatgcaagagaaaactagctccacaaagtgctttaaatgtcttggaagatggcacattacatctcaattccccaacaagaaaaccatgattatgaggggccaagacatttatagtagccaagatgaggctactacttcaccttcctctagtgaaagtgaagaagtaaaaggggaacaatctagtgaaaaaatctacccccaagaagaaggacaacctttaatggttaaggaggagtgtaaggaagtaagtgtctcctccaagaggttagctaagaaggatcgaattcctgcagcccgggggatccactag

SEQ ID NO: 35957 - DNA, 1188 bp, Glycine max
  Peptide Sequence Number=SeqID_127642
atggccagagatcgggcgctcacgcttgaggcgctgagagtgatggacgcgatcgaccggcgcggcagcttcgccgcggccgccgacgaattgggccgggtgccgtcggcgctcagttacaccatgcaaaaattggaagaagaattggacgtggtgctgttcgaccgttcgggccaccgcaccaagttcaccaacgtggggcgcatgttgctggagcgcgggcgggtgctgctggaagcggccgacaagctgaccaccgacgccgaagcgctggcgcgcggttgggaaacccacctgaccatcgtcagcgaagcgctgtcgccgccgagcctgctgtttccgctggtggacaagctggcgctgaaggccaacacacaggtgtcgattttcaccgaggtgctggcgggcgcctgggaacggctggagcaggggcgcgccgacatcgtgatcgcgccggacatgcacttccgcgcgtcgtcggagatcaacacccgcaaactgtacaaggtgatgagcgtttatgtcgccgcgccggatcacccgatccatcaggagccggagccgttgtccgaggtgacccgcgtgaagtaccgcggcatcgcggtggcggataccgcccgcgagcgcccggtgttgaccgtacagctgctggataaacaacagcgcctgacggtgagcaccatcgaagacaaacgcctggcgctgctggccgggctgggggtggcgaccatgccgtacccgatggtggagaaagatatcgaagccgggcggctgcgcgtggtggggccggaatacagccgcgaagccgatatcatcatggcctggcggcgcgacagcatgggggaggcgaaggcctggttcctgcgcgaaattccgcgcctgttcgcacagcccgaagcgctggtcgcggccgtgcggctcgtccagatcctgcgccggcccgatggaaatgatgccgtgcgggttgatggtggcgtggctgcggtagtagtggttgcgaatgtgcggcaggctgaccgtctcggcgatgcccggcatctggtagatgtcgcgcaggaaaccgtacaggttcaggtagtcgctgatgcggtgtttgtcgcacttgaagtgggtgacgtacaccggatcgaagcgcaccagcgtggtccacaggcgcaggtcgggttcggtcagccgatcgccggtcag

SEQ ID NO: 35958 - DNA, 582 bp, Glycine max
  Peptide Sequence Number=SeqID_127643
atgggtgaagtagaggagatacaagagaagatgaaggccgacatggaggccattaaagagaaaatggccacaatgatggaggtcatgatgagcgtgaagaagataattggaagccatgcggttgcaatcgccgctaccagcgttgttgctaaggcaaagatttgggaagtacgggcagcccccatgatgtgcaaattcaaaacaagcacgccttcccgccatatggcttgcctcccaaactatacaccacccaatgtggcgtacattcccaatgaggatgtcaaaaactccacttccatactcattaagagccaacaacctcaatctgatcatgcacatgtctctcgacccatggaggagacacatggaatgccccaccacaatctagccgacttcgagccttgcctcggatatgccactgaagggcaagcagttggtggtatacccctgcaaaacactttggagggccctcagtgtcatccacaaccacaaccctcacgttccacagcggttaaaaaccctcatgactatggcaggaatgggaaagttggatcatctagaggaaaggctcagggccattga

SEQ ID NO: 35959 - DNA, 1071 bp, Glycine max
  Peptide Sequence Number=SeqID_127644
acgttgcccgcctcatctgtcgccgtggcggtaaactggtggcttccctcgtcaatatcgctctcaggacgccagctccagttgccattgctgtctacggtgacgcgacccacttcggtggcaggctgattattaatgctgtcataaataataatcacgtcgtttgccgtaccggtgccgctgagtaccggacgcggatcgttcgtcgtttcgccatcggcaaccgggccggttatctggctcacgctgtcggtgacggtaggtgcatcaggcgtggccggtgcgtcggtatcaatggtgatggtcaccggctgggacggggcgctttcattgcccgcgccatccttgttggtgacggtgagggtgatgtcataggtgccgttatccagcggggtcgttggcgtccagctccagttgccgtcgctgcctaccgggacctcatcaactttgacgccgccgatatagatagcgacggtatcacccgcctccccggtgccgctcagcgttggggtggtatcgcgggtcacttctcccggattcagcgcgacctcggtagtgccgccgtccggattgacggttacggccggggtatccggcgtagcaggcgcgacggtgtccaccaccagctcgaacggatcggagacggtggtgttcccggcggcatccgtggcatggacggtgatcgaatgcgggccatcggtgagcggagtcgttggtgtaaagctccagccgccattgccgtcgaggtcagcggtaccgagcagggtatcgccgtcatagatggtgataatggtacccgctggcgcgctgccctgcagctgcggcagggtgtcatccgtggtatcgccactgctgagcgggccctgcacgtcgcccacgctatcggtcacggtggcgatggtcgcggcaggcggcggcgtgatatcgacggtaaagctccatgcgccgttgctgtcggcgaccgccgtgccaatgctgttaccgtccagacgaatggtaaccgtcgcgcccggttcggcggtaccgttgagcgtcggggtcgggtcgttggtggtttcacccacgtcaagc

SEQ ID NO: 35960 - DNA, 1050 bp, Glycine max
  Peptide Sequence Number=SeqID_127645
atggcccagcaggtcaccgtcagctgcgctgaaggcgataccggcttcatctacgagggcaagctcggcttcgagcgcaccaccaccgatctgggccacatgccgccggcaccgctgaagatcatgatgaacgtggccaacccggaacgtgccttcgacttcggccagctgccgaacgccggtatcggcctggcccgcctggaaatgatcatcgccagccacatcggcatccacccgaacgcgctgctggaatacgaccgccaggatgccgcgaccaagaagaagatcgacgagaagatcgccggctacggtgatccggtcagcttctacgtcgaccgcctggccgaaggcatcgccaccctcactgcttcggtcgcgccgaacccggtgatcgtgcgcctgtcggacttcaagtccaacgagtacgccaacctgatcggcggcagcaactacgagccgcacgaagagaacccgatgatcggcttccgcggcgccagccgttacgtcgacccgagcttctcggccgccttcgcgctggagtgcaaggccgtgctgcgcgtgcgcaacgaaatgggcctggacaacctgtgggtcatgattccgttcgtgcgcaccctggaagaaggccgcaaggtcatcgaggtgctggaacagaacggcctgaagcagggcgagaacggcctgaagatcatcatgatgtgcgaagtgccgtccaacgcactgctcgccgatgaattcctggaaatcttcgacggcttctcgatcggctccaacgacctgacccagctgagcctgggcctggaccgcgactcgtcgatcgtcgcgcacctgttcgacgagcgtaacccggcagtgaagaagctgctgtcgatggcgatcaaggcagcacgtgccaagggcaagtatgtcggcatctgcggccagggcccgtccgatcacccggatctggccgagtggctgatgcaggaaggcatcgagtcggtgtcgctgaacccggacaccgtggtcgatacctggttgcgcctggccaagctgaaggccaacggctga

SEQ ID NO: 35961 - DNA, 288 bp, Glycine max
  Peptide Sequence Number=SeqID_127646
atgcgtctaccggggaaggagagtctgctgatgggatccctgtcataccctaatttcgtccggggacctttgctcgatgacgtgcgaccattctttggtcctcgtgagcacccaggcccatttgggccctccagaagattcctccagaaggcggttgctttctggaggaagcaaccctgctcgcctgggcgagctgagctcgcctgggcgagctgggcggcaaccaccttcctctattttgctataaataggggaggaaagcaagaagaaaggggtccagctccttag

SEQ ID NO: 35962 - DNA, 549 bp, Glycine max
  Peptide Sequence Number=SeqID_127647
atggaaaaaggtaatgttggagaaaacagaggtggtccaattagaagttatagttcctcaagaactgtaacatgggatctaggaaacaaaggcaccacggcaaaaacaagagagacgaattcgagctcggaatcaaatagtgtgaagtccactggggcatacagaggtaggccttttagtaggctttcaaatgcggagttccaggagagggtagaaaaaggactttgttaccgttgtgatgggaaatttggccttggtcatatatgccccaataaccaattccaagaccttattttgggagaaggacaagatggagaagacgaaaaagaagaaggggcaagaaatgagaaacaactgcagatagtgaaacaacagcaaataccaatcacacctactaaaccgtatactgtggaagtaggggatggacgaaaaatcaggtgtgaaggagtctgcaagaattttaaattgcagatccaaggcatggaaatccagcaagacttatttgtctttgaaatgacgggagtggatgtggtattagggatggaatag

SEQ ID NO: 35963 - DNA, 242 bp, Glycine max
  Peptide Sequence Number=SeqID_127648
atggtgatggaggagcaagaagaaaacgtaggggaagaaggagaagaggctggaaatttctggaggaaagagagagaagaaaaatctggacctttttggatgctgaaatcttgcctcgatttgcatgtcgtctccccgattctagttcttcgcgtttctctgcacccatcggggcccgttttcaaaggtagacaatatatatatcaaaacgctcagaatgaggtccttagcgtgattcagag

SEQ ID NO: 35964 - DNA, 156 bp, Glycine max
  Peptide Sequence Number=SeqID_127649
ttgagcttagctcatcaatgggctaagcacgcatccactgctaagtgcagcttcagcacgcttagcacaacagaagaatctggcaaagcattaatatcaaggcctcgtgctaagcacgagatcagtgcactaagcgcaacagttgtcttaaggtag

SEQ ID NO: 35965 - DNA, 153 bp, Glycine max
  Peptide Sequence Number=SeqID_127650
atgggtgatacccagagttacctctacctctgctactgtgttttcttgcttccagatcatacattgcatctgcttgcctcatttccttgcacagacataatccaaatgatcgcgctaagcagaccatgtcgcgctaagcgcgttcatccctaa

SEQ ID NO: 35966 - DNA, 423 bp, Glycine max
  misc_feature (96)..(96): n is a, c, g, or t
  Peptide Sequence Number=SeqID_127651
atggaactactctttttaagagaaggacttagggaggagcaaagaacaagcatagttaggttccttagtgggcttaatatgtgtcataccctaatntcatccggggaccatcgtttgatgtcatgcaaccttcgcttgaccgccttgagggttgcttccggaggaagcaacccagctcgcatgggcgagctgggcggcaacctcctccccctttttcctataaataggcgaaagggggctgttccaaatatccctcagccccctggctatgcatttcagctgtttttgggtgaaaaaaattgtttccgtgaagaaaatccaagccgaggtgcttccttaacgcttccgagacgtttccgtgagcgaatccgtgaaggttttccgtcgttcttcactgttcttcatccgttcttcgttctttaa

SEQ ID NO: 35967 - DNA, 219 bp, Glycine max
  Peptide Sequence Number=SeqID_127652
atggaaagatatctgccttccaaaggagttgggggtcttgggattaaggatatctctagttttaatgctgccttgttgggtagatggttatgggctttagcctctactcaagatcagctgtgggctagaattcttatctcaaaatatggtggctgggcagatcttaacaatggcagtgatacaccttggcactctcattggtggaaggatattcgaaaa

SEQ ID NO: 35968 - DNA, 1041 bp, Glycine max
  Peptide Sequence Number=SeqID_127653
atggccacgatggagaagaaaggcatggccaccggcctgcacgctatccatccgctgacgggcgaagagattccggtctgggtcgctaacttcgtgctgatggagtacggcaccggtgccgtgatggccgtaccgggtcatgaccagcgcgactgggaattcgccaccaaatatgatctcaacatcaagccggtggtactcaacctcgacggtaccgcgccggatatcagcgccgcggcgatgaccgaaaaaggcacgctgttcaactccggcgagtttgacggtctggaccacgacgccggcttcaatgccatcgccgatgcgctggcggccaaaggcgtcggcgtgcgtaaagtgaactatcgcctgcgcgactggggtgtgtcacgccagcgctactggggtgcgccaattccgatggtgacgctggaagatggcaccgtgatgccaaccccagaagatcagctgccggtaattctgccggaagacgtggtcatggacggtatcaccagcccaatcaaagccgatccggagtgggcaaaaaccaccgttaacggtcagccggcgctgcgtgaaaccgacaccttcgacacctttatggaatcatcgtggtactacgcgcgttacacctgtgcgaactacaacgaaggcatgctggatccggcggcagcgaactactggctgccggtcgatcagtatgtgggcggtatcgaacacgccatcatgcacctgatgtacttccgcttctaccacaagctgctgcgcgacgcgggcctggtcaactctgacgagccggccaaacgcctgctgtgccagggcatggtactggcagacgccttctactacgtcggcgccaacggcgagcgcaactgggtttcaccggttgacgttaacgtcgagcgcgacgaaaaaggccgcatcaccaaagccatcgacaatcagggccgcgaagtgatctacgcgggcatgagcaaaatgtcgaagtccaaaaacaacggcatcgacccgcagctgatggttgagcgctacggcgcagatacc

SEQ ID NO: 35969 - DNA, 193 bp, Glycine max
  Peptide Sequence Number=SeqID_127654
tctcagccggaagacgctgacatctgcgggaagggtgccccccgaagactcttaccgatagcgaatgagactttttcacagtctcgaccggaagacgctgacacctccaagaagggtgcaggtgacgacatagcgaatgagaccttttcgcagtctcgaccggaagacgctgacatctccgggaagggtgcag

SEQ ID NO: 35970 - DNA, 480 bp, Glycine max
  Peptide Sequence Number=SeqID_127655
atggatccacgcgctaggagtggtcccctcgacgcttcaccaaaaactgaaattcgcagttggtggactcttggtgatagtgttgggcgaagaggatatgttggtaaactgcccctcctcggcaccatatgtagaggcagcgcaagaatcattggaaacagctttccaatccttcgaggtggcacggttatgagcccggaatgggtctgggcaaggacagccacgggaatgccgatgtggggtatgagcccgggaaacctggaagaaggaatgcaccatcaagactccgggcagatagggcatggcccggatcatgttagccagtgtttcacaaatgtcgggataatgttcgaggaagaggtgggcggcaataggaggagaagctccacaagatccgccgagtttcgtgcgaccgtgccatcccaatttccaactggggaattggcacgtgacgagccagttggaagtctataccgttga

SEQ ID NO: 35971 - DNA, 332 bp, Glycine max
  Peptide Sequence Number=SeqID_127656
ggactgaagagtcatctcaaatccctaaatgctttgagtgcaatcaacccagacatctgagggctgattgtccaatctttaagagaaaaatagagaagtttgaaaagaagactattggagataagaaggcaaagaaggcctatatcacatgggaagataacaacttagaattgtttgatgattctcaaaaagaaatgattaatctatgtctaatgggcaaaaactatgaaagcgacgaagaggtgtcacaacatgcccttttgcgggcgagcgaggcgaggctcacgggtgcgctttccaaaggaggaaagatgcgcggagtcgccaccaac

SEQ ID NO: 35972 - DNA, 267 bp, Glycine max
  misc_feature (52)..(52): n is a, c, g, or t
  Peptide Sequence Number=SeqID_127657
atgtcagcccaggttttcttagggagctttgttagcgcaatttcttggaggnccaaaagtttgattgcaactagttgggtaggtgacccatcttgttgttttggtttctgggttgatgacccaaattgggttggtgacccagattttgagggtgaaatattttttgaggatggctctggtagagctaacttgaatccttttccagaactccttcctcctcgtaaggaggtgttggatgccttaggagacatgacaatttttctgtaa

SEQ ID NO: 35973 - DNA, 222 bp, Glycine max
  Peptide Sequence Number=SeqID_127658
atgaatccgtccagttttaagaacatatgggacatccttatcagggtattggatgcacaagctttcataagaatgtgcaaaatcagaatgctcaaaattataatgctcaagatcaggatgttcaaaatcaccaataacgagaatgcacagattcgccagttatggaatgctcagaatgatcaaaaggatcaaagggttgtaagtcagatggattgcctctag

SEQ ID NO: 35974 - DNA, 612 bp, Glycine max
  Peptide Sequence Number=SeqID_127659
atggctagaccacccccaagcaatcgaaacaatgaccttccaaatatggaggggcaaccaacgcaaacatctgtcagtaatgccaatataaattctggtataggaccaattcctgaccaaactgttggcacgattagttcaaccgcttcgacggttatgaatcagacaggggtaacctctcccatgaccaacatgacgttggcaagttcgaccacgtcagcgtctgcttttgccccttggaacaaccctagtttagggaatcccagtggaagtccctttcgaccgcctcaaaaccctctatatggcatgcctacatctttgatggtagggttgcaaaattctcaaccaaacatagagaatcttaatatgtcctctccatcaggatctgtagcgggcaatcaaggtagggcgcctgtccaagagatacagatgcctaacaatcccgggatgcaaatggctcaagcaccacaaccagcggcacgcatagagccaccagtccaacaggtcgaaccaaaccctggtatagtattgacagtattaccaaggggtgtgaaatccctaagtttacccctttccgggagagacaatgagtccactgtcgacacgtgctag

SEQ ID NO: 35975 - DNA, 243 bp, Glycine max
  Peptide Sequence Number=SeqID_127660
atggtgttagacaacccaatgattgaagttccacaagctgttgaaagtgataatgtagatcaagttgctttgtacctacaagaatcagactacaacattggagccgaaaatgatcctgagacgttttcacaagccatgagttctaaggaatcaaatttgtggtataatgctatgagggatgagatggttattctatggcatctaaccaagtttgggatctcgttgagttacctgttggtgtaa

SEQ ID NO: 35976 - DNA, 225 bp, Glycine max
  Peptide Sequence Number=SeqID_127661
ggacagcaagttaggtggtgggtgaagataccttatggtcatctgcgcctttcatcgaccgaggggaacgaattcggcagtttttcactctcgtcgtccgaaaacattaaagtccagcgacgcgtggaattcttctctgttgggcagagacgattgggtgcaatggcaaagggaagtgttgtggttgtccaactttgtcgttttcaaaacactgaagtttattga

SEQ ID NO: 35977 - DNA, 93 bp, Glycine max
  Peptide Sequence Number=SeqID_127662
atggcctttgggaatcatcacagattaattacggaagaggctaagtgtcttatctttactttcctcccatctccgataaaagccttcgcatga

SEQ ID NO: 35978 - DNA, 153 bp, Glycine max
  Peptide Sequence Number=SeqID_127663
atggaggagatacatggagaaaatgatgaaaaacaaggaattaaagccttggatcttcttcatcaatggagtattttgcttcttgaagatcaatggcagtggaatagagaaggaggaaaggtgattggagacgccacttcaaggagaggatga

SEQ ID NO: 35979 - DNA, 415 bp, Glycine max
  Peptide Sequence Number=SeqID_127664
gacctcaagattttgaggaaatccttgcaaaatgggcatttctttcgagaggtttgtcaaaaccaaagcccaaattcaagagcggagctatatccgaatcaacaactgctctgaatgttgatcagaccaacacctctgtgattagtggtgacatcaaaaccacaccggcgagtgctgcattgccagtgccagtgcttgcaaccaccacaacaagaggaaataatcaggaacaggcagcggctgttaatggttcttctgctgctacagtcatatctgctgcttctgcaccaccaaagaaggaaggtggacaagcaaaagctcaggcggacaagaagaagatagatgccagaaagaaaagggagggagtggggatgtggtctcctgggttcaacatttgctttataaaacgagtgag

SEQ ID NO: 35980 - DNA, 387 bp, Glycine max
  Peptide Sequence Number=SeqID_127665
atggccaaaaaagaaagaagaaggtatagcccctttaaaagccctcatcatcaaatgcaagaaagaaaacggaaggaagaagattcagatgatgaagaagattttttcttttctttgttaagaaatttcaaaaattcatcaagaaaagaagaattgacaggcgtcagaacttcaataatggatgaaaatcacaagatgattctcaagtccttaggtgttacaaatgcaaccaaattggttacatcaaggccaactgtccttcaaatgaagaatggtcagagaaaagtgaaaagaaaagatttgatgaaagaagaactaagaaagcatacattgcatgggatgacaatgattcattcgatggttcagaaaaggagattaatcttctaa

SEQ ID NO: 35981 - DNA, 107 bp, Glycine max
  Peptide Sequence Number=SeqID_127666
ctgatcttgcaggactaagggtggaggaagtcgtggcaagttctgaagatagaagagtgctttggataagggaagagaataggattgatacaggccttatgccatga

SEQ ID NO: 35982 - DNA, 115 bp, Glycine max
  Peptide Sequence Number=SeqID_127667
ccgaggcacttccgaaacgtttccgaaacgtttccgtaacattttccgtgaggaatttcgcgaaggttttcgaccgttcttcgacgttcttcattcgttcttcgatcttcaacag

SEQ ID NO: 35983 - DNA, 564 bp, Glycine max
  Peptide Sequence Number=SeqID_127668
atgcagatggcagacagaggtagaggtagtggtcgtagaacatttaatcgtggtacaagacgtgatacccacagtttgagagctccaattaccgccaatccttccccctcatccattcacatatcaacctcagagtcgatgattcatgttgttgcacagactccaaacacacttcctacagctcaagaccaaccaaatcctacctttgtaagggagtcaattcctactacccctgttagagatgcttcaccttcagcaccagatgattctgttacacctgagtacccaacaaatccaaattatgaacatattgttaatgaaaggcctttcattcgtgcatataaaggagagtttcaaccaacatatgggtgttgtaatatcatatcaaatgttattagggcaaaatttgatgaactagctccaagttggttgaatgtgtcagttgaccttcgcgataggtggtttggagagtttaagaaagagtataggtggcacccacaagaagagcgagccattagagctgtttttgagacaaaaggttcatgtattttaaaagtgcaatga

SEQ ID NO: 35984 - DNA, 207 bp, Glycine max
  Peptide Sequence Number=SeqID_127669
atggaggaaggtataggtctcatactagacctcactcccaaagaagaaaaaatgatagaatgtttcaagaggttgaagaactctttacttgccatcacattagtgaagagagaaaagttccattggctacccttagcttccaagggtatgccctttattggtggacttccctttttaaggaaagaaggattcatggggatcttctag

SEQ ID NO: 35985 - DNA, 654 bp, Glycine max
  Peptide Sequence Number=SeqID_127670
atggatgagaaaaggaatacacgagaacaccaagctgagtttactgaaaactcatcactgagtgtcaatccaccatcccccgtttcaggacatgtcaagtggaagatggcccgcacaaagcgatatggccagatgacctctacagcaacccaagaaatatcagacaaaattgactttgtttcacatggtcatgatgacatattgaacactgctattggtcgcgtacgtgtcgcgaggacaggtgtgacaatcagccagtactttggacaagcctcacgtggctccaacacttcctctgcatcaatcactcgacagcaaatggctgaaatcatcagtaacttgaaggaagagtcgaggaaacaatctactcaactagtggcattggaaaaagtgtatgacagttcatccaccatacacaatgtcccttatgcagatgatgtggttagggattcaccgaagcatttgccgaaaccagttggatatgctgaaatggacaatgtagtggctaccgttgatccattgggagaattggttaagaacttgtttgatgtttaccaaaagccaattgagttgtcatgggatgggtcaaaatttgggatacctaatgtcaaagatggctttttcatcacacgcgtagatgtaaaactgagataa

SEQ ID NO: 35986 - DNA, 690 bp, Glycine max
  Peptide Sequence Number=SeqID_127671
atgggttctccacctggctccactactcctcctccttctcctcctcctcctcctcctcctcctccttctcctccttctcctcctcgtcctcctcctactttggacgcatcggcttcgacgtctgccgtgaagcggacacgcaaagcctcacgcctacgatcgttgtccactagaccacctggtgttgagagaccagtggtgcatgttgatcctgctacagggaaggccgacggtccccacaagaagaaattaagaacatatttggggattgtggcacgtgataaggtggacatcacctacgagaactggaaggaggtccctactgctcagaaggacctgatttgggaggatattcagccgatcaggacggtgtcgaggacactgtctgtgacaaaatacggcatcagcaaggaaaagtgggcccagtttgccagactcgcagagacccttcttgggaggatgtgcgcatcagaaggcacaggccatccagaagcagaatactgccccccacgtttgtctcgtggggtttatgattatttggagcaaaagctcctggctgagaagacgaagaagaagctggaggaagctgcacagtcaagaagcattgatggcgtcatcgacccttcatcctcggtcagacgccacgtgaagtggaagatgacccgcacgaaagaagacaggggattatga

SEQ ID NO: 35987 - DNA, 564 bp, Glycine max
  Peptide Sequence Number=SeqID_127672
atgaatgcttctttaaccgccgggcgtatttatgcctggctgataacggctgcttttttttggggtatcactccgtcagcctcagcgttatctaacggctgtgctaccgtcaatgccctgtcaggttccacctctctgtcctacagcgccaacaggtatcctgcctcggactttaccgctggcgacgcgttgacgctgagctttaccgacagcggttctgctgtgggcggcactcccatgaacgccgacagtctgagcgtggcccgttttgacctgagtaatgctcagacttacaacgccgtaaactcaacgacaacctcttcccacaccgtgacaatcaccgtgccgtccggcagtctggaggccaacgggctggccgtgcgggttaccacctcgcatggacagatcagtaacctcgtatttaactgtaccagtgcaacatcgtcatccagcgatgccacgctgtcaggcctgtcattgtctgctggcgcactgtcaccgtctttcagcgccgccaccagcaattacagcgcatcggttgcgttcgatgtttcgtcggtgacg

SEQ ID NO: 35988 - DNA, 381 bp, Glycine max
  Peptide Sequence Number=SeqID_127673
atgcaagcaaatagagggttttcaaggttcaaggagaatggcagagtataccattccagctggtggtggggtgattctcctcatgtccaaaaagcaaacatcccaatggaaaatggaggttatctaatttatggcactgctcatatgcatttcaggatggaaggactttatgtacatcaacaccaaaaatatggaacgggaaaaaaggctggaaatgagaaaggttatctcattggaatgtctgtttgttatccacaaccgggttcaatcaagattcatgatggtgaaattttgactctagaatctagatataaaaatgagtttcgtactggagctatgggacatttctacatctatttggcagaggaactaccacaatga

SEQ ID NO: 35989 - DNA, 258 bp, Glycine max
  Peptide Sequence Number=SeqID_127674
atgaaacatcaatccaaaggagaagattcctccttagccccaaaatgctatgaatgcgatcaacctgggcacatgagatttaattgtcctatctttaaaagaataatggaaaaatccgataagaggaatttcaaagaaaagaaagaaaagaaaacatacattacttgggaagataatgacatggattcttcaagtgattcagaaaatgaaatcataaatctaggtctcatggcaaaagactatgaaagcggagaagag

SEQ ID NO: 35990 - DNA, 918 bp, Glycine max
  Peptide Sequence Number=SeqID_127675
atgggtcaacttcaacggcaagccttccgcaaagcctatggtaagatttgggacctagctagggtagaagtttccatggaaccgattgcatccctttcccagtattatgaccagcccctaaggtgcttcacatttgaggacttccagctagtgccgactatgaaagagtttgaagaaatcctgggatgcccactgggaggaaggaagccatatcttttctctgggttctatccctccacgacaagagttgccaaggtagtgaaaatctcagcacaagagttggaccgtgtaaagcaaaacagaaatggagtagtcggagtaccaaggaagtgtgtcctctttccaaatatggaagggttagtggacctagcagtgattgacgctttcctcgcctttcatcatggcaaggaaagcccggtcgtcaccattttggccatgcatgacacgttcgatcagagatgtgaaaagagcggcgcaagaattgtttgtttgtacactggctctctatgtgtggctggtttcacacctttttctccaagaaggattctatcttcatgcgaaggatgtcccatgagaggagtgccatcagacgaaagcatcatgcctttcatcgcacggggtttcagtgaccccaatgcgagggacagagagcttaggggaagcagtaatgggagcatcggcggctatcataagtggctgagagtccgaacacaaggactggattggctcccaaatctaaagactgtgagagacgatgaggttaaagcttcggaagaaagtgatgaggtacaagccctaaaggcagagcttgaaagagcctgggtagttgaagagaagttcaaggcagcaatagtgagctcaagctccgaagaggtgaaaggaatcatcacgggtcaaaggcatgatcttgaaggatga

SEQ ID NO: 35991 - DNA, 105 bp, Glycine max
  Peptide Sequence Number=SeqID_127676
atgatagtgttgatgatggaattcaaaatccattttggagtgatgctttccattataacaatatcaattggagtcatcctaatgaggaggacatttgtgatttag

SEQ ID NO: 35992 - DNA, 630 bp, Glycine max
  Peptide Sequence Number=SeqID_127677
atgccctcccccttcaaagggctacatgtccttgcctttagagggctacactcccctcgccttcagaggactacacgtccttaccttcagaggactacacgtcctccccgtcagaagggctacatgtcctcaccttcacagggctacacgccctcatcttcagggggctacatgtcctcccttttcagaggactacacgtcctcgccatcagagggctacacgtcctcgcctttagagggctacacaccctcaccttcagaggactacaacctccccgtcagagggtaaatgttctcaccttcatagggctacactgccctcaccttgagaaggctacacgtcctccccttcagatagggacttcacatgtcctcggacctcagagggctacacgtcttcacctctcagagggactacatagggttgcacatgccctcacctttagaggactacacgtcctctgccttaagagggctacatcctcccttcaaagggttgcacgccctcgccttcggagggctatacgccctcccttcagagggctacacgtcttcccttcaaaggactggacgtcctcaccttcagagggctacacgccctcacctttagaggactgtgggatcctctag

SEQ ID NO: 35993 - DNA, 365 bp, Glycine max
  Peptide Sequence Number=SeqID_127678
atgactagaggcaatccatctaacttacaaccctttgatcctgaaatagatagaacatttcatagattagttaggcatagtgtgcatcctactttccctaaacattttgtgccttttgaacatcctgagcattttgttactggtgagtctgtgcattttgtggttggtgattttgaacatcctgattttgagcattctaattttgagcattttgactttgaacattctgaaaatatggctcaacctccacctcgtgagaggactctaagggaaatggctgcacctgatttcacttatgaaagcttgtgcattcaataccctgatgaggatgtcccatatgttcttaaaactggactgatccacat

SEQ ID NO: 35994 - DNA, 546 bp, Glycine max
  Peptide Sequence Number=SeqID_127679
atggctgagagaaattccggggaacattgtggggtagcaacaatgagctcaagctccgaagagaggaaagagaccggtcacaggtgtgacgaaaaagatagtgcaagagggaggtctgattgtctacttgctcagatactgtgtgatggtatggtttcaccgacctattccaacaagacacaagaccgtccgcttctattcaaagttatcaaaagccatgcgccgaaggttgtatcgaatttaccgcagcctcgggggccactaagacagtctagggtaccccatgacggggagcgtccaatagaagaaagtctctcgcctttccttgtgagggatctaggcgcgcaaagtctcaaggtgatacaaagagtccacaaggcgtggagaagtccgttgaggaaagacaaggagcttagaggcatccgaaatggcgtcattggtggttatcatggatggctaagagttcacacgcgagggttagattggctctccaaattgaaagttatcaatgaggagaactttgaagctccggaggaagatgaagaa

SEQ ID NO: 35995 - DNA, 234 bp, Glycine max
  Peptide Sequence Number=SeqID_127680
atggggatgacaatgagcagttgtaggatgcgtactattgtacctgtcgcaacctacccttcgacgggagggcgacgcgagactcacgggttgcgtgttccacgaaaggaatacgcgcggagtcgccaccaacgtttatttgaggaaagcgtcggaaaaaccggaaaagacgcgatctacgaacttttaagtgaaaggttcgggagttgtatttacgcacggggaaggtgttag

SEQ ID NO: 35996 - DNA, 132 bp, Glycine max
  Peptide Sequence Number=SeqID_127681
gtacggcctcgatcacttggcaaaattctaaaattgacaaacgacttgacaacacatgcatatgaggatcaaaaggtctttaaagattgtaatggggccaaggacaaggtagggaagaaaaatatggaataa

SEQ ID NO: 35997 - DNA, 381 bp, Glycine max
  Peptide Sequence Number=SeqID_127682
atggaaatctttattcaatcaattgatcctggtgcatggaatgccatcgtcaaaggtcctttcattcctactaaaaaagtgaatggtgaattaatacctaaagaatgggatgaaatgagagatgatgagaaaagaaaagtgcaagatgatcaaaaagctaaaaacattttaacttctggaaaaacatttgaagatgaagagctaaacattaagattttaaactttcttacaagaactttggaaccaaagattacaacaatcaaggaatccaagaatctagctacaatgactatggaagctctctttggtaaatttcttgcctttgaacatgaactgactcaattatcttatgcagaagaaatagaaaagagaaggaaataa

SEQ ID NO: 35998 - DNA, 500 bp, Glycine max
  Peptide Sequence Number=SeqID_127683
accaagggttatgtgagacggaagtcaccatcaaggaagaaatagaggtcatatctaaaaggtttgatgaacttgatgtggctggcaaagtaaatctgaagagtaaacttcgagaaatcgcataccctgatcataactctatgtgccctcctccatcaaaggtgaacactaaaggtgcaccgaagaaaccgatgaaaagaagtcaaacatccacaaagcgtgatccgtcttactgggagtatgttgatgcttttcattctgttcaaagcagcaactctccaggtttcattcgtgacgttgtggatgtgaaagcggacggtaactgtggatatcggtccattggcgctttattaggtatgggggaagattcatggccgttagtgcgtaatgaattgcttaaagaacttggcaggtggtcgcatgagtacatgaacctctttggtggcacagagagatttgaacagttgaggttgtcccaacatgtggatgggttatccaag

SEQ ID NO: 35999 - DNA, 156 bp, Glycine max
  Peptide Sequence Number=SeqID_127684
atgaaaggcaccatgcataaacctcaagcgaacctaagggcagatcaaaagttctcccccagtaggttcccagctacaaggtcatcacgaaagacaacgattggtacctcaaagccttacactggggcaatgaggggcatcgtgcatgagcctcaa

SEQ ID NO: 36000 - DNA, 936 bp, Glycine max
  Peptide Sequence Number=SeqID_127685
atggccaagttcgatctagaaatagtcctcgaattttatgccaatgcttggccaacagaggagggcgtgcgtgacatgaggtcctgggtaaggggtcagtggatcccgttcgatgcagatgctatcggccagctcctgggatatccgttagtgctggaagagggccaggagtgcgagtatggccagaggaggaaccggtctgatgggttcgatgaggaggccatcgcccagttgctatgtataccggggcaggattttgcccggacctccgcaaggaggcgagtgcgaattatgcgcaccaacatgaccaccctgactcagatatggatgactttgctgctcagcaacatcctgcccaccgaccataattccgacctccccctgccgaagtgtcagctggtgtacgccatcctgacgcagatgagcatccatgtggctcagttaatcgctgatgccatttatatttttgcaggactctgccagtcgttcggagtccccgttgcacctaccaaggtgattcggccacccatcacccaggcttttattgagaagtactgcacccaaagacaggctcaggaggatgctccgcaggccgcagacgcgccgccacctcatcaggctggccaggctgggtcgtttgacatagagcagtatttatggaatttggttcgccagcaggcagccaaccaccgggcacatgtacagacccatgattgtctttaccagctgagcctcagcatgcagagtcagggcttcgcttctttttcatgccctactccagaccagttcagggcagaggtcgcatggcccggggattggcctgaggcccaagcaggagaggcacccccagaggctcccgacgatggagaggaggcccacgaggacgaggagatggccgatttgcttgacttcttgggagggagtggagctacatga

SEQ ID NO: 36001 - DNA, 117 bp, Glycine max
  Peptide Sequence Number=SeqID_127686
ccatctgcaccaccatcagagccagagcagcctattgttcaggatccaccagctactctggtgctggatctaaacgagcatgcagaagatcaacaacaggatgatcaggagttttaa

SEQ ID NO: 36002 - DNA, 633 bp, Glycine max
  Peptide Sequence Number=SeqID_127687
atggcccagaagaagagtggtccaatcactcctgccacatccagaagaagcaaggttgctatcccctccaagaagaggaaagaaatttcgtcatccgattctgataaggatgtcgaactagatgtctcgacatctaagaaggccaagacttcagggaaaaaggtgcctggaaatgtccctgatgcaccattggacaacatctctttccactccattggcaatgttgaaaagtggaaatatgtgtatcaacgcagacttgcggttgagagagaactgggaagagatgccttggattgcaaggagatcatggacctcatcaaggctgctggactgctgaagactgtcagcaagttgggagattgctatgaaggcttagtcagggaattcattgtcaacattccctctgacatatctaacagaaaaagtgatgattatcaaaagatattgaatgtttctgagcatcaaattgccaaaggaaatcactgcccaaaccgagtcccagcattggccaaaggaaaagggaagctttcagcagggaagctaagtgtgaagtatgccattctgcacaggattggagctgcaaactgggttcccacccaatcatacttccactgttgccacaggtttgggtaa

SEQ ID NO: 36003 - DNA, 243 bp, Glycine max
  Peptide Sequence Number=SeqID_127688
atggggaagaggaagctggagctaggttttgaagatcagaaaattgattttgctttatttgttgaaaacaagcctgctccagaacacaatgtctgcttacaggtaatggaaggagagcctcgcgctaaacacatatttggtcatgtgctaaaccgtgagtctcaagcacttaacacccaacccttgcatctaaggctgatttggtccgctaagctggccaaggatgagctaagacaactttaa

SEQ ID NO: 36004 - DNA, 381 bp, Glycine max
  Peptide Sequence Number=SeqID_127689
atgggtgaagaatcatggtcattggtgtgcaaccatctgcataaagaactgacaagctggtcggaagagtatatcaaccccgttggttgcatagacaaatttgaggaattaaaacgttccttacttgttgacggattatctatggtgcgttactatggacaagtggatgaatattatggatatgggatatgtcattgcttcacgatacaacgtgatcattgtttcttctatgcatcacgtaatatgcattggtcatacgtatggaaatcattttgtacaggtttttttatgagaccattgtcttttacaactattggcattgttgtggaatacacattgtcattctcaggcaaagcagtggtccaccccgtacataggtag

SEQ ID NO: 36005 - DNA, 492 bp, Glycine max
  Peptide Sequence Number=SeqID_127690
atggcccgagttatgttagggaacggttacgaacccggaatgggtttaggcaaggacaacggcggcataactagcctgataaatgccaaaggaaatcgtgggaagtatggtttaggctataagcccactcaggcggatatgaaaagaagcatcgcaggaaggaagagcagtggtcaaagctcacgttggagacaagaaagtgaaggaagcccgccctgccacataagtagaagctttataagcgcgggtttgggagacaaaggtcaagtggtcgcgataagcgaagatgatgttccgagtacattggatttggtacgaccatgccctcctgatttccagttgggaaattggcgagtggaggaacgccccggcatttacgcaacgagcataatatccgatgacgagtcccccgaaggtactaatacctgggacccgcctatcgacttcgagcaagaaatgagtcaaacggaagatgaaggaaacgaggatgtg

SEQ ID NO: 36006 - DNA, 297 bp, Glycine max
  Peptide Sequence Number=SeqID_127691
atgaccatagagaaatacacccctaagactagttcccaaaaaaggtctagcaacattaaatgcttcaaatttcttgggagaggtcacattgcctctcaatgccccacaaagaaaactatgatcatgaggggtcaagacatttatagtagtcaagaggagactacttcttgcccctcctctagtggaagtgaagatgaagtaaggggtgaagagtctagtgaggaagtctacccccacgaagaagattattgtgcagttagcaagagattagatgatctatctttaggaacgaattaa

SEQ ID NO: 36007 - DNA, 312 bp, Glycine max
  Peptide Sequence Number=SeqID_127692
atgaaaatacaaaaaaaaggggttcccatgaaccctaagagaataaaggtcattcctgagtggcccactccaccaacaccactcattgagttggtgaggaaccatgttccttcatgggaagatgcccaagaaatgggttttcagaccttaccttacttcaacataccaaacaccactaatacatatgtttttgttctttttactggtgttaaggaaaaaagcccagagtttcaaaaacctcaagatttgaggtcaattccttttcaagggggagggaatgatgcaatcctaccccacaagggcattggatag

SEQ ID NO: 36008 - DNA, 210 bp, Glycine max
  Peptide Sequence Number=SeqID_127693
atgggtgcaagggataattcattcatgcacaagaaaaataaatgggaaatcctgtcatggctcctcctatgccggtgtctgcttatcttgggctggtgcaagctcgccatgaggccaagaatcccaggtgctctatgttgcggtcatatcagctgcataatctgcatcaacaacgccatcctcctcctcaaagacctccaaaactggtga

SEQ ID NO: 36009 - DNA, 255 bp, Glycine max
  Peptide Sequence Number=SeqID_127694
atgcacacgccaggtttcacaattccacaattccttagaataggcctaactcacaaaaaggtccccagtggagtcgccaactgtcgcagcatgcccttttgcgggcgagcgaaggcgaggctcacgggtgcgctttccaaaggaggaaagatgcgaggagtcgccaccaatgtttatttgtgggaaacgtcagaaaaaccgaaggaaaccggtcaagatgaaaattctaagttcgggagttgtatttacgcttaa

SEQ ID NO: 36010 - DNA, 222 bp, Glycine max
  Peptide Sequence Number=SeqID_127695
atgcagcagaggatacagagtcagatgatgattctgatgccaccccatgaccatcagacctttattctttttgcttttggggcatgtccctttgaacaattgattgttattgctgatagaagatgctgcagtgaactgctgcctagcagaatattcacttcacagcagcaagagcatggagacagggggagcagaaagctgatgtcacgtgagatgtcttga

SEQ ID NO: 36011 - DNA, 264 bp, Glycine max
  Peptide Sequence Number=SeqID_127696
atgagggggattgggtttggctccatcttaggaatcatagattccctactaaaagtgaaatccaagcttagccctagagggatggcctttcaggtcttggagaggatcaataacaatttggcctcccagaaaagtgacttggctataataggaggaggaaccatagtgtgtgcatttttcaaatcctttcaagggggaggtcatgatgaattcctcccaaagggccattcaccagagcatgagcaagagactccaaaattctag

SEQ ID NO: 36012 - DNA, 574 bp, Glycine max
  Peptide Sequence Number=SeqID_127697
gtcgcgtcccattcgccattcaggctgcgcaactgttgggaagggcgatcggggggggcctcttcgctaataggccagccggtgaaagggggacgtgctgcaaggcgattaagttgggtaacgccagggttttcccagtcaagacgggggcgaattggagctccaccgcggtggcggccgctctagaactagtggatcccccgggctgcaggaattcgatatcgaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 36013 - DNA, 180 bp, Glycine max
  Peptide Sequence Number=SeqID_127698
atgaagctgctaagggtccagcataaaaacaacaaaatcaaggtgacaactgtttcttttgcaggttgcctaagctaccagaagccaattgattttggaagatggatctttgttagagatggtaaatcggtggagctgcctatggtgaatccccccacccccagaattgcatggtactaa

SEQ ID NO: 36014 - DNA, 488 bp, Glycine max
  Peptide Sequence Number=SeqID_127699
atggggacaaatcaaaccagcaagaggttttaccaagtcaaggttaaaagcctagataccaccagcatcaaggaattagggcggttgatggaacctctccaaatgcaagccttccgcaagacttacggaaagatcttagagttgaccatagcagaggtatccatagaagccattgcatcactcacccaatactacgaccagcctttgagatgcttcacgtttggagacttccaattggtaccaaccattgaagaatttgggggaaattctaggatcgagaggtttggaccgcataaaacagactcgaaatggcatagcgggcctaccacggaggtacctagaagacaaggcgagggggtcgtcctctttccaaacatggatggtttggtggacctagtagcaatcgacgctttccttgcataccaccatagcaaggaaagttcggtggtagctgtcctggcagatttatttgacacatttgaccgaag

SEQ ID NO: 36015 - DNA, 1059 bp, Glycine max
  Peptide Sequence Number=SeqID_127700
gacgagggtgagagccctgtcgagtctgatgaaacaaaagtccaaacttggagcagccaacactacaggaacgaacctgtggttgttgttgctgctccacggttgcaaaagtattctagttttgatgaccagagtggggagaagcctctgcttttgcccattcaaagcttcaaatctcgcttatctaaagaagttattgatgttcaatctcagaacatgtcaatgagttctaaaagattttcaagctattcgaatagaaaagcagaagttaaagctgttgatgttgatgttgatgttcaatatctaaatagaaatgcagaagttgaagctgatggtgttgatacagatgttcaatctctaaataggtcaacaatttctcaaggattttcaagcaattccaatagaaaagctgaagttataatgttgtcttcaaacacttatgttataatgttgtctttaaacacagaggattcagtgaggaagaaaggcttctacaagtcttgtcctccaccaccgccaccaacaatgtttcagaaatcagtgttcatgaagccaaggttcgatggttcatccaacgaagcaccttccttcaataaggagttgaagagaagcttcacaagtgagagaaccacaccagtgggaaagaaaagtcatgaagaaaataaatccatgcaaggcacattgtttagaagtaacaagttcatggggcatgcaagtgtgcgtcttatgtcacagccagctgagaaagaaagccttcttgtggaatctgacgatgatgatgatgacgatgacacagaaaccaaggaccaagacattgaaggaggaagaaccgttgctcagaacaatgacaggggaaagggtccacctgttattggtggagaaagttcaaaaacagatggtgatgaaggaccagatgtggataagaaggctaatgagttcattgctaagtttatagagcaaccaaggcttcagagaatcgagtcaatcaagaggagtgcaagaaactcttcaagtacaacctgcatttcaaagatagctttagggggggactattcatag

SEQ ID NO: 36016 - DNA, 231 bp, Glycine max
  Peptide Sequence Number=SeqID_127701
atgggggagaatggaaatttatatgatgacaaaggtgatgacaaaaagctcaaaggtcaatcaaagaatgagttcaacatgttcaagatagaatcaagaacacttcaagattcaagaggaaagttgaagaacacttcaagattcaagaggaaagttgatttcaagaatcaagaatcaagattcaaggatcaagctccaagaatcaagatcaagattcaagaatcaagataa

SEQ ID NO: 36017 - DNA, 667 bp, Glycine max
  Peptide Sequence Number=SeqID_127702
caagcacgagaggccgaggaaggatcgcaaaggatggttcgcggtctttccggttcgccggtggccgcagcttccatggtcatgcctttcaccgctttgctcggtttggaccgatgaattcatcgggaagggcgcgatagggcaggtctgccaggtcattggtgtcgtcgtcgatgtcaaattcgacgagggtttgcctccgatcatgaccgcgctggaggttctggatcactcgttgaggcttgtgttggaggtggcgcaacatttggatactgagcattatttgcccattcatagagaagctcctgcttttgttgagcaagaaactgcacaacagattcttgttattggaatcaaggttgttgacctgcttgcaccatatcaaagaggaggaaagattgggttgtttggtggtgctggtgtaggaaaaattgtgcttattatggaacttattaacaatgttgcaaaagctcatggtatgtatgtggtttctctgtgtttgctggtgttggagagtggtgtcattaagcttgatgataagcagactgaaagcaagtgtgctcttgtgtatggtcaaatgaatgagccccctggtgctcatgcccgtgttggtcttactgggcttactgtgggtgaacacttccgtgatataaaagatgcgatgaca

SEQ ID NO: 36018 - DNA, 369 bp, Glycine max
  Peptide Sequence Number=SeqID_127703
atgccgatctccccttacggaagggtcacgcccaagggacacccagtggacccggagaagtccaacagggccctggggtttccagctcgggttacgggcctctgtcagtcctacagggtgtccgtccccccagcaaggttataccaacgtgacatagggatcgtgcccgcaagacacccagtggacccggagaagtccaatagggtcttggggtttctagctctgattacgggcctttgtcagttctacgaagtgcccgtcgcccccaacaaggtcattaggccccccattaaccgggctttcatcaagaagtactgcgccctcaggcaggcgcagggcgagataccacaacagcctggcgatggctga

SEQ ID NO: 36019 - DNA, 102 bp, Glycine max
  Peptide Sequence Number=SeqID_127704
atgactctcttaaggcgaaaccacagccaagggaacgggcttggcggaatcagcgggggaaagaagaccctgtttgagcttgactctagtccgactttgtga

SEQ ID NO: 36020 - DNA, 303 bp, Glycine max
  Peptide Sequence Number=SeqID_127705
gtcgactctagaggatcccacgattccttgttgtcataccctaatttcgtccggggaccatcagttgttgggatgcgaccctcgtttgaccacttcgaggatgttcctccagaaggcggttgcttctggagggagcaacctagctcgcctgggcgagttgagctcacttgggcgagctgggtggcaagctcctctcctatttttcctataaatagggggaggaataaaggagaaaaatgttcagccccttctgattttcaaccgttcttcattcgttcttcgtcgttcttcggtctgcaaccg

SEQ ID NO: 36021 - DNA, 177 bp, Glycine max
  Peptide Sequence Number=SeqID_127706
atggcctttgtggataactgggcggtgggtaaggagaagaacaccggtcacgtgtctactatcacggttatcatctccctttccgtcattggaggtgccacctgggctgcctggtctctccacctttgggtgtattctttgaaagattcgtgccccctttttgcacatgttctgtag

SEQ ID NO: 36022 - DNA, 621 bp, Glycine max
  Peptide Sequence Number=SeqID_127707
ggagtcctctttccaaatgtggatgggttggtggacctggcagcgatcgacgtttttctcgcctatcataaccacaaggaaagtccgctctctaggtggggctggtttcacacctttttctccaagaaggcaggcccgcctatccgctacaaggaaggaagaatcaagattctatcttcatgcgaaggatgtccaaatgttcccttgatgggaacaaggggttgtattaattataatcccgttctcaccataagacagcttggctaccccatgagaggagcgccattagacgaaagcatcacgcctttcatcgcacggggttttagtgaccacaacgcgagggacagagagcttaggggaagcagtaatgggatcatcggcggctatcataagtggctgagagtccgaacacaaggattggattggatcccaaatctaaagactgtgagggacgatgaggttaaagcttcggaagaaagtgatgaggtacaagccctaaaggcagagcttgaaagagcccgagtagtcgaagagaagttcaagtccatagccatcaaaggcagcaatagtaagctcaagctccgaagaggtgaaaggaatcatcacgggtcaaaggcatga

SEQ ID NO: 36023 - DNA, 80 bp, Glycine max
  Peptide Sequence Number=SeqID_127708
atgcatgctagagatgagatgtgtctgccatcgccttggccttggctaataatcggggaagttcttgactcccgttcaag

SEQ ID NO: 36024 - DNA, 741 bp, Glycine max
  Peptide Sequence Number=SeqID_127709
atgaacttaatcattgttatcaaaaggaaagaacacactttacggtgcccttaccaaacccgtgctagagctagagtaatgggtgaagtagaggaggtgcaaaagcagatgaaggccgacatggaggccatgaaagagcaaatggccacaatgatggaggccatgatgagcatgaagaagataatggaagccaatgcggttgcagttgccgctaccagcgctgttgctaaggtgaacccgatgcccccatctggcctcaaccaaatgaatcatccaacctcagctatggtaggcaaagatttgggaagtacgagcggcctctattatgtgcaaattcaaaacaagcacgccttcccactatatggcttgcctcccaaatatacaccacccaatgtggcatacactcccagtgaggatgtcaataactctgctcccatactcattgaaagccgacaacctcaaattgatcatgcacatgtctctcaacccatgggagagacacatgaaatgccccaccacaatctagcggactttgagctttgcctcggatatgccactgaagggcaagcaattggtggtatacccttgcaaaacactttggagggccctcggtatcacccacaaccacacccctcacattccacagcggttaaaaaccctcatgctatggcagaaatgggaaagttggatcatctagaggaaagactcagggccattgaaggaggtgaagattatgccttt

SEQ ID NO: 36025 - DNA, 510 bp, Glycine max
  Peptide Sequence Number=SeqID_127710
atggtcattctacaccttttgtcatccagaggcggcgagccctatgacatgcgtagacaaattatggtcatccgcacacctttttggcatccaaggacgatcgactccgatggcacgcagagacaaattatggtcattctgcaccttttgtcatccagaggcggcgagcccgatgacatgcgcagacaacttatggtaatccgcacacgttttcggcatctagagacgatcgagtccgatgattcgcagagacaaattatggtcattatgcatcttttctcatcgagaggcgtcgagctagatgacatgcgcagacaaattatggtcatccgcacaccttttcggcatccagagacgatcgagtctgatggtacgcagagacaaattatggtcattctgcaccttttgtcatccagaggcggcgagcccgatggcatgcggagacaaattatggtcattctgcaccttttgtcatccagaggcgacaagccccactacatgcggagataa

SEQ ID NO: 36026 - DNA, 183 bp, Glycine max
  Peptide Sequence Number=SeqID_127711
atgtggaccactacgggggaggtggttgccgcccagctcgcccaggcgagctcagctcgcccaggcgagctcagctcgcccaggcgagccaggttgcttcctccagaagcaacagccttctggaggaatattctggagggcccaagtgggcctgggtgctatttgcacccccatttttactaa

SEQ ID NO: 36027 - DNA, 882 bp, Glycine max
  Peptide Sequence Number=SeqID_127712
atgaccagccctctcgatgagtcgatctcttgctttctcataagggtggacccttgggtacttgtacctatcacctttagaggactacacgtcctcaccttcgtagggctacacgccctcacctttagaggactacacgtcctcgccaacagagggatgcacaccctcaccttgagaagactacacgtcttcgccaacagagggctgcacgccctcaccttgagaggactacacgtcctcgccaacagagggctgcacgccctcaccttgaagaggactacacggctacacgccctcacctttagaggaccacacgtcctcaccttcagagggctacacgccctcgccatcagaggaccacacgtcctcaccttcgtagggctacacgccctcacctttagaggaccacacgtcctcaccttcagagagctacacgccctcgccatcagaggaccacacgtcctcacgttcagagggctacacgccctcgccatcagaggactgcatgtcctcaccttcgtagggctacacgccctcacctttagaggaccacacgtcctcaccttcagagggctacacgccctcgccatcagaggaccacacgtcctcaccttcagagggctacacgccctcgccatcagaggactgcatgtcctcaccttcagagggccgcacgccctcgccttcagaggactacatgtcctcaccttcagaggactacacgtcctcgccttcagaggactacacgtcctcgccttcaaagggtcatgtaccttcaccttcaaaggactacacatcctcgcctttaaagggtcatgtacctttaacttcagaggactacacgtcctcgtcgtcaaagggtcatgtaccttcactttgtag

SEQ ID NO: 36028 - DNA, 117 bp, Glycine max
  Peptide Sequence Number=SeqID_127713
cgggcaatagacacaccgccatcaccactaaagttcacctctgcttatccacaaaaaggtttgagtattgcctacgcaacatggccgaccaataggcgaccaagtccaaagccaaag

SEQ ID NO: 36029 - DNA, 354 bp, Glycine max
  Peptide Sequence Number=SeqID_127714
atgttggtggcgactccgcgcattttcctttcttggaagacgcacatgcgagccccgcgtcgccctcccgctgaagggcaggttgcgacaccaaccgttgaggaattagaccacagaaagcaagtcaaaaatggggtggttggagtaccgagaaaatgtttagaggcaaaagcaagaatcttggcaggtagaggtgaatgggccccgttcatagacatcctcgcacttttgatcttcggaggattcctctttccaaatgtggatgggttggtggacctagcggcaatcgacgcttttctcgcctttcatgaccgcatggaaagctcggtcgtcgctatcctagccgatctataa

SEQ ID NO: 36030 - DNA, 558 bp, Glycine max
  Peptide Sequence Number=SeqID_127715
atggctgactttccagaggattggcccaatgtgaaaaccaacccgctcgccaatcatggagggggagcggttaatgtcgttgagtccgataggccgcgcaggtctaaacctttaagggatgtggcaacccctaggaggtttatctttgaggccctacaaaagggaggtgtgattccccatagtgggcgtaaggaggattcctgtttgctgcattccggcgagctgcatgacatggaaacgtgtttgggatccacggatgggagcagtgttgcgaagcccaaacccttggtgatatacttcaccaagggcgcggcttcgcaaaaaaccggacaccccttggcaactaaacctgtcccattcccataccaaaatagccacgcagtcccatggagatatacacctccgagggagaaggaagaagaagccaccaacgtcagctcgttgtcggctaaggtaacaaatatcacgggactgagtggtgtgacccgtagcggtcgtgtgtttgcacccccggacctaccagtccaacccgcgaacgtcaaggggaaagcaaaagtg

SEQ ID NO: 36031 - DNA, 549 bp, Glycine max
  Peptide Sequence Number=SeqID_127716
atggtgcaaaggaaggacaaggaacttaggggaagtagcaacgggcctatcggtggttaccatagatggttgaaagcctatgcacaaggtttggattggctcccgagtttgaggaccactaaggagatggagggtgaagctctggaaaaagatgaagagaacgccgaactgagagacgtcaacatagccaccaccaaggccttagagcaagaggccaagagggcccgcaaggaagaacatggccggaacaagtttcgaggggctctgtggggcagtaacagcgaacttaagctccaaagagaggaaagggaccaatcacgattagatggcgtaattctgaaggacgaattgaagacttgcctaaggtcaaagaggagtttgtctcagcggttaggcgagatcgaaacaaacatgttggccatcatcaacaagtacaaagaagaattaagtttggccatcgcccacgagcacaaagtggcagacgaatacactcgagtgtacgcggagaaggaggctagaggaaaagtaattgactcattacatcaataa

SEQ ID NO: 36032 - DNA, 123 bp, Glycine max
  Peptide Sequence Number=SeqID_127717
atgacccgtggcaaatgcgtgaatagggatgatagggagggtattaaatggaagcaaaagttgaaggctccgaacgaaggaatgagaattgcgtgggccagcgttcaaaaattcggcgcccca

SEQ ID NO: 36033 - DNA, 1185 bp, Glycine max
  Peptide Sequence Number=SeqID_127718
atggccgtggttgagtttgaacctcaacaactacgcctcttcatccccaacttcctctccctcgatgaatgcaaagaattggaattcatccataagagtagcagcacggtgggttacagacccaatgtcttctccaccactctctcccatctcattgctaccaactcttcccacttcatcattccttttatacccatcagagaaaggttgaaagacaagttagaggagtttttcaagtgtgagtatgagctcttcattgaattcactggtttaatcagttggagtagaggagcaagcattggatggcatagtgatgataacaggccctacctcaaacaacgccacttctcagcagtatgctatttgaatacttatggcaaggatttcagtggtggactctttcacttccaggatggtgagcccaagtcaattgtgccaaaagccggagatgttgtgatgtacacagctgatgaccgtaacattcattctgttgatgagataactgagggagaaaggctcacacttgctttatggttcagtcgtgatggctcccatgatgaggatatgaagctcatttctcttctttcacaacacctgctacatgagaacgtggctgattcatacctacctttgccagcatccagtaatatgtactggttttctaaggaccaagcttccaattatcaattcggttttaatatatcctgggctagactgcatgttcttggatacgacatatatatttctcaagacagtagctgtgagtctgatgtctttgaattactggtaaagccagtgcgtttagtgagggataatgagttgttagaccaggaattcgtcaatattatgcatgcacttcaggttgtccatttctattgttggaaaggatcagctttactgaacaacatgtcaaatatagactccaaggtactaaaagtgacagaggtacagagagagaaaatcagtggtctgaattctgtacttttgaatgataatgattttgcatccaaagttttctgtaatatgccttcggaagaaaagggatgcatttgctttgactggtcagaagttctagctgcagttgctgcttgggaagattatgcgtcaaacttaagcaaacaaattcatttacagttgccttactggagaatgcatgagtctatatataatgtgcaattagagtag

SEQ ID NO: 36034 - DNA, 2172 bp, Glycine max
  Peptide Sequence Number=SeqID_127719
atggaaagccgtgtccacctcccttgctctaacgacgtcgtcgtccacgtcaacggcgactctgctcccgacgctcgccggtttcacccaaccaacgatgcatttccccctcaacaacaacaacaacagcatcaggagcatgggaaggaaagaaggggcagtttggttcttgcgtacaagactcttggagtggtgtttggaggacttgtgacatcacccctttacgtgtacccttcaatgccactcaagtctcctactgaagatgactatctgggcatctacagcatcatgttttggactcttactctcattggggttgtcaagtacgccaacgttgccattagagctgatgaccacggtgaaggtgggacttttgccttgtactcattgctttgtaggcatgtcaatattgggatcctgccctccaagcatgttggtttgaacacaactaaggacgtccaaaagagtacttcgcttgccagattcttccaaacaagcgtggttgctcgtaggctcttgctctttgttgctatgttgggtacttgcatgcttattggtgatggtatacttacgcctgcaatttcagtgttgtcagcaatggatggactaagagcaccttttccttcagttagcaaaacgctagtggaaacactctctgcaattgttttgatcgttctgttcttgttgcaaaagtttggcacatcccgtgttagtttcctcttttctccaataatgggtgcatggacgctgagtaccccacttgtaggaatttacagcatcatacaccattatcctagcatatttaaggctttatctccccactatatattccgtttcttttggagaaatggaaaatctggctggcttttacttggtggtactgtcctttgcattacaggttctgaggcaatgtttgctgatcttggtcatttcaatcagaagtccattcagatagcttttctattcacaatctacccatctttagttctgacttatgcgggacagacagcatacctgatcaagcatcccaatgatcatgatgacggcttctacaaatttataccaacttcagtttactggcctatctttgtcattgccacttctgctgcagttgttgctagccagtccttaatatcagctaccttttctgtaatcaagcaatctgtagtgctggattattttcctcgtgttaaggttgtccacacatctaataacaaagaaggagaggtttactcccctgaagtgaactacatcctgatgatcctttgtgttgctgtgatacttatttttggagatggaaaagatattggaaatgcttttggtgttgttgtgagcatagttatgcttatcaccactatattactcacattggtgatgatcatgatatggaggactcctgctatactggttgccctatactttgttgtattttttgtgatggaaggggtttatgtcagtgccgttttcactaaatttgctgaaggtggatggattccttttgccatatcacttatccttgctttcatcatgtttggttggttttatggtagacaaagaaagattgattatgagttaacccacaagataacctttgagagacttgaagagcttttagctgaccgcagtgttcaaagggttcctgggctatgcttcttttataccaacattcaagaaggcctaactcctattcttggacactacataaagaacatgaaatcccttcacaaggtcacaatattcactactcttagatatttgttagtccccaaggttgctccacatgagaggattgtcatcaagaaatcgaatctcgaaggtgtatattgctgtgtgattcagtatggctatgcagatgctttaaatttagaaggagatcattttgttaatcaagtcatcactagtttgacacaacatatacagaactctcctgacaagctttcatctgattctcgagagattgaagagacttcatacttagaagaggcaaggtgtgcaggggtagttcatgttcgtggaaagacaaaattttacattggcctgaactgtggctggtttgataaatttgtgcttagattttatgaagtcatgcacaataactgtagatctgccttgcctgctctaggggttccaccacaacaacggattgaagttggaatgctatacgaggcttga

SEQ ID NO: 36035 - DNA, 179 bp, Glycine max
  Peptide Sequence Number=SeqID_127720
atggcttcaggaacttcagcaccgcgattgattcccgagaggggtcaggttctaaagagggtcctcaaaatgcaccttcgcgtatctgaatttgttcttgtattgacctttgaccactcgtcaaattggacactgcgttcgtccaacaacaatgttgttcacctccgagatcaacctgg

SEQ ID NO: 36036 - DNA, 1581 bp, Glycine max
  Peptide Sequence Number=SeqID_127721
atggattacgaaaggatccaaaagcctcagggtggtgggggattttcaccgggaaaattgaggagcatgctactgggtgtggagaagaagaggaaagaagaggaagagcttgattctactttcaccacgagatctcagaattcagacatggatgaatctggtggtagtagttccgatcattgcaaagatgtagatgttgtgagtgtccttcctgaatattcaacttctgctatagttcgcactagtagcgtagaggcagttggtggtgatcgttttgtgaaggctaatgcaggagtgaattcaaggagtagaatcttggaagacccttcttcagattatgatagtgggcacgataatatgagcatgtcctcgtcaatgtttgaatttcaaaaggccgagcgtgccccacagagggttcccgtggggccattctcaaaaccagcaccatctaaatgggatgatgcacagaagtggatagcaagtccaacttcaaacaggccaaagacagtgcagagccaggggcaaggtgggcaaagtgggcatgtaggaccgcgaaaggttggtagtcttggttatggaagccggcaatcttcaatgaaggttgttgttgaagttccagatcaaaaagaaattgctttagatgaaccagataccaagcaaattgatacagatcagactaagatggaaactggaggacagaaatttgtgagttgggaggctgatccctatgcaattgcaagttcttgtgatgtctctggttcaagtcctgggtatgcaaatgcgttaaatacttggagggagagttttgccgcatatagtagtcctatctggctcaaacagcctccaatggaggatacctgtgatctagaccaaaaaaacctgggccttaagttacggtttacttggtccccatttagtctcagccagcacaattcatctcttgcaatccaaaatgaaacaacatttgttcctcccccttcaacagctcggtctgtatcaatgagagatatgggtaccgaaatgacccctattgctagccaggagccatcaagaacaggtaccccagtgagggcaacaacaccgatgcgcagccctaattcttcccggccttctactccccccagagcctcccctgcatctactttaactgatctgcatagtgacaatctgaatctcaacatgaatgagttgtccgaaaaggagctacaaatgaaaaccaggcgagaaataatggttctcgggacacaactaggtaaaatgagcattgctgcctgggctagcaaagaagaggaggataaggatgcatccacttccttgaaaacaaaaacagaaccacctaaaagtgtcgttgtagcacgtgcagcggcatgggaggaggctgagaaggccaagtatatggccaggtttaggcgtgaggagatgaaaattcaagcatgggaaaatcatcagaaagcaaaaacagaagccaagatgaaaaaaattgagatttttgggacaagcctttggacattaacctctaatcctaatatggaagaatctctgagtcagcctaacaatagcaacatctgcgtaagaagttga

SEQ ID NO: 36037 - DNA, 882 bp, Glycine max
  Peptide Sequence Number=SeqID_127722
atgttgacttcagcatcctcatcatcctccatcttctccttcacccctaaaaccctaaccatacccccacagcaacctcgcttcaccgtccgggcccactccaaaccccccattctccccaacctcaaaaccctcgccggcgccgcggtcttcgccgccgtcgcgctccaattcccctccaccgcacgtgcctcccctccgcctcctctcgaaaccgaccaccgcctcaacgtcgaggagtccctctcccctctctccgacctcctcgaaaccaacgccgaggccctcgccgcgctcaagtccctcctccagcagaagctcgagctcggcgaggacgacgaggcgctcgccatcctcaagcgcctcatcgccgcgcagcccgacgccgccgactggaagttcctcgcggcgcgcctcaccgcggagacaggcgactcggactccgcgcgcggctactacgaggaggtcctcgccgcgaacccgctctctttcgaggcgctcttcgagaacgcgctgctgatggaccggtgcggcgagggggaggccgcgatgcggcgcctcgaggaggcgctgcgagtggcggaggaggacaagatggcgaaggaggccagagacgtaaagctcatcatggcgcagatcatgtttcttcagaaaaacgtggatgaagcgttagtaatttataatcagctcacgaaagaggatcctagggatttcaggccttatttttgtagaggcatgatttatagcttgcttgataggaatgaagaagctaaggagcagtttgcaaaatacagggaattgagtccaaagaagtttgaggttgatgggtatttgagaacccctttgtcaaggatgaagctgtttagcactgatgagagttga

SEQ ID NO: 36038 - DNA, 1410 bp, Glycine max
  Peptide Sequence Number=SeqID_127723
atggtttttccaagacctccttctgagtctgacctctttcttcattccaactttgcttctcgctatgccagagactctcttcccaggttcagcatgcccgaggactccatgccaaaggaagctgcgtaccagaacatacatgatgagttgcagcttgatgcaattccaaagctgaacttggcttcctttgtgaccacttccatggaagaagagtgcaacaaactaatcatggaatccatcaacaagaactatgttgacatggacgagtatcctatcaccactgaccttcacaaccggtgtctgaacatgatagcacgtatgttccatgctgagatcggagaaaatgagaatgcaattggagcaggaacagttggatcatcagaggccataatgctggcagggcttgcattcaagaagaagtggcagaacaagcgcaaggcagagggaaagccttatgataagccaaatttggtgactggttccaatgtgcaagtatgttgggagaaatttgcaaggtattttgaggtggagttgagggaagtggaggtcagagaaggctattatgtcatggaccctgccaaagccgttgaacttgttgatgagaacactatttgtgtggctgcaatcttgggttcaacttacaatggagagttcgaagatgtcaagcttttaaatgacctgttgctagaaaaaaacaagcaaactggatgggatacgcctattcacgtggatgctgcaagtggtgggtttattgctccattcctatatccagagctagaatgggatttcagactcccatggaccaaggatgacttgccagaagaccttgtcttccatattaactaccttggagctgaccaacccaccttcaccctcaatttctctaaaggttctagtcagatcattgctcaatattatcagctaattcgccttggccaagaggggtaccgcaacataatggagaactgcagagaaaatgcgatggtgctgaaagaagatttagagaagagtggacactttaacatactctcaaaagacgatggtgttcctgtggtggcattttctctcaaagacagaagccggtacgatgagttcaagatatcagagatgttgcgccgccacggttggatcgtgccggcatatccaatgccaccagctgctcaacacatcaatgtgctccgtgtggtcatcagggctgagttttcgcgcacccttgctgaacgccttgtgcttgacatacacagtgtgctagatgaacttgaaaaggtacatccctccaaagtgaccaaaaacacaaaggaagagaacaagttattggttgaaaatggggtgaagaacaccgcattggacgcacacagtgaaatcattgctcaagaatccaacaagcgtcagaaaatcatggttgcctag

SEQ ID NO: 36039 - DNA, 369 bp, Glycine max
  Peptide Sequence Number=SeqID_127724
atgtacatgtggcagctgggtattggagtgggaaattatgcaatggtgggaaataatttaccatattctaccggtgagactactttgcagaaggaattttcaaattttggcaagatagctgaagttaaaatggttaaagatatgaacacaaaaagatctaagggtattgctttcattcaatatacatgtcaagatgatgccatgcttgcactagaaaccatggatcagaaggatttttatggtcgaacaatcggcgtggaaattgcaagactgggttgggatgattttggtgcatccccaagggcctcaggacccccaaagaagtgggatttgccagagcaaggggaagtggtagattgctggtactga

SEQ ID NO: 36040 - DNA, 1585 bp, Glycine max
  Peptide Sequence Number=SeqID_127725
atgtttactgctctgggaatttatgtagaaacctttgagaagccattccttgagtgcacatccgaattttatgcggcggaagttatgaaatacatgcagcaatcagatgctccagattacttgaagcatgttgagacaagattgcaagaggaacatgaaagatgtttgttgtacttggatgcaagtactaggaaaccattgatagggattgcagaaaagcagcttcttgaacgtcatatacctgccattcttgataagggttttattatgcttatggatgggaatcgtattgaagaccttcagagaatgcactcactcttttcaagggtcaatgcccttgaatcactgaagcaggcccttagttcatacattaggagaactgggcagggcattgttatggatgaggagaaagataaagatatggtctcatcccttcttgaatttaaggcttctcttgacacaatatgggaagaaagctttttcaagaatgaacctttcagcaattcaattaaagatgcatttgaatatcttatcaatcttcgtcagaaccgacctgcagagttgattgccaagtttttggatgagaaacttcgtgcaggtaataagggtacttctgaagaggaactagaggctacacttgataaagtcctggtgttattcaggttcattcagggcaaggatgtatttgaagcattctataagaaagatcttgctaaaagactgcttttaggaaagagtgcttctattgacggtgagaaatctatgatctccaagttgaagactgagtgtggcagccagttcacaaacaaactggaaggaatgtttaagcttctgacaactatgtctcaaattgttgtgaatcaggacattgaattatcaaaagaaataaatgagtcattcaaacagtcatcacaggcgaggtcaaaacttgcatcagggattgaaatgagtgttcatgttttaaccacagggtattggccaacatatccccccattgatgttagacttcctcatgaattgaatgtttaccaggatattttcaaagagttctatctaagcaaatacagtggaagacatctgatgtggcaaaattcactaggtcactgtgtcttgaaggcagagtttcccaaaggaagaaaggagttggctgtgtccctttttcagactgttgttctaatgttattcaatgatgctgagaagttaagtcttcaagatatcaaagatgctactggtattgaggacaaggaactgagacggattctgcaatcactagcttgtggtaaagttcgtgtcctacaaaagatgcccaaaggaagagatgtggaggacgatgactcatttgtttttaatgatgggtttacagctcctctttaccgtataaaggtgaatgcaattcaattgaaggagacagtcgaggagaacacaagcaccaccgaaagagttttccaagaccgtcagtatcaggggatgaaatggattggaatggaacttgatagaaatagaatgcattccagtatattctatgatttccatccaattcctctttctcccgtttctatttatttggggaaatgggatggaagtg

SEQ ID NO: 36041 - DNA, 1998 bp, Glycine max
  Peptide Sequence Number=SeqID_127726
atggcagcatcatcagcatgccttgtagggaatggtttatctacacggggtaatagaataactcttaagaaggacttcaatggaagaagatatctctactcatcttggagattttcattattgaacaacaataaggcatcaaaagcattttccataaaggcatctttggagcaaaggcaagaagaagggagaagggggtttctgaaactgttgcttggaaatctgggagttggtttgcctgcactattgggaagtggcaaagcttatgctgatgaacaaggggtttcatcctccagaatgtcttactccaggtttctggagtatttggacaaggacagagttaaaaaagtggatctttatgacaatggaaacactgctgttgttgaggctgtttcgcccgagttggggaaccggtcacagtatgttagagttcaactccctggacttaaccaagagctccttcagaaattcagggaaaagaatattgactttgcagctcatagtccccaagaagagtcaggttctcttttagctaacctgattgggaatctggctttccctttgctcttgattggaggattgttccttctctcgagacgatccggagggatgggaggtcctggtggccctggatttcctcttgcttttggtcaatccaaagccaagtttcaaatggaaccaaacaccggagtgacatttgatgatgttgctggggtggatgaagccaagcaggactttatggaggtggtggagtttttaaagaagcctgagaggtttactgctgttggggctcgcattcctaaaggagttcttcttgttggtcctccaggaactgggaagaccttgttagccaaggctattgctggtgaagctggtgttccatttttctctatatcaggttctgagtttgttgagatgtttgttggtgttggtgcttctcgtgttcgtgatttgttcaagaaggcgaaagagaatgccccttgcattgtctttgttgatgaaattgatgctgttggaagacaaagagggactggaattgcaactaacagggctgacattcttgactcggccttgttgagacctggccgatttgatagacaggtgacagttgatgttccagatataaggggaaggactgaaatcctaaaggttcatgctagcaacaaaaagtttgatgctgatgtttctcttgaagtgattgcaatgagaacacctggctttagtggagctgatcttgcgaatctgttgaatgaagctgctatattagctggtcgccgtggaaagacagctatttcatctaaagaaattgatgattctattgataggattgtggctggaatggaaggaacagtgatgacagatgggaagagcaaaagtttagtggcatatcatgaagttggtcatgctatttgtggaactttgactcctggtcatgatgctgtgcaaaaggtaacactagttcctcgcggtcaagctcgtggacttacatggttcattcctaacgatgacccaactctgatctccaaacaacaactctttgcaagaattgttggaggactaggtgggagggctgcagaagaaattattttcggtgagcctgaagttacaactggagcagctggtgatttgcagcaaatcaccagtttggcaaaacagatggtgaccacatttggaatgtctgatattggtccttggtcacttatggaaccatcagcacaaggtggggatgtcatcatgagaatgatggcaaggaactcaatgtcagagaggcttgcagaagacattgatgctgccatcaagaggatctcagatgaagcatatgaaattgcactggagcatataaggaacaaccgtgaggccattgacaagattgtggaagtccttctggagaaggagactctgagcggagatgaattccgtgctatattgtctgagtttgttgaaattccagctgaaaaccgtgttgctccttcaactccagtaccagccactgtttga

SEQ ID NO: 36042 - DNA, 2025 bp, Glycine max
  Peptide Sequence Number=SeqID_127727
atgggcaggtttgttgtttctcgtactcgcttctcagtgcctatcgtttttcaaaattcaatctttcgcttctccacgatttccttcaaaacccactttcaaaatggtcgcttttctgatggcaatgaacaatttgccaccttgtgttccaaagggcacataagagaagcgtttgaaagctttttatctgagatatgggccgaaccccgtttgttctcaaacctcctccaagcatgcattccgttaaagtctgtttctttggggaaacagcttcattctctgatattcacttctgggtgttcctcagacaagttcatttccaaccacctcctcaacctctactcaaaatttggggaacttcaagctgctgtggcactgtttgatcgaatgccaaggaggaacatcatgtcatgtaacatcatgatcaaggcctatcttggaatgggtaatctcgagagtgccaagaacctgtttgatgaaatgcccgacagaaatgttgccacgtggaatgcgatggtcacggggttgaccaagtttgagatgaatgaagaggctttattattgttttcgagaatgaatgagttgagtttcatgccggatgagtactcgttaggtagcgtgctcaggggatgtgcacatttgggagctttgttggcagggcaacaggttcatgcctatgttatgaaatgtgggtttgagtgtaatttggttgttggatgctctttagctcatatgtatatgaaagctggaagcatgcatgatggggagagagttatcaattggatgccagattgtagtttagttgcttggaatacacttatgtctggaaaagctcaaaaagggtacttcgagggagttctggatcaatactgtatgatgaaaatggcgggttttagaccagataagattactttcgtgagtgtgatcagctcatgttcggagttagccatcctttgtcaagggaagcaaattcacgctgaagcagtcaaagcaggagctagttctgaagtttccgtagttagttctttggttagtatgtactctagatgtggatgcttgcaagactctatcaaaacatttctggaatgcaaagagcgagatgttgtgttgtggagctcaatgattgctgcttatgggtttcacggtcaaggagaagaagcaatcaagcttttcaatgagatggaacaagaaaatctgcctggaaatgagatcacattcttgagcttgctgtatgcttgcagtcactgtggattgaaggacaaaggactcggtttgtttgatatgatggtgaaaaagtatggactcaaggccagactacaacattatacttgtctggttgacctactgggcaggtctggttgtttggaggaggcagaggcaatgatacggtccatgcctgtaaaagcagatgcaattatatggaaaactttattatctgcatgtaaaatccacaagaatgctgaaattgcaagaagggttgctgatgaagttcttaggattgatcctcaagactcagcttcatatgttctacttgccaacatctattcttcagctaacagatggcaaaatgtttctgaggtgaggagagccatgaaagacaagatggtgaagaaagaaccaggcataagttgggtagaagtaaagaatcaggttcatcagtttcatatgggtgatgaatgccacccaaaacacgtggagattaatcagtatctggaagaattaacttcagaaatcaagaggcagggctatgtacctgatactagctccgttttgcacgacatggacaacgaggaaaaagaacagatcttgaggcaccatagtgagaaattggcaattgcttttgctttaatgaacaccccagagggagtgccaataagggtgatgaaaaacttgcgggtttgcagtgattgtcatgttgccatcaagtacatatcagagattaaaaaattagaaattattgtgcgagattctagcaggtttcaccatttcaaaaatggcacatgctcttgtggagattattggtag

SEQ ID NO: 36043 - DNA, 372 bp, Glycine max
  Peptide Sequence Number=SeqID_127728
atgtggcctctaagctctcaaaagaacaccaacaccaccagcacagtgaagatgcaacatgaatctgccaactccacccccacaactaccgtggcaacgaaatctatggtctcaacatgccgctgttgttgtttggtgacaaaactgatgaggaaactcaagagacgtaaccgcaaactgcgaccaaaaagtgcaagtcgacagggttcattccaatgccgctatgatcctttgagctattccttgaactttgacaccactggaatggatgaagattactacaagttctgtgctttttcttcaaggtttgtggcaaatccaagaacttcatgtcccgctgttcaagtacagggaactcccattaaccaatag

SEQ ID NO: 36044 - DNA, 591 bp, Glycine max
  Peptide Sequence Number=SeqID_127729
atggcagcttcttcttctcttttctcctcttcaatgcatatggagatgtttgctccaaagacatcaaaatctttaagtatgaatatgtcatcaaaatgggaacaaacggatcgaagagatgcattgcattgccgcgctttgaaaattgagcctgcaccttccttttcggtggggcagaaatttcaatttgatgatattatagaagctcaacagtttgatagagatattctcagtgccatttttgaagttgcacggaatatggagaacgttgaaaaggattctcctggtagccagattttaaagggttttcttatggccaccctattttatgagccttctactagaactagactttcatttgagtctgccatgagaagactaggcggagaggttttaactactgaaaatgcgagagaattttcgtctgcggctaaaggagagacacttgaagatacaatcagaacaattgagggttactctgatataattgtgatgcgacattttgaaagtggtgctgccagaagagctgcagctatagctgacattccaataatcaatgcaggggatggtcctggacaacatccaactcag

SEQ ID NO: 36045 - DNA, 552 bp, Glycine max
  Peptide Sequence Number=SeqID_127730
atgtctaatggcttcaggcttggacatagaatatgggaattgcacagaattataaatataagatataagatgataagtgatgtatcagaggtgcttgcagaaatggaaaatagcaataagagagagaaagggaagagcgaatttctgagagccactgctctcccaacaattacctcactacccctctcaaacataattcagaaattctcagtgcctaacaactttgggcctacgttgataaaccttaagaggcttatctccaataaggccctgtttcctaacataagacagttcagttcctctctgtgctggattgctcttgggattggaaattttgggatccgtgtgaaattgccaatcatacttgctgaaaaactactaataaaggcaaaaggtcaaaacctcacatctacaatggcacgtgctgcctcagatagactaggagaaatgtctagcaaatcacacctgaaatatagaagtcgtaaatccggaaacggtattgtcaggacatttcggaaaagcagaagggaacacattcaaaatgccaactaa

SEQ ID NO: 36046 - DNA, 984 bp, Glycine max
  Peptide Sequence Number=SeqID_127731
atggaaaccctagcacgagacaagaggcgtagcgtaggagatggtgcggagcttgtgaaatcgaatatcaaaacccctccaaggccaaaacggcgtcgtcaaccactcaaatcatggcctgttactttctccccctttgctcgcgctctcgctctctctcgcatcacctctctctctccaccaaaccctaccccaaccctctctgctaagaaaccgcaaccctctcatggatctgtccatgcagatttatcccaaccggaacactccgagtcttccgacgaggacttcgatggagttgtccaagcagatttttcatttttcgatcccaaacctaatgattttcacggagccaagaccttgctgcaaacctacctcgacgaccaggaatgggatttgagtgcctttgtagacttgattttggcacagaccaccgtaggctctgttgttaagatagaggacgacgaggatgaagggctcttcgctcttgttactgctcttaatttatatagatacagggagcataagtgtattgcgacagttaaggattttctcctccataaagtgcgccaagagaagagtgtccatgaccagttgaaattgctgttgggggagcaagcgcatgatgttggtctcctggtatcgcagcgcatggtgaaccttcctccccagcttctgccacctctttatgatgccctttttgatgaagtgtcctgggccacggaagatgagccgacggaggagctccagaattccttcaagtttaagcattatataatacttaccaaaatttacgtgctcaagaatgtagaacagaaaagaaaacagagcaatggtagtgatgaggcaataatatacataaagcttgaggatgaaatttttcacaagttaagctcgtggtccttctgttttccattgcaaactcagcagcttgcacctcatgaggcaagttttatgtttcttcaatctcaattaccatttttgtga

SEQ ID NO: 36047 - DNA, 822 bp, Glycine max
  Peptide Sequence Number=SeqID_127732
atgggtcgtggaagaatacctatggaactcattaaggaggagaaagcctgtgaaaaaacatttcacaagagaaaaaaggggttattgaagaaagcttatgagttttccaccctttgtgcagttgatgttggcgttattatctatgctcccaaatatcttaatgaacctgaaacatggccccaagacaaagactcaagagaggtaaaacgtgtcattcaaaaatatcataacaccactagtgataggcatcctaaggtgtatgatgtgcaagagtattttaacgatagaatgaaaaagattgaaagtgagatttccaaagtgcacaaagaggagataaagctcatgtacccaacttggaatgagtcttacaatactcttggagagaaacaattgaggatgtttgttggtattctggatgccaaacttgatgcttgtaatcaaaggatgaatatgttaaagcaagattcaaagggaaaaggaatagcaaaatcggacaaaattgagacgcttactccctacatggcctcaaatttaggtagtcacctaaatttcatgtctcaaacacaacttttcactcctagtgataacaatcaagtagcattttacccatttcagcttagccaaagttctcaaccttctacgtttcatggtggtcaaagttgtgtgcaattgatggagaaaaatgcaatggtggattgggctaatcaagttggtgttggtgctaattgtgatcccaaaatgggtgtactaaaggaggatcaatctaacaaaactcaaaactcctcaccatgctactacaatggaaatatgcaaactacatag

SEQ ID NO: 36048 - DNA, 507 bp, Glycine max
  Peptide Sequence Number=SeqID_127733
atgagcttcacattcaacctccatgttcccaaagctctgcctcctcttccctcttcatcacgtggaacaacttctctcttcttttcttcaaagcagaaatcataccacaacaacactagtccttgccaatcactacttataacatgcagaagccacaaaccaaattatgatgataccagcctaaagtatacaagtttggcactgcaagtaggagcactcttggccttgttgagtgtagcagtgactggagagaataaccggccagaactcatctgggttttgacccaatggggggttgttctctttggatatttccttgtcgtgccacagtatctaaaactgagttgtgaaatggttcttctttgggcaccatttttaaacttcaggaaattccctcgggacacttccttgcagtacccttggtctgtacctgaagatccttcaaaaattagaagttcatacgcaaagtacccatatgccgaacctgaagattatgataatctatga

SEQ ID NO: 36049 - DNA, 1053 bp, Glycine max
  Peptide Sequence Number=SeqID_127734
atgctgggaactgcactgcaattcagcggcgttcgcggcgaggatcggttttacattccggtgaaggcgaggaagaaccagaatcagcggaaacagagtcacagagccaagaacaacgaacctgaaaacgcggatttagcttcgaagaacaaagtcgatgtctctgaaaatagcaataacaatagcaacatcaaaagcaagagcgatagtaatctcaaccaatctctgaaaccaactctttctccgtccgtagaggctgtcagtaatatcgataggttcttggagtttacaacaccgtcagttcctgctcagtatttctccaagacaacgatgagaggatggaagttttgcgatgtggagtatcagtcttactttacattgagtgatctgtgggagtcttttaaggagtggagtgcgtatggagctggagtgcctttggtgcttgaccaaagtgattctgttgttcagtattatgttccctatttgtcagctattcaactctatgctcactctgctgagaagtcaagtgcaaagccaaggtacaccagtgaagacagtgagggtgattactacagagattcatgtagtgaaggaagtagtgattatgaatatggaaaaaggactgaatttatgacacaaagaagtagtcagcatctaacaggtggtgtctcactgaaaatggacacactatctatgcatgataaatgcagtacagtgcaagaaggattttcaagtgatgatagtgaaactgggaatcctcaagatctactattcgagtattttgaacaagatcctccttatagtcgaagtggtcgtactcatgctccaacactggtttatcccagtcagatggatgttgtaccaaagatttctatgcctacttttgcaatggcttcctataagttaaaggggtctatttggatgaaaaaaggagttagtgaatctcaacaagtgagttccctcttgcaggctgccgataactggttaaggctagttcaggttcatcacccggattttcagttctttaaatcacatggcacataccatagatga

SEQ ID NO: 36050 - DNA, 168 bp, Glycine max
  Peptide Sequence Number=SeqID_127735
gagcagaatcgtcttaggcgatggtcaaataccgagccaaatccaaagacagagacaaatcgaggtactcagggacggatgcgagtaaaggctaggcccatgatcgacaaatcgttgtctcatgtccagctccggacaagcgggaagcgctgctgggaggcagcctag

SEQ ID NO: 36051 - DNA, 255 bp, Glycine max
  Peptide Sequence Number=SeqID_127736
atgacaaaaatctccgcgtgtcaacgggttcgcttgcctctggttgacaaaagaacttgtggggcggctgacaaaagcgaggctcttgctcctacgtatcctcaatttgtgatgaggataaccataaggtacccccgcatgtcatcagacccgccgtctcttgatgacaaaggtgcagatgacaatgtaagtctcttcgtgtcaacgggctcgcttgcctctgggttgacaaagggtgctgaagacgacgtttag

SEQ ID NO: 36052 - DNA, 1050 bp, Glycine max
  Peptide Sequence Number=SeqID_127737
atgaccaactatctgctggagccgcagctgccgtgggtggagcgcgcgatctttaacgtaggtggacagagccttgagtacggtaatccgctgatcgagcataccgtgccgtccgatgacgaagttgcgtacgatcaggcctcgctgcgttatccctacagcattacgctgtacggcccgtccccggcgcgactggcgctcaataccctgccgtctcagctgccgctggcggtactgctgagcctgctgctgggctatatcgtctggctggccaccgccaatcgcatgagcctgagctggcaaatcagctatggcatcaccgctaacgaatttatggtctactgccagccgctgatcaatgcccgcagcggcgactgcgatggtatcgagctgctgctgcgctggcacaatccgcgtcagggctggattgccccggacgtatttattccgctggccgaacgccagaatctgattgcaccgctgacgcgctttgtgattgccagagtcgtcgcggagttgcctaatctgccacagtgcccgacatttcatatcgcgattaacgtcgcggccagccacttccgcgatcgcctgattgttgaggatttacagcgctactggtggcccgccaatcccctgccaaaactggtggtggagctgaccgagcgcgatgcgctgccggtcatcgaccagacggtcgtggcgcagctgcatgaaattggcgtgcggctggcgattgacgatttcggtaccggccacagttcgctggcctatctgaaggatctgaagccggacgtactgaaaatcgataaaatttttaccgccgcgattggtactgacgcgatcaacgccacggtgacggatatggtgatttcactggcgcagcggctgaacatcgcgctggtcgcggagggagtggaaaccgccgagcaggcgcattatctgcgcgagcgcggcgtggatcatctgcagggttactactatgcgcgcccgatgccgattgaggacttcccgcaatggctggcgcagcatcaggcgcagctgggcgcctga

SEQ ID NO: 36053 - DNA, 225 bp, Glycine max
  Peptide Sequence Number=SeqID_127738
atgatttatgttaaccctgacccgggaagtcaggcagcaggcgggggtttttactctcgtcttccggagacattcaagcccgatgacacacgagattcttctctgctaggtggggacgatcaagccatagcgtgtggaaacgtcatggttatcccattttatcactttcaaggaaccgaagttttgctgacgctcatgatgcctttcgcttttctttctgaatga

SEQ ID NO: 36054 - DNA, 594 bp, Glycine max
  Peptide Sequence Number=SeqID_127739
atggtctgcaatgaccaggctgatatgactggcagattgcttgctggatcattaacttttgattaccgcatcatgcattatattattgttcacattttgcttccacgttcctcaaaccttgctcaaacctttgaggagaatttgattcttatgtgggcttttcttactggtcatcagatcgactgggctcatttgatttggtaccagatgcataaggaattacgggccaatgcacctctcccttatcctcaccttgtcaccctttttcttcattatttcaaaattcctttggatgatgaaccatttattcaagtaaaaaggtcttttgctaatggtgcagacttacctcagccaattcctgacgaacgtaccccttctccaccaccgcaaaggattgattcctcttcacttctaaacgacgtcctcactgaactctacggtcttcgcgctttcgtgggtgatcgatttgatgctatggatactcaccttgatgccatggatgctcgctttgatgggatggacacgaggatcactcgacttgaggacgatatgagcttcattaggcattgtttcgatccaccggtcgaccattag

SEQ ID NO: 36055 - DNA, 261 bp, Glycine max
  Peptide Sequence Number=SeqID_127740
atggcttgcacccaattccggatttacacacgattctcctcaaatttcagccagcatcaattagaccttgcaccttacgcttcagagccctacaatgctcaatgggacgccccgaggcttctccgtgacaagcacacgttgcgttcgagtcgtattctcggagaaatgaaggttgatgaaccttggttggggttatggctaccattgaatcatcaagtagatatgggagcaagtcagcataggacactggaactggggtga

SEQ ID NO: 36056 - DNA, 747 bp, Glycine max
  Peptide Sequence Number=SeqID_127741
atggaacctctccaaatgcaagccttccgcaagacttacggaaagatcttagatttgaccatagcagaggtatccatagaggccattgcgtcactcacccaatattacgaccagcctttgagatgcttcacgttcggggacttccaattggtaccaaccattgaagaatttgaggagattctaggatgtcctctcgggggaagaaaaccatatcttttctcggggtgtctcccctctttgagcagaattgcgactgtggtcaaggattcagcaagagatggtttggtggacctagcagcaatcgacgctttccttgcataccaccatagcaaggaaagtccggtggtagctgtcttggcagatttatttgacacatttgaccgaaggtgcgagaagagtagcgcacggatcatctgttgcttgcccgccctctgtgtttggttggtttcacacctgttccagcaagacactaggcatccatgtccgctccaaagccatcgctcgtgtgctgaaaagagaagaatagattgggaccaacttttggctggtgtaggaggtagaacaatcaattggttctcccgatggaaggaaggaaaggagggagtccttttctcatgtaaagggtacccaaacattccgctaataggaacgaggggttgtattaactacaatcccgcgctcgctataagacaactagggtaccccatgaggggagcaccgatggaagaaagcaagtctcctttcctt

SEQ ID NO: 36057 - DNA, 459 bp, Glycine max
  Peptide Sequence Number=SeqID_127742
gttccacaagttcttccgcgagcaggaaatgttgcctgcggaagaaggttccgcaggttctttcgtgggatccgcggaagacatagttctttcactggagcccgcggaagaacctccggaaccatcttccgctggatccagcggaagaaccttcggaaccttcttctgccggaacgcgtggaagaaccttctccgctttcttccacaggttcccgcggaagaactccttcttccgcttcaatatccaactgcccctcccacatgcgcagaagaaggttcttctggcggaagaaccttcgtcttcaacctcagccaccacacatcactcatgtcgtctatcctacgaccattaacgcttccaaatgaagacacgagaagacgaaggaagaagacgaacctttttggaaggaaggagaagaacgaaaccaaggaagaagaagcttgcggggaggttgctgg

SEQ ID NO: 36058 - DNA, 291 bp, Glycine max
  Peptide Sequence Number=SeqID_127743
atgtcaggatttacacgcgattctcctcaaatttcagccagcccgcatcaatttgaccttgcaccttacgcttcagagccctacaatgctcaatggaatgccccggggcttctccgtgacaagcacacgttgcgtttcgagtcatattctcggagaaatggagggatggcctttgtggataactgggcggtgggtaaggagaaggaaaggcagtcacagcatgggtttctccctcatcctcaccctctttatttgccccagttttctcattcgtccaagcaggatgattaa

SEQ ID NO: 36059 - DNA, 429 bp, Glycine max
  Peptide Sequence Number=SeqID_127744
atggaagagggattttctcatggttcagttccaattattttaggcaggccatttatgaaaatagcccgaaccaagatagatgtttatgctggcacattgtctatggaatttggtgatattgttgttcattttaacattcttgatgccatgaaacatcaatctgaggatcattctattttttgtgctgagataattgatcagattattgatgattatatgtttgattttgattctgttcttcatggaaagcggaggaaccttcttctttctcctaccctagttcctcccactgttcagccacccccccacaccggagttgaagcccttaccagcaaccctcaaatatgcttacttggaggacaaggaaaaatttccaatgatcatctctgcccttccttgctactaagcaagaggagaagttgttgctag

SEQ ID NO: 36060 - DNA, 305 bp, Glycine max
  Peptide Sequence Number=SeqID_127745
atgtccaatctttttgaatttgggatgaccagccctctcaatgagtcattctcttgctttctcataagggtggacccttgggtactagtaccctcaccttcagagggctacacgctctcaccttcagaggactacactccctcgccttcagagggctacacgtcctcgcctttagagggctgcacgccctcgccttcagaaggctacacgccctcgccttcagaggactatacgccctcgccatcagagggctacacgccctcaccttcaaagggctacacgccctcaccttcagaggactacac

SEQ ID NO: 36061 - DNA, 216 bp, Glycine max
  Peptide Sequence Number=SeqID_127746
atggagttgcaaagactaaatcaacatgaagaaaatgataagaagaagaagggaattgctcttaaagcctcatcttcaatccaagacgaaagtgacatagaagattcaattgatttagatgaagatgaagatcttagcctctttgtcaaaagattcaacaaatttattagaatgagaggaaatcaaagaagacaaaacttcaaatctaaaagatga

SEQ ID NO: 36062 - DNA, 330 bp, Glycine max
  Peptide Sequence Number=SeqID_127747
atgccctttcgtgggcgagcgaggcgtggctcacgggtgcgctttccaaagaaggaaagatgcgaggagtcgccaccaacgtttatttgtggaaaacgtcggaaaaaccgaaggaaaccggtcaaaatgaaaattctaagtttgggagttgtatttacgtttgaggaaggtcgacaaagggtggggcttttgcgcctacgtaccctccatcaaagaggaaatcagacctacgtagttctttcttttaagggtgaatcaagcgattctttttacttgaaaggtgatgattttaaggcgttggaccttaagaatgatccatttacttggtaa

SEQ ID NO: 36063 - DNA, 285 bp, Glycine max
  Peptide Sequence Number=SeqID_127748
atgcatgtacagtatgcaatcattggggcaaacatacccatcggacacagtatctcaagcagtgaggggcgtgtgcttgctgaaaagactcttgtccaaggtcacgaatcatgtcctccaagcgatctcccatttctacatcaaacggttcagattgggacccatgatgcaatcctaccccaaagggcattggatagaagactccaagaagattgggccagagatgtaagagaaggcctaagggttgtcatgagccttagggtagattttggacccatggactaa

SEQ ID NO: 36064 - DNA, 261 bp, Glycine max
  Peptide Sequence Number=SeqID_127749
ggattaaaactcaatgtacctcctttcaagggagggagtgatccagatgcctaccttgactgggagatgaaaattgagcataaactccagaggctatcccaggaaagtctgactatggaggagtactacaaagagatggagatggcactagagtacgtggaattggatgacttgctacataagttcgtccgggttgagcaacagctgaagaggaaaactgtagcaagaaggaactcactcaacactttcaaccagaactag

SEQ ID NO: 36065 - DNA, 241 bp, Glycine max
  Peptide Sequence Number=SeqID_127750
atgaagcccacttgtgccttccagattcttcctccaaaaggcggttgcttctggtggaagcaacctggcttcgcttggggcgagctgtgtggcaagctcctcccctattttgctataaatatgggaggaatgaagaaggaaggggttcagccttcttggcacttctattctcttgaaatgctgaggaaaattgtttccgtgaagaaaatccaaccgaggcgcttccgtaacgtttccgtgg

SEQ ID NO: 36066 - DNA, 624 bp, Glycine max
  misc_feature (621)..(621): n is a, c, g, or t
  Peptide Sequence Number=SeqID_127751
atgatccaggaagaaatcatgagtggagcttccttatttcattcgctggagaaatggaacccgaggttgcatataggatacaggttgacttgggtccagtgctggggtattctgttgatagcctgggacacgacgcaaattcagaagattttggctgcgattggggatatggtggaggtggacgatgacgttgaagaagttcggagggtggacagggcaagggaaaatgggtacagtacgggaacatgcaactgccgattcaggagtgctttgagatcatcggaggaaatcgagtccgacgaaagtgatattggaactccggtaccggagatgttatgcgcgtcggagaaggaagatgagccgaaaaatgaagatgggaacacgacaatacctagtggtctaaacggaaaggaaagaccacatggtaaaaacattggcccgtgggtacaacgcttcaatcagaaagggagcagagcagatagcacaatggatatcgatgaagaacaagaaacacacaagaatagagaggaacaacatgtcgggaacatcaacccgacaaagtgggagaaacaattacacgaaaacggaaaccaagagtctggaaggagctgtgaggtgttnggg

SEQ ID NO: 36067 - DNA, 414 bp, Glycine max
  Peptide Sequence Number=SeqID_127752
atgattataaggggccaagacatttataatagccaagataaggctattacttcaccttcctctagtgaaagtgaagaaacaaaaggggaagaatctagtgaagaaatctacccccaagaagaaggacaacctttaatggttaaggaggagtgtaaggaggtaagtgtctcctctaagaggttagttaagaagacacttgttagcactgccacacctcttgagcttgaggttattcctcaagtaaaggagttgttggatgagggtttggttcgtaagagcttaactctttgtgctttgttggtgcccaaaataggtactatgaggcatcaaatccctatgataggtggtatgatgaatgtgttgagtggtgcaaccctcttttgtaaatcacccatgcatccaacatcttcatga

SEQ ID NO: 36068 - DNA, 93 bp, Glycine max
  Peptide Sequence Number=SeqID_127753
atggaccctaaaagaataaaggtcattcctgagggcctactccaccaagtgttgaggaaagaattaatgagtttcaagaacctcgggatttga

SEQ ID NO: 36069 - DNA, 312 bp, Glycine max
  Peptide Sequence Number=SeqID_127754
atggcttctccatctgcctcccctcctcctcctccttctcctccttttgctccttcggacgcatcggctttgccgtctgccgtgaagcggacacgcaaagcctcacgtctacgatcgttgtctactagaccacctggtgctgagagaccagtggtccatgtagatcctgctaccggcaaggctgacggcctccataagaagaaattaaggacatatttggggattgtggcacgtgataaggtggacgtcacctacgagaattggaagaaggtccctactgctcagaagggcctgacttgggaggatattcag

SEQ ID NO: 36070 - DNA, 187 bp, Glycine max
  Peptide Sequence Number=SeqID_127755
atgcctcataccacctatcgcaacatgcccttttgcgggcgagcgaaggcgaggctcacgggtgcgctttccaaaggaggaaagatgcgcggagtcgccaccaatgaaggtattagcacctctcacgtcgacaaaagcggggcttttgctcctacgtaccctccatcgaagaggaaatcagacctac

SEQ ID NO: 36071 - DNA, 264 bp, Glycine max
  Peptide Sequence Number=SeqID_127756
atgaaggggactgggtttggctccatcttaggaaggataaattccctactaagaggaaatccaagcttagtcctagaggatggaccttttcaggaggaaccaacagatttgaggtcaaatccccttcaagggggaggggatgatacaatcctccctaagaagggatcagtcaccagagccatgagcaaaagactccaagaggattgggctagagctgctaaagaaggtcctagggttctcatgaaccttaggatagatttctga

SEQ ID NO: 36072 - DNA, 700 bp, Glycine max
  Peptide Sequence Number=SeqID_127757
gatgttagggaaattgtcctggtcgatgaggaccctagacaccatgaaattcactatgatgatggagacaaccaccgggattgtcttggttgatgagattgatgcccctgaagtgctgctttcgggactggttggactatccttcataggaaaagcctctagcgatggtgttgattacacctctgatgtgctggcggattcctattctggtgaaggccttgctcctgcctgggagtggtctggtctcttaacaaactgggctaagtatccagcctgtataagttcttcgatcttgccgttcaaggcccaacaatctttggtgttgtgtcaataccgcggtgaaacctgcagtacttggttgcgtctgaccctggcctcagagatttcatttggggtagccggacaggtacctccaggtcgaaggcttcctcaagaatcatggtacgattggccgtcaatgcttgtgcctcttgtccgacttgtgcaagtcggtcttggtgtttgctttgcacctttcacacttttgtttgacttggtagacttcattccagaatttggacatttcttctatctggatgtaacccttggctcgttcatgcggctcatccatgctaccagggttgagatttcggatctggacgactgtgcgcccaaatttgccaatgaactttctgagggattcatcgtctgcttgtcatag

SEQ ID NO: 36073 - DNA, 396 bp, Glycine max
  Peptide Sequence Number=SeqID_127758
atgtcttcagccagcgatagtagcatctctagcggttctctgagattcctccaaattttttcctctagctgctccgatagaattcctaaacgtcaaagaggcagagaagggattgaagcctccacttgtactgtcaccatgcgatttatttttctccctccacaaatattatctcacaaatcccaactacataataatgaaattcccaacagtgagaatgctcataattgggttgcgaacgtggtgctcaaatttcacaacgaaccaacgatgaacgagtctgagatcgtcgtttttctgagacaggttaggtggcctgcgggaaaaagagagggttttgggagaagagagaagaaacaacattgtgagacagaggaggctgaggagtcagtctga

SEQ ID NO: 36074 - DNA, 399 bp, Glycine max
  Peptide Sequence Number=SeqID_127759
atgcaagagaagattagctctataaagtgctttaaatatcttggaagaggacacattacttctcaatgccctaccaagaaaaccatgattatgaagggccaagaaatttatagtagccaagatgaggctactacttcaccttcctctagtggaagtgaagaagcaaaagaggaagaatctagtgaagaaatctaccccgaagaagaaggacaaccattaatggttaaggaggactggaggagtgtaaggagacaacctccacattttctcctttgtaaaaagacacttgttagcattgtcacacctcttgggcttgagtttattcctcaagtaaaggagttgttggatgagggtttagttcacaagagcttaaatccttgtgctttgttggtgccctaa

SEQ ID NO: 36075 - DNA, 242 bp, Glycine max
  Peptide Sequence Number=SeqID_127760
atggctgcaaaattcatagaggaaacaggactgatatcagttcagcaacaaggagcagattcttggatttggaagcaacattcaagcggtatctatttgaccaatactgcttacaagtttctgatggaggaaataaggggggatccaatggatgggagctttgtgtttctgtggaagcttaagataccaccaaaggcaaagatttttacctggagactcatcaaagaccgcttaccagctaa

SEQ ID NO: 36076 - DNA, 60 bp, Glycine max
  Peptide Sequence Number=SeqID_127761
ggagggtatcttagtaatgtaggatttttcagctcttgtattttagggcaccgagactag

SEQ ID NO: 36077 - DNA, 900 bp, Glycine max
  Peptide Sequence Number=SeqID_127762
atgtcagaggtttatggcatcaatggcgcgatttccgacacctacgcctcaatgatggcgaccatcgaccggatgggtgaagcctatagctgggtggggtatgcggtgctgttggcgctggcgctaaatatctgttacgtcctgctgcgccgcattaccggcatccgcactatcatgctgactggccatatcatgtttcagcaggcggggctgattgcggtctctttcttcatcttcggctactccatgtggacgaccattatttgtaccgcgatactggtctccctgtactggggtatcacctccaacatgatgttcaagccgactcaactggttaccgacggttgcggcttctctatcggccaccaacagcagtttgcctcgtggattgcctataaagtggcgccgtatctggggaaaaaagaggagagcgtcgaagacctcaagctgccgggctggctcaatatcttccacgacaacatcgtctctaccgcgattgtgatgaccattttctttggcgccattctgctctcctttggcatcgacgttgtacaggcgatggcgggcaaaacccactggacggtctatatcctgcagaccggtttctccttcgctgtggctattttcatcattacccagggcgtgcgtatgttcgtcgccgagctgtccgaagcctttaacggcatctctcagcgcctgatccccggcgctgtgctggcgatcgactgcgccgctatctatagcttcgcgccgaatgccgtggtctggggctttatgtggggcaccatcggccaactgattgccgtgggtattctcgtcggcgttggttcctccatcctgatcatcccgggctttatcccaatgttcttctctaacgcgacgattgggcgtctttgctaa

SEQ ID NO: 36078 - DNA, 804 bp, Glycine max
  Peptide Sequence Number=SeqID_127763
atggcgtggcgggcggtggcgacatcggggatcttggcggcgtggaatgtcgggaagctggtcgcggcgcggatttcaccggcgaaatcgagatgcggcgcgtttggccatgccctgaatggggatgacgtcggtcaggcccgggtcggtatcgatatggcccctgatgacattgagataatcgatcaggccgctatccttcaggcgtctggcgatttcgatgccctcggcctgcccggtgccgccctcaagacattcgtcggcggtatagcgcacaccgaggatgaaatcgtcgcccacgcgttcgcgcatcgccctgaagacatcgagacagaagcgcatgcggttttcgagcggaccgccataggggccgtccagttcgttggtcagcggcgagacgaactggtcgatgagatggccataggcttccagctccaccccgtccattccgcctgccttcatgcgttcggcggcgtcggcgaagtccttgatgatacgctcgatatcccagtcctcgatcttcttcggaaaagcccgatgcgccgcttcgcggtgatgggatggcgcaaggatcggcagccagtcgcccttgtcccagcgggtgcgacggccgagatgcgtgagctggatcatgatcgccgcaccctgttcatgcacggcgtcggtcatttcccggatccatgggacgatctcatccttgtaggcgagcaggttgttgaagacgggcgggctgtccctggagacggcggcggaactcggcgtcatcgtgagcgcaacgccgcccttcgccgctccaccgtgtag

SEQ ID NO: 36079 - DNA, 741 bp, Glycine max
  Peptide Sequence Number=SeqID_127764
atgttgggcgtgagtctacacactgtttggactgttgaggcaatagactctgaagaaacgatcaagaagattaaggtgaaagttaagggagtcaatagcttacctagggagttacgcatcattgtgaattttgatgaccaaggccaagcaattggtgaagcacaagccttgcttgcaggatttcttggaacactagcagctgattgcaaattatttcctatggattatgatagatggtctggaccttcaggcgtacctaaagcttattttgatgattgctttgaaacaattttaaagcctcaattttattttaagataaatgaagctggtgcaaaacggtattgcaaattgagtatgggaagaaaatgggctgcaaataggcaaagcttatggaatgaattcaacaatccaaccaaaacaagagatgaaatcataaaaaatgtgccgataggcatagataaagatcaatgggctcgttttgttcattatcgtcataaaccatcaaacattgccccccagaaactgggaagctaccaactcccccgacaattatatattgaaactcataaaaggaaagatggatcatttgtaaatgaagcagcaaagactatagcggaacaaattgaagtaggattgactcaaagcatagttgatgaatctgaagtttctcttcttgatgttgttggtagagtgttagggttagagcactctgggagagtgcgatgcagtgggatcctctag

SEQ ID NO: 36080 - DNA, 484 bp, Glycine max
  Peptide Sequence Number=SeqID_127765
atggctccgaaaaagctttccgtgaagagatctaggagggatgccgcggttgaaaggaccagtgccgcccccgagtttgatagccaccatttcaggagcgctaagcaccagcagcgtttccaggccatcaaagggtggtcgttccacagagagagacgcatccagctcagggacgatgagtacacagattttcaggaggagatagctcaccgacattggatgtcgctggtcactcccacggctaagtttgacccagatatagtcttggagtcttatgctaatgcttggcccacagaagagggagtgcgggacatgcggtcatgggtgaggggtcagtggattccctttgacgcaaatgccctcagccagttcttgggtgacccgctagtgttagaggaaggccaggagtgcgagtttagtcagaggaggaacagagccgatgggttcgatgaagaggccattgcccagctattatgcataccgg

SEQ ID NO: 36081 - DNA, 207 bp, Glycine max
  Peptide Sequence Number=SeqID_127766
atggtgggagcaggtttgaaaaaggatcttagagtgtctagggttgtgccaggagggtctcttaatgccttcctttttcttctcatcggagttattttcacaaagacttgccatggtgcgatgatttactttcacggggcgaggtctctggttcaagtccaggatggcccagctgcgtcaaggaaaagaatagaaaaactgacttga

SEQ ID NO: 36082 - DNA, 102 bp, Glycine max
  Peptide Sequence Number=SeqID_127767
gttctatcaagccaaaatcaagagcttagagtcaccaggtttacgaaaggtggggcaattaatgggtcaacttcaacggccaggccttccgcaaagcctatg

SEQ ID NO: 36083 - DNA, 51 bp, Glycine max
  Peptide Sequence Number=SeqID_127768
atggtcagaagtcaagacgagttgacagcagaagtcaaccaaggtacttag

SEQ ID NO: 36084 - DNA, 537 bp, Glycine max
  Peptide Sequence Number=SeqID_127769
atggccccgaggaagcttgcctcaaagaggtccaggaaggacaaggcggccgaaggaactagttccgctccggagtatgacagtcaccgctttaggagcgctgtacaccagcagcgcttcgaggccatcaagggatggtcgtttctccgggagcgacgcgtccagctcagggacgacgagtatactgatttccaggaggaaatagggcgccggcggtggacatcactggttactcccatggccaagttcgatctagaaatagtccttgagttttatgtcaatgcttggccaacagaggagggcgtgcgtgacatgagatcctgggtaaggggtcagtggatcccgtttgatgccgatgctatcagccagctcctgggatatccgttggtgctagaagagggccaggaatgtgagtatggccagaggaggaaccggtctgatggggagacgagtgcgaatcatgcgcaccaacatgaccatcctgaccgagatatggatgacgttgctcctcagcaacatcctgcccagcgatcataa

SEQ ID NO: 36085 - DNA, 246 bp, Glycine max
  Peptide Sequence Number=SeqID_127770
atgactattgcagatagtattaagacaactcttcctgagaccgataatgctaaagagtttatgaggttagtgagagaacgctctcaaccagctgataagtctcttgctcggacatcaatgagtacactgatcaccatgaaatttgatggttcatgtactatacatggacatgttattgagattacaaacattacaacaagacttgagaccttgggaatgactgcaaatgagaattttcttgtttag

SEQ ID NO: 36086 - DNA, 417 bp, Glycine max
  Peptide Sequence Number=SeqID_127771
atggaccaccacggcaaaataggggaggtgcttgccgcccagctcgcccaggcaagccaggttgcttcctccagaagcaacaaccttctggaggaatcttctggaggcccaattacggaaacttacgaatttcgtaacaatacttgttttctttccgtaatgttatggaaccttatggattacataatcatcccctttttgacttacggaatgttacggaacctcaatagttgtgcaacgatgctccatttgatttccggtgtgtcacggaaccttacggattgtgcatcaatattttcttttgttttccggcatgtcccggaatttcataaattgcctaatgatgggtgccaagcaccttacaaggaccaaacaaaggtcgcatgccatcaagaaaaggtccccgaacgaaattag

SEQ ID NO: 36087 - DNA, 171 bp, Glycine max
  Peptide Sequence Number=SeqID_127772
atggatcagccttggcgaggaaaggaagcttgtttccaactaagcgactccacaaacaagagcttcaaggtcaacgaacatcgacttaagtcattcttcacgaacccttctttagtggacgtagtggtggaagagacatccttactccaccctactcttcctccaccatga

SEQ ID NO: 36088 - DNA, 426 bp, Glycine max
  Peptide Sequence Number=SeqID_127773
atggatgccctacaatatattaaggaagtacaatgtgcatttcatgacagcacagaaaagtttgacaagtttatggatgtcatgaaagattacaaatttcatagaattgatgttgggattgtcgtagaaaaaatggaggagattcttaaagaccacggggatttgattttgggattcaacaagtttttgccaaagggatatgaaatcttacttctagatgagggtgaggatgggtttggaaatgcttcaaaatatttgaagaagattcaggatcgatttgaaaacaaagatcatgtttacaagtcatttctaaatatacttcttaagtacaaaaataatggagtcactctttatgatacataccatgaggacaagcaaaaggttgttacaagtctcaatagatcaaagactaaccaactatgttaa

SEQ ID NO: 36089 - DNA, 135 bp, Glycine max
  Peptide Sequence Number=SeqID_127774
atggaggatagggtaacgattgaccgatcgtcgtcccttcccggcgttggacaagcagagaacgtcgctgcgaggttagctcgcctgggagagctgagctcgcctaggcgagcaacccctgcaccaaaaatataa

SEQ ID NO: 36090 - DNA, 154 bp, Glycine max
  Peptide Sequence Number=SeqID_127775
aactttatggattgcgcaacaatgcttcctttcgacttccggcatgtcgcgaaacttcacggattgcctaacgatgggtgttaagtacctcgaagcggttaagcgaaggttgcatgccaccaaacaatggtccccggacgaaattagggtatga

SEQ ID NO: 36091 - DNA, 446 bp, Glycine max
  Peptide Sequence Number=SeqID_127776
tccaaactcaggagcacaggtcgcttgagcaaatggaccaatggtttgcactcaattctggatttacatgcgattcacctcaaattttagccagcccgcatcaattagaccttgcaccttacgcttcaggcccctacaatgctcaatggaatgccccggggcttctccatgacaaacacacgttgtgttcgagtcgtattctcggagaaatggaggttgatgaaccttggttagggttatggctaccattgaattatcaagtagatatgggagcaaggatggcctttgtggataattgggcggtgggtaaggagaaggttggttattggctgagtaatgacattgttggatccacttcgatcatttcgccggcgaagaccaaatccgcaaagcttgaaggtgccacttgggctgccaggttctccacctttgggcgtattctttga

SEQ ID NO: 36092 - DNA, 699 bp, Glycine max
  Peptide Sequence Number=SeqID_127777
atgctttctcataagagtggacccttgggtactagtaccctctccttcagaggactgcacgtcgtcaccttcagaggactccacatcctcacctttagagggtcatgtaccttcaccttcagaggactacacgtcctcgcctccagaggactacatgtcctcgccttcaaaggactacacgtcctcgccatcagaggactccacgttctcatcttcagaggactgcacgtcctcaactttaaaggactgcacgtcctcgccttcagaggattgcacgtcctcgcctttagaggactgcacgtcctccccttcagagggctgcacgccctcgccttcagagggctgcacgtcctcgcctttagagggctgcacaccctcaccttcagagggctacacgccctcgcctttgtagggctacacgccctcaccttcagaggactacacgtcctcaccgtcggagggctacacgccctcgcctttagtggactacatgccctcgcctttagaggactacacgtcctcgccatcagaggactacacgtcctcgccttcagaggacttcacgttcttacctttagagggctacacaccctcacccttgagaggactacacgtcctcaccttcggagggctacacgccctcgccttcggaggactacatgtcccccttttcagagggctacacgccctcgcctttag

SEQ ID NO: 36093 - DNA, 616 bp, Glycine max
  Peptide Sequence Number=SeqID_127778
atggagaacaaaggccttaacgtctttaactccaaatatgtgctggcgcgtaccgataccgccaccgataaagattatcttgatatcgagcgcgtcatcggccacgagtatttccataactggaccggtaaccgcgtcacctgccgcgactggttccagctgagcctgaaagagggcctgaccgtcttccgtgaccaggagttcagctccgatctggggtctcgtgcggtaaaccgcatcaacaacgtgcgtactatgcgtggcctgcagtttgcggaagatgccagcccaatggcgcacccgatccgcccggataaagtcattgagatgaacaacttctacaccctgacggtgtatgaaaaaggggcggaaattatccgtatgatccataccctgctgggtgaggagaatttccagaaagggatgcagctgtactttgagcgtcatgacggcagtgcggccacctgcgacgactttgtgcaggcgatggaagatgcctccaatgtcgatctctctcatttccgccgctggtacagccaggccggtacgccaattgtgaccgtcaaagacgattacaatccggaaaccgagcagtacacgctgaccatcagtcagc

SEQ ID NO: 36094 - DNA, 195 bp, Glycine max
  Peptide Sequence Number=SeqID_127779
atgagtgaactaccatcaaagagagaaacacgagctggtgacaatggtggttgtcgcaacctacccttcggcgggagggcgacgcggggctcacgggtgcgtgtcccaagaaaggaatacgcgcggagttgccaccaaagtttatttgaggaaaatgtcagaaaaaccggaaaagacgtgatctatgaattctaa

SEQ ID NO: 36095 - DNA, 195 bp, Glycine max
  Peptide Sequence Number=SeqID_127780
atgaagaaacaacaatggaagagaagcggaagacaaaggagaagaggtgagaggaggcgccatccactaaggaataagccatggaagaaggagcttcaccaccaagatgagccttggataagaagtttggagaggatgcttcaatggaggaaaagaaagagggagagaaagagagaggggggagcacgaaattga

SEQ ID NO: 36096 - DNA, 1461 bp, Glycine max
  Peptide Sequence Number=SeqID_127781
ggctgtgggactcctgtggaaggagatgcctttgtgcgcaacaaagagagcggtcagttctttgacccggcaaaactgcacaccctggatcaccgcggtgatttcttccaggtcgccggaccgctgaatattggccgtaccccgcagggacgtccgattgtctttcaggccggcgcgtcggacgacgggaaaaaactggcggcgaaacatgccgacgccattttcacccaccatgaaaccctcgacgaggcaaaagccttttaccgcgacgtgaaacagcagctggaaactcacggccgccgcccgtcggatttgcatatattccagggcgtcagcgtgattgtgggaaaagatgccgatgacgtggaaaaccagtatcaaaccacggcggcgctggtgtcgattaatgatgcccttaattacctcgggcgttatttcgaacatcatgatttcagccagtatccgctcgacgaaccgttcccggatatcggcgacttaggcaaaaacagcttccgcagcaccaccgatgagatcaagcgtaacgcccgcgagcgcaacttaaccctgcgtcaggtggcgctggaagccgcttcgccgcgtccacgcttttccgggcggcacgccggacaccttcccgcgctttgtggaccaggtcgtgccggttctgcaggcacgcggcctgttccgcaccgattacccgggcaccacgctgcgcgaaagcctgggtctggaccaaccgaaaaatcactttacacaacaataaaagagaacaccgctatgcagaaaacatcgcttattctggcgctcgcgctggcctttacccctgccgtctgggcagagaatgtgaacattaacggcaccggcgtgagcatcgaggccaataaaacgccgatcaacaccgccaaaaacggcgatgccatcgcccggttgccgaaagactatcgctttgccgtaccgggaaaatttaccgtggcggtggcggggctcaaccagccgccgctgacggtgttttccgatgacaacaaaacgctgttaggcagcgaggtcgacgttgctcgtctggtggcggacagcctcgggctggagctgaacgtggtgcccacctcgtgggaagactggccgctgggggtcgcctccggcaaatacgatgcggccatcagcaatatcaccgtcaccaaagaacgcaaacagaaatttgattttgccacctaccggaaagactccctcggtttctacgtgaagtccaccagtcctattacctcgctgcagaaggcggaagacatcgccgggctgcggattatcgtgggctccggcaccaaccaggagtccatcctgctggcatggaacgcggaaaacctgaagaaggggctgaaaccctttaccccgatctacaccaaagatgatgcggctcaaaccctggcgctgcagtccgggcgtgcggatgcctactttggtccgaac

SEQ ID NO: 36097 - DNA, 321 bp, Glycine max
  Peptide Sequence Number=SeqID_127782
atgtaccctccactagaactaatccacaagagatgtaccctctcttgttctcagtcaaacccaagtagatgtaccatttacttgtaccacaaaggatgtaccctccaatgtgttaagacaaagatctcaggcgggagaagagagacacaaaaagaattcaggcggttagtccttggcgaattctttttggcaaagggagaagagaatgaaaagatgaataacacaagttttcaaggtttggaaaaccagaaaacttcagaaagcttttggtacaaagaagaagaagaagttcaaagagattcaaggcttgtaaaggattga

SEQ ID NO: 36098 - DNA, 408 bp, Glycine max
  Peptide Sequence Number=SeqID_127783
atgggtaaagcggaggaggtacaagagaagatgaaggccgacatggaggccatgaaagagcaaatggccacgatgatggaggccatgatgatcatgaagaagataatggaagccagtgcagtttcagttgccgctaccagcactgttgctaaggtgaatccgatgcccccatctagcctcaaccaaatgaatcatccaacctcaggtatagtaggaaaagatttgggaagtacgggcgccccccatgatgtgcaaattcaaaacgagcacgccttcccgccatatggctttgcctctcaactatacgccacccaatgtggcgtacactccccaatgagaatgtcaataaccactcctaaacccgttgagagccaacaaccccaaactgatcatgcacatgtctcttaa

SEQ ID NO: 36099 - DNA, 99 bp, Glycine max
  Peptide Sequence Number=SeqID_127784
gtcagtgaccgacaagtcataaggcgtccagctcaagacgttaaagaagcgctactaggaggcgacctagtaccttttaaatttctacctgctatttga

SEQ ID NO: 36100 - DNA, 225 bp, Glycine max
  Peptide Sequence Number=SeqID_127785
atggatcattttcaagttttccttcggtttttccgacgttttcctcaaataaacgttagtggcgactccgtgcgtattcctttcgtggaacacgcatcccgcgagtcacgcgtcgcccgcccgcaaaagggcacgttgcgacaccctctcataactaagctcacctccttgagaaacttccttgagaagctagagcttagctacacacacccatctaaaagctaa

SEQ ID NO: 36101 - DNA, 538 bp, Glycine max
  Peptide Sequence Number=SeqID_127786
cttggctaccccatgagaggagtgccatcagacgaaagcatcacgcctttcatcgcacggggtttcggtgaccacaacgcgagggacaaagagcttaggggaagcagtaatgggatcatcggcgactatcataagtggctgagagtccgaacacaaggattggattggctcccaaatctaaagactgtgagagacgatgaggttaaagcttcggaagaaagtgatgaggtacaagccctaaaggcagagcttgaaagagcccgggtagtcgaagagaagttcaagttcatagccatcaaagtgaaaggaatcatcacgggtcaaaggcatgatcttgaaggacgagctaaagtgcaaagagaagctaaatctagcggcgactcacgagcaaaggctgagaggatgagtacgccaagatatcagcagaaagggaagcaagggaaagggagtcaagaacttcccccattcctagccaaggccaaagcagtggcggacacctactccgcccccgaggagatccacggacttctcagctatt

SEQ ID NO: 36102 - DNA, 150 bp, Glycine max
  Peptide Sequence Number=SeqID_127787
atgtggactcccggaatcatgaggacaaataatttgcgtatgatggttgatgacccagtcaactccatttcaagccatgcaatgattccaatagcaaaaaagtggattgaagcaatgaatgaggagtataagttccatgcaagacaatga

SEQ ID NO: 36103 - DNA, 145 bp, Glycine max
  Peptide Sequence Number=SeqID_127788
agtgcctgtcgcccccagcaaggtcagcaggtctcctactaatcgagctttcatcaagaagtattgcgcccccaggcaggcgcagggagaaacaccacaacagcctggggatggccggcagcagacgcaccaccaccacctctag

SEQ ID NO: 36104 - DNA, 804 bp, Glycine max
  Peptide Sequence Number=SeqID_127789
gtcgactctagaggatcccacactcgaaactggaaggataaacaaacccacccggtggactgccgagctacaagtcccacgacacaggagcgggattctctaaaaagccaaggtcgcgggtggccaagagggcccacttggagacttgggatctcagcaggaaatgcgaaggcttatcttataatagggaatactctaaccctgggaaccggggcctggccaaagtccagggtggctcaaagttcgatcaaggagatccctgtcctggaatactcctccaaggttataaagcccactaggactactaaggaagaggaggaaaaaaaagcttatgatgagcatctatttgagtcgattaatcatcccttgcatcatccttacaccggttctcttgttcccctcatgattattctttgtgttctttcgggcctcgaatccgggtatacgttgcacatgatggatccagcaggaggtcagcctgctgccaatcctgcagcggagcaaccctcaaacgtgccttcaggcgcatcgacctcgggctggagaagtttcgaagaaggtgttttgttagaatcttcaaacgaatccagcgaagcgagcgtgaatcagcagcctgtgattcccgaacttgaacctccgcttctcgatgacaacacccggcgagcagagctcgctgttcgattgagggcgaattggtgggggatcgcttataacgagcgaatcctcgactccttcgtccggagtcaacttgcaatcgaaaggcacatagaggccgcacttgtggcggacggatattccccgcaa

SEQ ID NO: 36105 - DNA, 276 bp, Glycine max
  Peptide Sequence Number=SeqID_127790
atgaatagccaatatatttgcttttatctcatgcctttcttcgttcatggttcgatattctggtgtcctaggcgtagaggaaccacaccaatccatcccgaacttggtggatactccggggaacagatatccagtggagatgacggggtggggcctgtagctcagaggattagagcacgtggctacgaaccacggtgtcgggggttcgaatccctcctcgcccacaaccggccaaaaagggaaggatttttccctctgggggtaggaaaatcatga

SEQ ID NO: 36106 - DNA, 525 bp, Glycine max
  Peptide Sequence Number=SeqID_127791
atgtgttccggtggaggcagcatgctttttttgagaataaatatcattggagagagttccaatgatgaatcctttaataaccacatcagttctaatgttggtagtgataatgagtccaatgttcccaatggtgatttcaccactaccggtggtgttgctactagtggtagcattatttgtccgaacattgaggaggaagaggtcgaatcacctctacctattcctcttcaaaatgtcattgacttggatttggaggccattgttgtgcatgttctagtccttcatcccatcattcatccttctactcttcccccttcaaaacctaaaacgactacaaaggaataccctcccttaacccttatagaagaatcaaacaaggttgtttcaaaggataagcattgcttcaagattaatacaaggttgcttcaacaaacaaagccttgcttcaagattaactcaagatcaagccttgcctcaaaacaaagtgtttccaagacatccaaggctctggtaatcgattactag

SEQ ID NO: 36107 - DNA, 198 bp, Glycine max
  Peptide Sequence Number=SeqID_127792
atgataacaaaagatgatgacaaaggtgatgacaaaaagctcaaagatagaatcaagaacacttcaatattcaagaggaaagttgatttcaagaatcaagaatcaagattcaagagatcaagagttcaagaatcaagattcaagatcaagggaaggcttaatcaagataagtatgaaaaggtttttctcaaaaattga

SEQ ID NO: 36108 - DNA, 288 bp, Glycine max
  Peptide Sequence Number=SeqID_127793
atgggccagacaactaccttaaggggattattaataggtcttgatgatgttccacaacctaaatcaaaggcttctgctaggtggattgtcgtcaagtgtaatagacaaaaaggaagtactgagtgcggctactatgtgatgcactggatgtccaccatcattttaggaacttttaggaataattgggaagcgtattttaacaatcctagaccattggagccagagagattaaaggcattgcggatccagtgggcacagttttatcttcgagttagagatcaggcctag

SEQ ID NO: 36109 - DNA, 315 bp, Glycine max
  Peptide Sequence Number=SeqID_127794
atgatcctcgtgaacctcgtccgactgtcgaggaggctccccttcaagggtgggggaagggacatgacccgcgtcatcacgcatgaccggcggcatttgtatcccaaatgggggttgctgatgtgccccagtgtgctcctttctcgtcctaccgcgttcgggagaggatggtgcgtggtggctgggagagttgggtctgcttcggcagccgaactaacagcggcagcagtcgccacgttattctccataagttgtctcattcctaacatggcctccatcatggaagccatttgctctttcaaagccgacacttag

SEQ ID NO: 36110 - DNA, 483 bp, Glycine max
  Peptide Sequence Number=SeqID_127795
atgcaggaacaatatgttcattatgatgctgaagagatgtttatgcgatgcatgataagaatgcatttacggacacgagagccccgaaaaattatctcttctgacttgcacacttgggggtgcagtgccccatgtttcacaattccacacttccttagaataggcctaactcacaaaaaggtccccagtggagtcgccaactgtcgcaacgtgcccttttgcgggcgagcgaaggcgaggctcacgggtgtgctttccaaaggaggaaagatgcacggagtcgccaccaacgtttatttgtggaaaacgtcggaaaaaccgaaggtcgacaaaagcgagacttttgctcctacgtatcctccatcgaagaggaaatcagacctacgtagttctttcttaagggtgaatcacacgatttctttttactggaaaggtgatcatttaaaggtgttggaccttaaaaatgatccattaacttggtaa

SEQ ID NO: 36111 - DNA, 225 bp, Glycine max
  Peptide Sequence Number=SeqID_127796
atggccctcggcgttcgcttactcgaacccactgaagtaataattactgtgaatttaaaggatactaggctgccatgcagcggcgtttccgcttgtcctaagctgggaagggatgacgatctgtcggtcgtgaccctagcctctatttgcgtccgttccgaagtacctgaaagtaggaaacaacaatgcgtggcaaatcgtgaccgcgtcgtcgtcttaccttga

SEQ ID NO: 36112 - DNA, 216 bp, Glycine max
  Peptide Sequence Number=SeqID_127797
atgggttcaaaaatctaccctaaggttcatgagaaccctagggccttctttagaagctctagcccaagcctcttggagtcttctatccaatacgcttggggggtaggattgcatcacccaagaacaagccttctgaataggcgagcttataggactaatcctcaagagatcaaggagattgaatcccaagttaaggaattgttggagaagggctag

SEQ ID NO: 36113 - DNA, 246 bp, Glycine max
  Peptide Sequence Number=SeqID_127798
atggtcatcattttgcctaaggacaatgttgtcatttggttttgttccttgcacgataggcccgacaactacttgaaaagcattattaacagtgctttaaagggattcaacgacaatcaaggaagtaaattcaaggttgctgctagatgtattgtagttaaatattttgttgatcaaagactattgaaaccagagagaatgaaaggcaatttgcattcaatgggcaatatattatttaaaagttaa

SEQ ID NO: 36114 - DNA, 300 bp, Glycine max
  Peptide Sequence Number=SeqID_127799
atgtcaaatcataaaagcactgagtcagcgctgaagaactttaaggtccagaagaatcccaaggaggaatgcaaagctgtgatgacaagaagtaaaaggtttgtggagaatgaggaagagaagagtgttggactcaagaagaaagctgttgaagagaaaggaattgatggaaggaaaaatgatgtgagaggtgaaaataatcaggaaaaagagaaacaaataatggtcaataaaaaagaattgaatgaccaagaaaaagaaaaagaagtagaaaaagaaaaagaaaataaaaagaattga

SEQ ID NO: 36115 - DNA, 298 bp, Glycine max
  Peptide Sequence Number=SeqID_127800
atgcaagtttcagtagaaaccactcaaggccttgggcgccgtctctctattactgtaccggctgatactatcaagcaggcggtgaagaaagagctgatcaacgcagcgaaaagcgtgcgtatcgacggcttccgcaaaggcaaagtgccgatgaacatcgcggaacagcgttacggcgcctctgttcgtcaggacgtgctgggcgaagcgatgcagcgcagcttcgttgacgcgatcatcaaagaaaagattaatccggccggcgcaccaaactacgtgccgggcgagtacaaagaag

SEQ ID NO: 36116 - DNA, 285 bp, Glycine max
  Peptide Sequence Number=SeqID_127801
tatttacagcacttggttcaccaacaggcagccaaccacagggggcaggtgcagacccatgagtgtctctaccaactcagcctcagtctacagagtcagggtttcgctccttttgcgtgccctactccagatcagtttagggcagaggttgcatggcctggagattggcctgaggcccaggcaggggaggcacccgcagaggctctcgacgatgcagatgaggcccgcatggatgaggagatgacagatttactcgatttcttgggagggagcagagccacatga

SEQ ID NO: 36117 - DNA, 600 bp, Glycine max
  Peptide Sequence Number=SeqID_127802
atggcatcatcggtgttgaaaattatcaacgaggagaactttgaagctccggaagaggatgaagaagtccgacctctaaaaatagaactaggaaaagcaagacttgccaaagaaaaattcaagttagtcgctacagacgtccgtaaagagtgtgtcgagttacgaaaagaaaacgcagctaccgcaagagcccttgaacgagaaaccaagagggctcgcaaggaagagcatggccgagacaaatttcgtggagctttgtggggcagcaacagtgagctcaagcttcgaagggaagagaaagaccaatcacgagcacatagcatggtcttaaaagaggagttagctgcttgctcaaggtccaagagaagcttgtctcagtgtttatgcaagacagagaccaacatgttagccatcatcaataagtaccaagaagaattaaatctagccacggtccacgagcacaaagtggcggacgagtatgctcgggtgtatgcggaaaaggaggctagaggaagggtgatcgactcgttacatcaagaggcaacaatgtggatggaccgatttgctcttactttgaacgggagtcaaaaacttccctga

SEQ ID NO: 36118 - DNA, 252 bp, Glycine max
  Peptide Sequence Number=SeqID_127803
atgtcacgaaaccttatggattacgcaatcgtcccatctttggcttttggaatattacgaaactttatggattatgcattaacacttcctttcgactcccaacatgtcgtggaacttcacggattgcctaacaatgggtgtcaagtacctcgaagtggtcaagcgaaggtcgcatcccaacaaacagatggtgcccggacgaaattagggtatgacaattgcctctctttacttgtcttttattggagataa

SEQ ID NO: 36119 - DNA, 487 bp, Glycine max
  Peptide Sequence Number=SeqID_127804
gaaatggccccaaggaagctgcctcaaagagatccaggaaggataaagcggctgaagaaaccagttccgctcccgaatatgacagccactgttttaggagcgctgagcaccagcagcgcttcgaggccatcaagggatggtcatttctccgggagcgacgcgtccagctcagggacgacgagtataccgacttccaggaggagatagttcaccggcggtgggcatcactggttacccccatggccaagggtcagtggatcccgttcgatgcggatgctctcagtcagttcctgggatatcctttagtgctggaggagggccaggagtgcgagtatggccagaggaggaaccgggccgatgggtttgatgaggaggccatcgcccaattgctgtgtatactagggcaggattttgcccggactgctgctggaagacgggtgcagatcatgcgcaccaacatgaccaccctgactcagatctggatgac

SEQ ID NO: 36120 - DNA, 294 bp, Glycine max
  Peptide Sequence Number=SeqID_127805
atggagcggtattcacagcacttggttcgccagcaggcagccaaccacaaggggcaggtgcagatccatgagtgtctctaccagctcagcctcagtcagcagagccagggctttgctccttttgcatgccctactccagatcagttcagggcggaggtcgcatggcccggagattggcctgaggcccaggcaggggaggcgcctacagaggctcacggcgatgcagaggaggcccgcatagatgaggagatgaaaaatttacttggtttcttaggagggagtggagccacatga

SEQ ID NO: 36121 - DNA, 258 bp, Glycine max
  Peptide Sequence Number=SeqID_127806
atgcgtggagattgctttacaattttcccttctcacccaattttcggagcccagaattgcgttttcgtttatgtgtcctccaccttcgagtttggagctatgcgtagtgattgcttagatcaattctccattctcaccctttttcggagccccatgaattgcgttttggttcacgtgtcctccaccttcaagtttgcagccatgcgtagtgattgcttagtgcaattctcaattctcaatcttttcggagccccatga

SEQ ID NO: 36122 - DNA, 444 bp, Glycine max
  Peptide Sequence Number=SeqID_127807
atggcgaaccatataattagcagcagggacagtggaggaatcaccctggaaaccagttcaacaaaagaccagggtggtccatctaacaagccacaacaacaagggcctagtctctatgatcgaacaatgaagctggaaaagaatcttgctcaattcatgcaagtatctatgtcaaaccctaagagcacagagtccaccatcaagaatctggaagtcctggtgggacagttggaaaaacaattggtagaccatctgtctagtagctttggagctaatactgagaaaaatccaaaggaggaatgtaaagctgtcatgactagaagcagattggtggccatgaaagaaagtgagaatggaataggtgcagataaacaacagctggtgtctaacctagcacttgagcctgtggtagaatttttgagtgagtttgaggaagaattggag

SEQ ID NO: 36123 - DNA, 432 bp, Glycine max
  Peptide Sequence Number=SeqID_127808
atggcagcacagttgatccatgatcgagttgtgatggagtgcctagaaggtgtttgggagaccctcgaaggcaatgagaggtgccgattccgtggcacgattcgactcactgctacttcattagtacatccggaggaacccgcacgcacacttcagcagcctgtggagtggatactacctacacctactccatatcgactagtggagccaattcaagtgatagaggtgtcatcctctgatgaggatcctgaagaggacccagaggagttacctcctgaacctgctgtggatgctcttgacttcccagaggatgatgaggacccactccctgatgttgattctccagaggatatcatgtcagcatctgaggcagactctacagaggagagcggccctggagggacaacgaatagtgaagactattcatcatag

SEQ ID NO: 36124 - DNA, 442 bp, Glycine max
  Peptide Sequence Number=SeqID_127809
atggagttttgcttggctagtccatgtaaaatccaagtttcatctcctacaataattgttgaaagagcagggttctttgcctggacaagcaaaagctggagagtcagagagaaatttgcacgaacagtcacatctgtaattggtctgttttcatctactgagcttccccttcaacgtgctattctttctcctattttgcagttgctgaatgatctgaatcctgctgttagggaagcaactattttgtgtattgaggaaatgtatacacaagctgggtcccaatttcgtgatgaacttcagcgccacaatctcccttcatctttggtgaaagctattaatgctaggctagagggaattcaaccaaatgtttgctcttcagatggtatttctagcggttataatgctggggaaattaagcctgtgggtgttaatcccaagaaaa

SEQ ID NO: 36125 - DNA, 516 bp, Glycine max
  Peptide Sequence Number=SeqID_127810
atgggggagtggtggagacaatttaagtttgatttgacgtcaaaatgggcactcgtagccgacaaggaaagtgtcgatgacactagacccttcatgggaggatgtgtgcgtgctactggagccggtgtcacgatcaagcaatactttggaccggctccaaggacctcccgcacgtcttcctacatggctcccgaagacctggagcagctgacacaacaaattagggaccagctggaggagtcgatcatagaaaaatttcagtcgcagatgcaatcacagggactcgcactgcctcctgagcctgaggttggtccttcagctactcgtgttagcacaaaggagagttatgttaatccattagggaatgatccagacacaggtgactcagacaaatgcgagttgtacattgaagaaaatcatcctcgcctggttgccctaggaagagtttgtgagggatctacaatcgttcacaacattcctttgttacatgatcaagtcaaggttcgtgttgagaag

SEQ ID NO: 36126 - DNA, 189 bp, Glycine max
  Peptide Sequence Number=SeqID_127811
atgaagaatattccagattcgggagttatctttacgtttgaggaaggtcgacaaaagcggggctcttgctcctatgtaccctccatcgaagaggaaattcaaacctacgtagttctttcaaaggggcgaatcaagcgattcttttttacttggaaggtggtccttttaaggcgttggaccttaaaatga

SEQ ID NO: 36127 - DNA, 570 bp, Glycine max
  Peptide Sequence Number=SeqID_127812
atggtcattgaccaatccctcttctatgatttgactcaattgtccagcgaaggtgtaccatttgaaggtacactagatgatgattggaaatttgatttttctatgcatgatgcccgccggttggtttgcaccaaccaagcggatatgaccggaaggctgcttgccggttctttggcttctgaaagccgcatccttcactatcttattgttcgtatcttactcctaagatcttcaaaccttgcacaagtttctgaagaagatcttatagttatgtgggcctttcatacctaccgacaaattggttgggcacatttagtccaatctttcttgatcggtgctgctgtggttgcgtcctttggttactgcaaagagcgtgatggctcttgggtaaaaaagggtgctcaaccaaatgatgataaaggacaattaccagttgaaggggactcttctctccttcaaagtattttggacaagttcgatggacttcaaacctatgttggtgagaggtttgatgctttggaacgacaagtggacatgcgattcgatgcaatggactcaaggatcacaaag

SEQ ID NO: 36128 - DNA, 647 bp, Glycine max
  Peptide Sequence Number=SeqID_127813
atggctacctcaccaaaagctactgcatctcctggttcaccctctgtaccatcatctccatcatccaccaaagcaccatcaaaccaggaacaacctgaattccatatccaacccatacaaatgattcctggtcaagcccctgttcctgagaaactggttcccaaaagacaacagggagtgaagacttctgaaaaccctagccttgcaacaagtcctagggaagtagacacggagatggataagaagatccgcagtattgtgagtaacattctgaaaaatgcttctgtgcctgatgctgatgaagatgttccaacatcttccaccccgaatgtttctgtgcctgatgctgatgaagatgttccaacatcttccaccccgaatgtttctgtccctgatgctgataaagatgctccaacatcttccaccccaaatgctgaagtcctctcttcttccagcaaagagagatcaacagaggaagaggatcaagccacagagaagacccctgcaccacgggcaccagaacctgctccaggtgacctcattgaccttgaagaagtagaatctgatgaggaacccattgccaacaagttggcacctggcattgcagaaagattacaaagcagaaaggggaaaaccccaattactag

SEQ ID NO: 36129 - DNA, 474 bp, Glycine max
  Peptide Sequence Number=SeqID_127814
atggctctgagaaagctttccgcaaagagatctaggaaggacgccgcggctgaagggactagtgccgctcccgagttcgacaaccatcgtttcaggagcactgagcaccagcaacgtttcgaggccatcaagggatggtcattccaccgagagagacgtgtccagctcagggacgatgagtacacagatttccaggaagagatagctcaccagcattggacgtcgctggtcactcccatggccaagtgtcgcaacatgcccttttgcgggcgagcgaggcgaggctcacaggtgcgctttccaaaggaggaaagatgcgcggagtcgccaccaacgtttatttgtggaaaacgtcggaaaaaccgaaggaaaccggtcaaaacgaaatttctaagtttgggagttgtatttacgtttgaggaaggtattagcacctctcacgtttgtctcaaaggacaacaacctattttttag

SEQ ID NO: 36130 - DNA, 136 bp, Glycine max
  Peptide Sequence Number=SeqID_127815
atgggtaaggactggggtcctagcactgctgatgtagggtatactggtagaagctctcattcaactgcacttggcccctatggttcgtcgcctgctggtcagccaaatgctgcatgtagagttccatcctttgcat

SEQ ID NO: 36131 - DNA, 279 bp, Glycine max
  Peptide Sequence Number=SeqID_127816
atgagtgcttctagtcctagtcaagctaaagaacaagatgatgataccaaacctttatggacctatgttacaaagataaaaaaagtgagggcacacttattgaagatgacaagaaagagagttagagtttgtcaaaaggtaacagttgccaaacttatagatttgaagaagatagacaatgaggctacattgagggtggagaggtcaaaaacaaaatctgtgtcattgcctccgggttctactcaacaccaaatggatacaaacactcttggtggttga

SEQ ID NO: 36132 - DNA, 237 bp, Glycine max
  Peptide Sequence Number=SeqID_127817
gccaaggttcaaagaggtctaaggttgtgtctcaatgggatcttttatcatgggaaccccaatcttgatatctggggcgagacaaatttgggtgtcaagggggaggtcggaattatggtcgctgggcaggatgttgctgagcagcaaagtcatccatatctgagtcagggtggtcatgttggtgcgcatgatccgcacccgtctcccggcagcagtccggggcaaaatcttgctccg

SEQ ID NO: 36133 - DNA, 496 bp, Glycine max
  Peptide Sequence Number=SeqID_127818
ggatcgcgcctacaagacgcccagtggacccgaagaagtccaacagggccctggggtttccagctctggttacgggcctctgtctgtcctacagggtgcccgtcccccagcgaggtcatgccatcgtgacatagggatcgcgcccacaaagacacccagtggacctggagaagtccaacagggccctggggtttccaactctggttacgggcctctggatcgcgcccacaaaggcacccagtggacccggagaagtatagcagggtcttggagttgtcaagctctaattatgggtctctgtcagttctacggagtgcctgtcacctccagcaagggcatcaggccccctactaatcgagctttcatcaagaagtactgcgtccccaggcaggcacagggcgaaataccacagcagcctggggatgaccggcagcgggcaacagacacaccgccatcacctctagagttcacctcagctcatccacaaaaaggttag

SEQ ID NO: 36134 - DNA, 267 bp, Glycine max
  Peptide Sequence Number=SeqID_127819
atggtgagtcaggattttggctcaaggcttgtagaatggctagacatgatacatgtcagggtttggtttggttcaaggataaaaagggatgccccacattatttccatgacacaaatgcaaaaatgatgatttggaaattttatgcaaaactggtcgtgcatgcacctatgcggacactcaagtgtcaaatttttatgaggtatttgcaacaagtcaccgacgcacaggattttggtggtaatagcaaagggagaagaccactttag

SEQ ID NO: 36135 - DNA, 240 bp, Glycine max
  Peptide Sequence Number=SeqID_127820
atgatgacaaaggtgatgacaaaaagctcaaaggtcaatcaaagaatgagttcaagattcaagaggaaagttgatttcaagaatcaagaatcaagattcaagagatcaagaatcaagattcaagagatcaagattcaagactcaagattcatgaaaaagcttaatcaagataagtatgaaaagtgcctttcaacgttgaaattcaaattcaaatgtgaagagtcacatcctttcacataa

SEQ ID NO: 36136 - DNA, 141 bp, Glycine max
  Peptide Sequence Number=SeqID_127821
atgcggagatacccaagtggttatccgtacaaacggtttttcttaatccttacccgtgaagtaaggcgaagaatcccaagtggatatccgtataaacactcttttgctatccgtcagactcagagtccggtagcatgttga

SEQ ID NO: 36137 - DNA, 285 bp, Glycine max
  Peptide Sequence Number=SeqID_127822
atgataacaaaagatgatgacaaaggtgatgacaaaaagctcaaaggtcaatcaaagaatgagttcaagatattcaagatagaatcaagaacacttcaagtttcaaaaggaaagttgatttcaagaatcaagaatcaagattcaagagatcaagattcaagactcaagatagattcaagaatcaagagaaggcttaatcaagctgtcaatcgattctcacaatgttttggtaatcgattaccagtgcctttgaacgttgaaagctttcaaattcatgacatgtag

SEQ ID NO: 36138 - DNA, 270 bp, Glycine max
  Peptide Sequence Number=SeqID_127823
atgacacagtctgagaattcttttgattgttccccattccctaatacaaaaagtgttcaaagcctgagatctttgtctcaacacattggagggtacatcctttgtggtacaagtagagggtacatctacttgggtttgactaagaacaagagagggtacatctcttgtggatcagttctagtggaaggtacatccactaggttcaaagagaacaaaggagggtacatcccttgtggatctttgcttgtaaaaggatttttacaagattga

SEQ ID NO: 36139 - DNA, 441 bp, Glycine max
  Peptide Sequence Number=SeqID_127824
atgggaaagcgcagaaagttgaatatcattcagaatgatggtcaatcacaagcaaaagagcaatcaattgaaagctctactgaagtgaaccaaaataacaactctatacttgaagaaaatgcacaatttgaaggagaacaacacataccagaagatagtcatgttcagtctcatacttctcttgaaagtgcaagtgaaagttcaactaaaggtaaaaagagaaccaggggttatacacatatgctagatgtgtgggacttgccagatggagaattcatacttgttgaagtagatcattggggcaatcctatgggttgggaaggaaaaactttgaatgtaattaggagcttggtaaggagacaccaatgtgctcctatcaattttcttagctggaaagacatgcctaaggactatattactgacatggttgaattaattcag

SEQ ID NO: 36140 - DNA, 783 bp, Glycine max
  Peptide Sequence Number=SeqID_127825
atgcagtcccagtttcagtcagagatgcaatcacatggacttgcactgcctctggagcctgaggttggtccctcagctgctcgtgttagcacaaaggagagttatgttgatccctcagggaatgatccagacatgggtgactcagacaaatgcgggttgtacatcgaacaaaatcctccccacctagttgccctaggaagagtttatgagggatccacaaccattcacaacatccctttattgcatgatcaagtcaaggttggtgttgaggaggttaaacatgcagatgctcccattcctgtacccactaacgagggagttgtgggacccgcaaaacttgcagataggtcagatcatgaggtcgatgatcccctatatttgatgacattgaccatcccacaactttttttgaagcctttccaagttatgtgggatgctaccgtgttcagggtgtttaatgaagacttcccgctatacataaagcacgaagatctgtctgaaattgcacacggtggtcaatgtctcaacatatctgttatacaattgtggattctgcatctgactgagacaagtattcgagcggggaattctgatgtgtatggattcctcgagccacatgctttgaaaggacttgatgatactccacaacctaaatccaaggctggtgctaggtggattgttgtcatatgtaatagacaaaaaggaaacactgagtgtggctattacgtgatgcattggatgtccactatgatcttaggaagtttcaggaataattgggaaacg

SEQ ID NO: 36141 - DNA, 384 bp, Glycine max
  Peptide Sequence Number=SeqID_127826
atgttaagggttggtggttggtgggaacctagaaaagaggctatgtgggattctttcctaggtaaagaggtcctgaaatctaagtatggcgggtggcaaaaccttggcctaaataatcctacctataagtcttcttgttggtggaaagatttaggtaaagttgttgggaccttggctcgtggtggttggtttgatgttcatacaaggagttcttgtggtgaagatcacactttgagtggggaaaagtgttatataatgagtttgtggatgctctctctaatgtctcgcttaagaggcatcaacatgatcgcttattatgggatcttgatgcctcaagctctttctcagtggcctccacctattggttccttcttcaacccctag

SEQ ID NO: 36142 - DNA, 207 bp, Glycine max
  Peptide Sequence Number=SeqID_127827
atgttgagcttagctcatcagtgggctaagcgcgcatccaccgctcagcgcagcttctgcgcgcttagcacaacagaagaatctggcagggcatcaacatcaaggttgcgcgctaagcgcaagatcagtgcgctaagcgtagcaattgtcttcagccaggctcaatgcatgattggcgctaagctcaaatcctcttactcgcgttga

SEQ ID NO: 36143 - DNA, 342 bp, Glycine max
  Peptide Sequence Number=SeqID_127828
atgacattaggaaagcatcatcctcatgtagaacaactctccactggaaaggggcacccaaatcagcctgccaatagtatttccttgtttccttggtttccagcatctttttcatgcatcataaacaaatttggacacatattcagcataagtaagatctcgtccatgatgccagtactgtgccaatttcttgactatctttccaataaacaggctgttgattttctaggtggaaataaagatgttcaactgccagtgcacgcccatgcattgggaatgcaaaaatcttccaacatgcttcaggagccgacacatacctggagaatgaaaaataaaatatga

SEQ ID NO: 36144 - DNA, 255 bp, Glycine max
  Peptide Sequence Number=SeqID_127829
atgaaggacaagagggatgaggaaaagatagaaaaacaaaagaaaaaaatggacagtaaggccttagctccaaaagtcaaggagaaggaaaaagagggaaggtgttcctataagaaatttgtaaaaaaggagagtcattttgcaacaaaaggagatattaagagagctcttcttctcaagcaatctttctaccttctcctttcaagggagacttcccttagcactgccacaattctcccacttgagacctattag

SEQ ID NO: 36145 - DNA, 321 bp, Glycine max
  Peptide Sequence Number=SeqID_127830
atgcacttgccggttaaaccacttccgcataaaacaagtaattacaaattttggaaaaaggaactgtggaagggggtcaacaatgtttgcatgcgtagatcttctgtaggtgaattggttccattggatctagaaattgaagccacctttagaaggaacaacgcagagagaaaaagaaagcttttgcacgacagaacaatagcatcaatccttgaagaggatcacttttctgagtcatcatcttctaattcacctacatccagggaatctcaaacagaagaatttgaagtcgaagtcatggctgaagagcaacctcaatga

SEQ ID NO: 36146 - DNA, 627 bp, Glycine max
  Peptide Sequence Number=SeqID_127831
ggaggaataaccatacccaaagaacgcttgattgagaagtcggggaatgttgcagcttgcaagaaaactccaccaaatgcagtcgaagagctgaaggaatatatggttaacaaaaaaagtggaaccacttacaatagttctggcagtggtaatatggcaaatataagatattttgaatttggtgaaccaattggatgtgatggaagtgaagatgagtttgcagactcttgtaatgctactgcaaagacaaagtgtgggactaaaaagggagcaatggacaaattttgtaagaatccaaaaaatgcaattaatcggagaaaaatggagatgttgaggcaaatgaacataagagagtcaatggataagaatgaagtattgaaggtgcatcaatatattgctcgcttttggtaccaagcaggtttgtcattcaatctcattaaattgaaaagctttgagaatatggttgtagtcattggccaatatgggccatatttgcccattcctagctattatgacatcagagttccactcttgaaaaaggaagttgaatatactaaaaatttgatgaaaggccacagagcaatgggtcaagtatggttgtactattatgttcgatgcatggactga

SEQ ID NO: 36147 - DNA, 258 bp, Glycine max
  Peptide Sequence Number=SeqID_127832
atggtggatgcgcttgccactttagcgtccatgttccagctgacaccgcacggagacctaccgtacattgagttcaggtgtcgtggcagactcgcacagtattgtctggtggaagaagagcgggacggtctaggatcttcttcatcaatggattcctttgcttcttggaagatgaatggcagcggaatggagaaggaagagagagaggagacgccacttcaaggagaagatgagtctagaagaagctcaccaccatag

SEQ ID NO: 36148 - DNA, 704 bp, Glycine max
  Peptide Sequence Number=SeqID_127833
atgcccaaaagcacgttggagaaattgccgtttaatgcttcccatctaaagccaagttccatggtggtccgtgccttcgacggcacccgccaagagctgtcttttgggacgcccgtggatccacttgatggagggcatttggttattgtgtcgggggaggaagacatcttggtaagttgcccgacctctatgccatatgtggaagccacggaggagtcattagaaacaaccttccaatcttttgaggtagtaagcattgcctccgtagattccttttctgggcaaccatgcctgttcgatacggcaatgatggtggcctgggtgatgctggggaatggttacgagcccgaaatgggtttaggtaggaacaacggcggcagaaccagcctaataagcacccgaggaaatcatgggaagtttggattaggctataaacccatgcaagcggacataaggaaaagtgtcgcaggaaggaagagcggaagccaaggttcgcaattgggacgagaagtcgaagggggcccgccctgccacatcagtaggagctttataagcatgggtctaggacacgaaggccaagtcgttccgatatgcaagaatgactctccgagtgggtcggttttagtacgaccatgccctcctggtttccgactaggaaattggcgagtggaggagcgcccagacatttacgcgacgagcataat

SEQ ID NO: 36149 - DNA, 159 bp, Glycine max
  Peptide Sequence Number=SeqID_127834
atgcggaggaactcgcctgcctactctagagatacttctttcttgccacaaccatcctttttcttcggaagaccttttactggaacatcctcggggtgcaaacacgcgaccgctgcgggtcacgccgctcagcctcgtgatattggttaccttggctga

SEQ ID NO: 36150 - DNA, 234 bp, Glycine max
  Peptide Sequence Number=SeqID_127835
atgccacccgtgttcggggtcgttaatccagatttccccctgtacataaagcacgaagacttctccgaaatcgcacacggtggtcaatgtctcagcatatcagtgttacagttgtggattctgcatctcactgaaacatgtatgcgagcggggaattctgatatctatggattcctcgagcctcagtccattcagaagattcagatgatgaagaagacttctcactctttgtga

SEQ ID NO: 36151 - DNA, 273 bp, Glycine max
  Peptide Sequence Number=SeqID_127836
atggctctaaaggaaagatcattggaaatgggaaagctagttcatgatggacttcctagtctgaacaaaagtactgctggtgaagggactgactgcaaacctgatcagcatcagtcagttgtgcctgaggtcgactctagaggatccccagtgattctgacagagataactatgcatcaaagtgagaagattcttcagcaagaagcacaactgaagaaggtcattgcagatctggaggctgagaagaaggcacataaagaggagagagcttaa

SEQ ID NO: 36152 - DNA, 255 bp, Glycine max
  Peptide Sequence Number=SeqID_127837
atgccacccagctcgcccaggcgagctaggttgcttcctccagaaggcaccagaccaagtgggtctgaactttacgaattccgtaacgatacttgttttccttccgtaatgttatggaaccttacggattacgtaatcaccccttttttggctttcggaatgttacggaacctcacggattgtgtaacaatgcttccttttgatttccggcatgttacggaacttcacggatcgtgcaacaatgctctcttttga

SEQ ID NO: 36153 - DNA, 219 bp, Glycine max
  Peptide Sequence Number=SeqID_127838
gtcgactctagagggatcccacgacaaccaaaggtaacggctattacaaaatcaagagatcttactaacatgtctcttgcaactttgtttggaaagcttcagaaacatgaaatggaactcataagactaaatcaacatgagaaaaatgacaagaaaaagaaaggaatgcacttaaggcttcatcttcaattcaagaagcaagtgataaaggagatttga

SEQ ID NO: 36154 - DNA, 645 bp, Glycine max
  Peptide Sequence Number=SeqID_127839
atgggtaaagcttgggcagcagtagaagagctgagaatgtttcttgtggctgattcgttggaagaggtgaatagaaaactggacaagttctacatggtccttatcttgaggagtctacactcagattttgatcatgtatgtgatcaggtcctagctggagatcaagtcccatcgatgtattttctcattactaggcttctccgtgtacctcatgcgttgaaggatgaaaatctcactgatgctgtggaaacatcagccatggtggcacctcgtgggagagggggaggtcgtaatagtaaaggaggccgcgatggaagaagtggatgtcctcaatgcacatattgcaagaggatgggccacactcaagaaaattgttactctttgcatggcttccctgacaaagtggcacaggtatccgagtcagaaaaatctgagtctaatttttttgatgaggaataccaagagtatttgaagctcaagtccgagaaattcagcaatcaagcatcatcttcatcagtaccatgtttctcaacagcatgtgtttctaaatcaatcagaagtcctagcccttggatacttgactcaggtgcctctgatcatatctctggaacatgggatgggtcgactgattggaaaaagacatga

SEQ ID NO: 36155 - DNA, 504 bp, Glycine max
  Peptide Sequence Number=SeqID_127840
atgacggaagggtgtggtgaagggttttgccttgcaaaccttcccggtgatgcttttagtctatgggggaacttctttgaggcaaagaaacaaatgatggctgatgccaagtttgcggggctgcttggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 36156 - DNA, 567 bp, Glycine max
  Peptide Sequence Number=SeqID_127841
atggagaggagtatgattgatgctgccagtggtggagctcttggtgatatgacccctgctgaagctaggaatttgattgggaagatggcttccaactcccaacaattcagtgcaagaaataatgctattgttcttagaggattccatgaggtggccacggattcatcttcatctactgaaaataaaaagcttgaaggaaaacttgatgcattggtcaacctaatcaccatacagatctatatccttctttgcagcaatctggagtcaatgagcaacctgaagcttatgctgcaaacatttataatagacctcctcagtagcaaaaccaacaacaacagaataattatgacatttcaagcaatagatacaatccaggttaaaggaatcatccaaatcttagatggacaagtcctccacaaacaacgacagcctgtccctcatttccagaatgttgttggtccaagcaagccatatgttcctcctccaatacagcaacaacagcaacagtcacaacaaagacaaccagcaactgaggctcctcctcaacctttccttagaaagagttag

SEQ ID NO: 36157 - DNA, 669 bp, Glycine max
  Peptide Sequence Number=SeqID_127842
atggcaaaagcaaatgtaaaagaccttttagaggctggtgtacacttcggtcacatgactagaaagtggaatccaaatatggctccatacatttttatggagaaaaatgctactaagaagcaagcaaaagaagttgttgctaagcacgcttcagaacttaatatgccttatattacagaaagatggccaggaggaatgttaacaaactttgttacaatcagaaaggctgttaagaaaatgaactctatcgataaaatgaaaaaagatggaacgttcgaaactttatctaaaaaagagagacttcaggtagacagacaaagagctaaccttgagaagaacttaggttctatctctgacatggttcgtcttccttctgcaatatttgttgttgatatcttaagagagcacatcgctgtaactgaagctaaaaaattaggtattccagttttcggtatcgtagataccaactctgatcctagaaaagtagatttcgttattcctggaaatgatgatgcttctaagtctatcgatatgatcttaaatgttgtttctgattctatcagagaaggtcaatctcagagaaaagctgacaaagaaaaatctaaagaagaaggagaaaaagtatctgctgatacagatgctgatttcgatgcagaggggatcctctag

SEQ ID NO: 36158 - DNA, 320 bp, Glycine max
  Peptide Sequence Number=SeqID_127843
gtgattcggccgcccatcacccgggcttttattgagaagtactgtacccagagacaggctcagggtgatgccccacaggccgcaggcgcgccaccaccacctcatcaggctggccaggttggggcatttgacatagagcagtatttacggcatttggttcgccagcaggcggccaaccaccgagcacatcatggcccggagattggcccgaggcccaagcaggagaggcgcccccggaagcttcccggcgatggagaagaagcccacgaggatgaggagatggccgatttgcttgacttcttgggagggagtggagacac

SEQ ID NO: 36159 - DNA, 330 bp, Glycine max
  Peptide Sequence Number=SeqID_127844
atgtacggaacctcacttaaatatgcaacgatgctccaagcactcacgaattgcctaatgatgggtgccaagcacctcacgaggaccaaagaatggtcgcacgtcatcgagcaaaggttcccggacgaaattaggcaaaataggggaggtggttgccgcccagctcgcccaggcgagctcagctcgcccaggcgagctcagctcgcccaggcgagctcagctcgcccaggcgagcagggttgcttcctccagaagcaaccgccttctggaggaatctttctggagggcccaaatgggcctgggtgctatttgcacccccatttttactaa

SEQ ID NO: 36160 - DNA, 168 bp, Glycine max
  Peptide Sequence Number=SeqID_127845
atggaacaggtaagattcactcaatttggagtgcttcttcgtccaatagctcttaaggtggttggccccttgcttctggactcaaattcttcaagggatggcaccaatcctccttccaattccctatatggcaacccacaaacaaggaaacaaagagacaagcaataa

SEQ ID NO: 36161 - DNA, 162 bp, Glycine max
  Peptide Sequence Number=SeqID_127846
atggcagcgcagttaatccatgatcgtgttgtgatggggtgcctagagggtgtttgggagaccctcgaaggcaatgagatgtgccgattccgtggcacgattcgaatcactgctacttcattagtacatccgaaggaaccctcacgcacactccagcagcct

SEQ ID NO: 36162 - DNA, 510 bp, Glycine max
  Peptide Sequence Number=SeqID_127847
atgagtactagtacccttaacttcagaggactacacgtcctcaccttcaaagggctacatgtcctcgccttcagagggccacacgtccttgccttcagagggctacacaccctcgctttcagaggacaacacgccctcaccttcagagggctacacgccttcgccttcagagggctgcacgccctcgcctttagaggactacacgtcctcaccttaagagggctacacgccctagcctttaaaggactacatgtcctccccttcagaggactacacgccctcgcctttagaggactacacgtcctcgccttcagaggactacacatcctcaccttcagagggctacacgccctcaccttcagaggactacacgtcctcaccttcagagggctacacgccctcgccttcataggactacacgtcctcaccttccgaggactacatgtcctcgccttcagaggactacacgtccttaccttcagacgactacacgtcttctccttcagatga

SEQ ID NO: 36163 - DNA, 441 bp, Glycine max
  Peptide Sequence Number=SeqID_127848
atgagtggaaagggattgcagcatgttcgaaaatcactttctcaatatcagcgtcttagagcatgtttggaaatcaaatgggataccaattgggaaagagggtttctaaactcaaaaacatcgacatccttaccttcaggaacactcgaaaggtggcaacgccactcaaaaaggcacgacttcggctacgtggcagtggtgggagcagcaggtccacttcagcttcaagtacttcatggcgggaaacaaaacgtcaaggtggtagcgggacggagttcacgacgggatgaagtagttcaggcaatagcgggggcgctaggtttttggagggacagtgtacctacaagcactgtctttgatgacttccatcaaaactacaacgacggggttatagacaaatgtcgttgtacaacaaacgcgccacataaaaaacttatataa

SEQ ID NO: 36164 - DNA, 69 bp, Glycine max
  Peptide Sequence Number=SeqID_127849
gaatacgtaggagtgatcgaggccgtacccgaatcaaataaacatgaaaatgcagtaactaggaagtga

SEQ ID NO: 36165 - DNA, 588 bp, Glycine max
  Peptide Sequence Number=SeqID_127850
atggacacaatgatggaggccatgatgagcatgaagaagataatggaagccaatgcggttgcagttgccgctaccagcgctgttgctaaggtgaacccgacgtccccatctggcatcaaccaaatgaatcatccaacctcagatatggtaggcaaagatttgggaagtacgagcggcccttattatgtgaaaattcaaaacaagcacgccttcccgccatatggcttgcctcccaactatacaccacccaatgtggcgtacactcctaaagaggaaacacatgaaattccccaccacaatctagcggactttgagccttgcctcggatatgccactgaagggcaagcagttggtggtatacccatgccaaacactttgaagggccctcagtttcgcccacaaccacaacccttgcattttgcggtgggaagatcccctcctgctatggctgaaaagggaaagttggatcatatagagaaaaggctcaaggacattgaaggaggcgaagattatgcctttgctaacctcgaagaattgttcctagtacccgaacatggtcattcccaagttcaaggtgccggactttga

SEQ ID NO: 36166 - DNA, 210 bp, Glycine max
  Peptide Sequence Number=SeqID_127851
atgagacctgatgaggttgttcctcttgagccaattgtgccaactatacatgagattgttgaagcaggtagcagatcctcctacaccagtacgggagagacaagcaaatcctcctacacctatgatggagatgccagaagaccctaccatgccaatcctaagactttcatccactccttcaattaccccagttctacatctgacagatga

SEQ ID NO: 36167 - DNA, 519 bp, Glycine max
  Peptide Sequence Number=SeqID_127852
atggccaagttcgaccccgagatagtcctagaattctatgctaatgcctggcccacggaggagggagttcgggacatgcgctcgtgggtgaggggtcagtggattccctttgacccagatgccctcagccagttcctgggcgacccgctagttttggaggaaggccagcagtgtgagttcagccataggagggacatggccgacgatttcgatgaggaaaccatcgcccagctgttgtgcataccgtgtatggcgcctactaggcaccctctggagccagataagtctaacagggccttggggtttttggtgctgattatgggcctctgccagtcctacggagttcccgtcacctccagtaaggccacaggcgcaccgccaccaccttggcaggttgacccagctgggccactgggcgtggagcattatctacagcatttggtttgccagcaggcggccaaccaccatgggcaagtgcagatacatgagtgtctctaccggttctgcctcggtcagtag

SEQ ID NO: 36168 - DNA, 130 bp, Glycine max
  Peptide Sequence Number=SeqID_127853
atggcgagaatagccaaagtagtcaaaatctcggcgcaagaattggaccaagtaaagcaaaatagaaatggggtagtcagaattccgaggaagcacttggaggagaaagcgaaggctttggaggatcaag

SEQ ID NO: 36169 - DNA, 477 bp, Glycine max
  Peptide Sequence Number=SeqID_127854
atggtggagctgagcgggatcgaaccgctgaccccctgcttgcaaaagcaggtgctctcccagctgagctacagccccatccagctcgatcacccaggtctcatcaaccaggcgcggcaacaattcgcatcaaccaacagtctcaacccaaaccctcattcgcatatgcaaatggtgggcccgggaagacttgaaacttccgaccccacgcttatcaagccacgggaaggttcatcctgttctagacaggcgtcttaccaattccacagcttccttagaaaggaggtgatccagccgcaggttcccctacggctaccttgttacgacttcaccccagtcgctgaccctaccgtggttagctgcctccttgcggttagcgcactaccttcgggtaaaaccaactcccatggtgtgacgggcggtgtgtacaaggcccgggaacgtattcaccgcagcatgctgatctgcgattactag

SEQ ID NO: 36170 - DNA, 291 bp, Glycine max
  Peptide Sequence Number=SeqID_127855
atgtttgcattcaacaatgctttgaaaggacttaacgatactccacaacctaaatccaaggatggtgctaggtggattattgttaaatgtaatagacaaaaaggaagcactgagtgtgggtattacgtgatgcactggatgtcagcaataatcttaggaagtttcaagaataattgggaaatgcggaaagtaaaaagtagggaagaaggaaacaaacacacaagagtttttatactggttcagcaacaacccgtgcctacatccagtccccaagtgacctgcggtccttga

SEQ ID NO: 36171 - DNA, 174 bp, Glycine max
  Peptide Sequence Number=SeqID_127856
atggcttacgaacggggcggagatttcctggaagatgccaggaagatacttaacagggaagactataaagataccagcgtttccccctggcggctccctcgtgcgctctctggtcctgcctttcggttaacggggcattccgctgttatggccgcgttgctcattcacgcctga

SEQ ID NO: 36172 - DNA, 174 bp, Glycine max
  Peptide Sequence Number=SeqID_127857
atgggggtgcaaatagcaaccaggcccatttgggccctccagaagattcctccagaaggcggggaggaatgcaagaagaaaaagatcccccagccctttaggaatctcgcaaaggttttcaaccgttcttcgacgttctccattcgttcttcatcgttcttcgatcttcaacgg

SEQ ID NO: 36173 - DNA, 189 bp, Glycine max
  Peptide Sequence Number=SeqID_127858
atggctctgtgggttaagctcacccaaagaggtgaagaatacttggattgtctctcccattaccaagtgggtgttgtggttgagtgggtgatctccaagcaaagatcaagttttgatgatgccaaaagtttacttgatgagaacagattgaaccaagtcaaagaacaagatcaagaaaatctaagataa

SEQ ID NO: 36174 - DNA, 297 bp, Glycine max
  Peptide Sequence Number=SeqID_127859
atggagttttcacctcaaattgaaatgacacattttatagttagtgatatcgtagcgacgaggcgggtcgttacaatggtaaccccaattatttgtggtggcggtgatgattgtgcacttttgattttgtcaactccagcggaagataaaaggagaagaggtgagaggaggcaccatccactaaagaataagccatggaaggagaagcttcaccaccaagagagtgacttggataagaagcttagagaggaagctttaatggaggaagagaatgagggaggggggcatgggaattga

SEQ ID NO: 36175 - DNA, 204 bp, Glycine max
  Peptide Sequence Number=SeqID_127860
atgccaatctccccctacagatgtatcaattgggatcgcgcccacaagacgcccagtggacccgaacgaagtccaaacagggccttaggggtttccagctctgggttacgggccttctgtcagtcctacaggggtgcccgtccccccagaatcgcacccacaaagacaccaagtggacccggagaagtccaacagggccctggg

SEQ ID NO: 36176 - DNA, 179 bp, Glycine max
  Peptide Sequence Number=SeqID_127861
atgttcaacccctcctggtatctgagaatcaccttaaaattagtgagaaaaattgtttcccgtgaagaaaatccaagccgaggcgcttccgtaacgcttccgagacgtttccgtgggcgatttcacgaggattttccaccgttcttcatcgttcttcgtcgttcttcggttttcaaccg

SEQ ID NO: 36177 - DNA, 312 bp, Glycine max
  Peptide Sequence Number=SeqID_127862
atggttgaagacccaagaagagtaaccctggaggattattcaagttctactgtgccacaatttttcactagtattgcacagccagaagttcaagctcaatctgttgaagatacagtcatggcttccactttgaactcgtgtctctgcagatcttcacacagcaaaatctctcagaactctctggaacttggacctttctctctctctagaaccttcatgcatgcagagcttctcaagaaaggtgccaaactcccttcacaaaatctgatttcaggcttaaataggtggccatgtttgtgctcgtgcgcttag

SEQ ID NO: 36178 - DNA, 366 bp, Glycine max
  Peptide Sequence Number=SeqID_127863
atgagactgatgaggctgtctcccagagccaatgtgccagttatacaggagactgttgaagcaggtgagtcacagttaaggcaggaggctactactcttaagaggacatcacagaccccagaaggtccactctcaccagggatggacctatcttttgctcagcaggtagtagatccttctacaccaatacaagagagacaggcagaccctcctacacccatcatggagatgccagaagaccctaccacgccagtcctaagactgtcatccactcctctagctaccccaattttacatctgataaatgaggaggatatgcaagaccaggacacacagggcacacaggaccagtcacaggaattctaa

SEQ ID NO: 36179 - DNA, 402 bp, Glycine max
  Peptide Sequence Number=SeqID_127864
atgcctgtcagcgccaacccagactcgcttcttgcgaacacaacgactgaattgccggaccgcctgggcgcagattatgattctgtaactcgtaagcaaagagcaattgcagtaggggtagccatgctcggtgttttggagccgctggcgcctatacgactattcgctggattggcaaacgtgcccatccccttctcaattgtcaattactttggggcctggtgcacgattgtcagtattgtagccatgcgtgcccataccaggggtcggctttttacttccaagcaacctcgcagactggtgttacctgatattccttggtatatgcggcttcatcatggtacatttcatagtttccttcttcaaaactattcaactgacattcccagcaatttctcttag

SEQ ID NO: 36180 - DNA, 288 bp, Glycine max
  Peptide Sequence Number=SeqID_127865
caatctggagtcaatgagcaacctgaagcttatgctgcaaacatttataatagaccccctcagcagcaaaatccacaacagcagaataattatgatctttcaagcaacagatacaatccaggatggaggaatcatccaaatctgagatggacaaatcctccacaacaacaacagtctgtccctcctttccagaatgttgttggttcaagcaagccatatgttcctcctccaatgcagcaacagcagcaacaacaacaaagacaacaagcaactgagacccctccttaa

SEQ ID NO: 36181 - DNA, 305 bp, Glycine max
  Peptide Sequence Number=SeqID_127866
gaattcgatcgccccctcagtcggctgagccaaatgacccaagcctcaaggaagaacgccagcatctcactgtactcctcttgtcggaacacgacggccgagataccattgtcgatttgactcgcaccctggccgagatggcacaaaagggtgacgtgcgacaagagcagattaacatggatttgatcgatgcacagctgaacgatcacgtctccagcgagcccgacctgctgatcctgttcagtccaacggttcaattgaagggctacccaccgtggcaactgaggttgaccgagattttgtaa

SEQ ID NO: 36182 - DNA, 174 bp, Glycine max
  Peptide Sequence Number=SeqID_127867
atggagggcgagatgttcgcgatagcggagtggcatggagcgggacagcacagcgacaagtggtatcctaaagcacaaaacactgtcacaactggtcccccaccaatgggagctcgacatttgcgctcgctcaaaggacggcacggccccgtgctacttcagcaagctgcatga

SEQ ID NO: 36183 - DNA, 696 bp, Glycine max
  Peptide Sequence Number=SeqID_127868
atggacctcatcaaggctgctggactgctgaaaacagtcaccaagttgggagattgttatgaaagcctagtcagggaattcattgtcaacattccctctgacataacaaacagaaagagtgatgagtatcagaaagtgtttgtcagaggaaaatgtattagattctcccctgctgtaatcaacaaatacctgggcagaccaactgaaggagtggtggatattgctgtttctgagcatcaaattgccaaggaaatcactgccaagcaagtccaacattggccaaagaaagggaagctttctgcagggaagctaagtgtgaagtatgcaatcctgcataggattggcactgccaactgggtactcaccaatcatacttccactgttgccacagaatcttttgctgtcaaattacccattgccttcccaactgtattgtgtggcattatgttgagtcaacatcccaatatcttaaacaacattgactctgtgaagaagagagaatctcctctatccctgcattacaaactgtttgaggggacacatgtcccagacattgtctcgacatcagggaaagctgctacttcaggtgctgtgtccaaggatgatttgattgctgaactcaaggacacatgcaaggtgctggaggcaaccatcaaagccaaacacaaagaagaaaattggagctggaacgcctga

SEQ ID NO: 36184 - DNA, 231 bp, Glycine max
  Peptide Sequence Number=SeqID_127869
atgcagaagacgacgttagtctctgcgtgctatcaggcttttcgtcttacagacagcaaaagaaagtttatacggataaccactcgggtgcgggataaccgtaaaggtgtctccgcgggttaccagctcttgggtcatggcaacaaaaggcggtgcgggccgacaaaaagcgaggctcttgctcctacgtatcctccaatgaggaactcagacctacgtagttctggataa

SEQ ID NO: 36185 - DNA, 86 bp, Glycine max
  Peptide Sequence Number=SeqID_127870
atggggaactctccgtctaagtggttaatccgacgagtcaattctcaatgtgatgctgctatccgttcgacgatcctacttctgat

SEQ ID NO: 36186 - DNA, 771 bp, Glycine max
  Peptide Sequence Number=SeqID_127871
atgaagttcatgaaacttggaacaaggccagatactttctacagtgaacaagctaccagcaccatgtactacgttatttcttcatttccatatctaaaaattcagaacctactcgcagatgatatggaggagagagagccgctgaaattcccgacaaaatataacattcaaatgggcatgaggtggctgattcagggtagccagtcaggggattcattgttaatgtcatccgactgtttagataggcagttgggaccgaggcttcatgggaggactgatgattcaggggtaaataacagatttacatacaaaactacttcataccaggatcctgttgtagagattaactatgaacgtgctgatataatcatcttgaaattgaagatgaccatagcaagtttgagccctgattgtcttctccagcaaagctcaactgtagaagattcaatttctttcaaattttcttatggtataactgaatcagttccatgctcatacactgaatttgccgagcgactggtgctgccgcaatataaaaatttacctgacacagaggttaaagagttccatagaagagatggttttgaggtagcaagtgctgacaagatggctaagtcatgcatggtttattttgaaatgcatctatccctaaggaaaaaaataattacaaaagcttttaatggtacaataattgttgttgaagatgacaagggagctgaaagaggaatgccgagcttcaattctcagttacccaattccaattcatggtaa

SEQ ID NO: 36187 - DNA, 225 bp, Glycine max
  Peptide Sequence Number=SeqID_127872
atggatcggtcaaccgcagcaggggaagagaagcagatgggaaataataagctcgacttaaaggagaggaagaataagaagagcaagctagacgtgcagggatgctaccttcctcaccgcagtcccctcagcagcacacagtgcgaacaggcagaagagttgacagccagaaagaaaagatgcgaacttcccactcctattctgagtttattggagctgggctaa

SEQ ID NO: 36188 - DNA, 273 bp, Glycine max
  Peptide Sequence Number=SeqID_127873
atgacagaaaccgtttgtacggataaccgcttgggtatctctgcacgtcacctgacttcatgggtcaagatgacaaaaaccgtttgtacggataaccgcatgggtatctccatacgtcacctgacttcacgggttaggatgacagaaactgtttgtacggataaccgcttgggtatctccgtacgtcacctgacttcacgggtcaggatgatagaaaccgcgaaagacgatgtaagtctccgcgtgtcaacgggtttgttggcccctgattga

SEQ ID NO: 36189 - DNA, 763 bp, Glycine max
  Peptide Sequence Number=SeqID_127874
atggctacctcaccaaaagaaacttcagctcctgggttcaccctctgcaccatcatctccaaccaggaacgacttgaattcaatatccagcccatacagatgattcctggtcaagcccctgttcctgaaaaactggttcccaaacgacaacagggtgtgaagatttctgaaaaccctagccttgcaacaagtcctagggaagtagacacagaaatggataagaagatccgcagtattgtaagtaacattctgaaaaatgcctctgttcctgatgctgatgaagatgttccaacatcttccaccccagatgttactgttcctgatgctgagaaagatgttccgacatcttccaccccaaatactgaagtcctctcttcacccagcaaagaggaatcaacagaggaagaggatcaagccacacaggagacccctgcaccacgggcaccagaacctgcgccaggtgacctcattgacctggaagaagtagaatctgatgaggaacccattgccaacaagttggcacctggtattgcagaaagattacaaagccgaaagggtaaaacccccattaagaggtctggacgaatcaagactatggcacagaagaagagcacaccaatcactcctacctcatccagacgaagcaaagtcgcaattccttccaagaagaggaaagaaatttcctcatctgattctgatgatgatgtcgaactagatgtctcgacatctaagagggccaagacatcagggaagaaggtgcctg

SEQ ID NO: 36190 - DNA, 48 bp, Glycine max
  Peptide Sequence Number=SeqID_127875
atggcttctatggatacctctgctaaggtcaactctaagatgttttcc

SEQ ID NO: 36191 - DNA, 285 bp, Glycine max
  Peptide Sequence Number=SeqID_127876
atggtgagcgccaaatgtacttatcaaaatctggagctaaccgatgtcaaggtaccatctgttaggagaataagagggggaacctacaaaacaaaggacttcgatgctcaagttaaaaagaggctaagtcatgaagtgctaaaagtgatagttgagctcagctcatcagttgggctaagctcgcatccatcgctaagcgcagcttcagcatgcttagcgcgacagaagaatctggcagagcatcaatatcaaggtcgcgccctaagtgcgagatcagtgtgctaa

SEQ ID NO: 36192 - DNA, 456 bp, Glycine max
  Peptide Sequence Number=SeqID_127877
cactcaaactgggaatggcagcttaattggagaagacaccttttcgattctgaaatagcaagggcggatagttttcttggggacatatcacagcagcaacttcatcccctaagggaggacacttggattgggaaacgtgaacctgcaggagactactcaacaaaaagtggatatgatttgatatggggagagctaatggaggcaagacaggaacaggattatggggcaatatggaaactgaaaatacccacaaaaacagcagtgttcacttggaggctacttcgggatacattaccaacaaagcaaaaccttagaaggagacaaataccgatagatgatatgctatgtcctttatgcagaaataaggaggaggggctgaacacttgttcttcaattgtagcaaaaccctccctttatggtgggaatcaatgtcctaggttaatcttatcactgtaa

SEQ ID NO: 36193 - DNA, 291 bp, Glycine max
  Peptide Sequence Number=SeqID_127878
atgggaagaatcaaaagaattctcagactgtgtcgttttgaattctttggcaagggagaagggagacacaaaagaattcaggcagttagtccttccttcttttggaaaagggagaagagagacacaaaaagaattcagcgattagtccttggtgaattctttttggcaaagggagagagaagaaagatgatagcacaagtttcaaggttagaaaaccagaaactttggaaagttttggtacaaagaagaagaagaagttcaaagagattcaaggcttgtaaaggattgtaa

SEQ ID NO: 36194 - DNA, 493 bp, Glycine max
  Peptide Sequence Number=SeqID_127879
taacctcaccttcagagagctacacgtccttgcctttagagggatacacgtcttccccttcagaagactacacgtactctccattagaggactacacgtcctcgccatcagaggactacacgtcctcgcctccaaaggacgacacgtcctcgccttcagaggaccacacgtcctcaccttcagaggacccacgttctcgccttcagagggctacacgtcctcaccttcagagggctactgccctcggcttcagaggaaaacacgtcctcaccttcagaggactacacgtcctcaccttcagagggctacacgccctcaccttcagaggactacacgtcctcgccttcagaggactacacgtcctccccttcagaggactacaagtcctcaagttcagagggctacacaccctcaccttcaaaagactacatgtcctctccttccgaggactacacgtcctcaccttcagaggactacacgtcctcccctttaa

SEQ ID NO: 36195 - DNA, 279 bp, Glycine max
  Peptide Sequence Number=SeqID_127880
atggagagaagccataacttcaacaatgggaagagatcccaagaagtttctcctacacttaaatgctacaagtgtaatcaacaatgtcacagcaaggaaaattgtctatcaaatgagtcatggctcgagaagaatgagaagaaaatctataaagaaagaagatccaagaaggcgtatattgcttgggatgacaatgactcatctgatggttcggataaggagatcaaccttctatccaaagactatgaaattgatgagaacatcactcaagaagattaa

SEQ ID NO: 36196 - DNA, 210 bp, Glycine max
  Peptide Sequence Number=SeqID_127881
atgaaaaactatgccaagcaagccaacaagaaaaggaaggaagtgacttatcaaggtaatccttgtggcgtctgtccagacttatcttccttcaccggaagtggcgtctaccctgacttatcctccttcaccggaagtggcgtctaccctgacttatcttccttcactggaagtggcgtcatccaaatcttcgtagcctgtatcaagtga

SEQ ID NO: 36197 - DNA, 543 bp, Glycine max
  Peptide Sequence Number=SeqID_127882
atgtctcgtataacagaaatgtttgcatcttcggaatatcaagatgacgatgctccactgtgggttaaagcacatttgctcagaatttatggtagtggaattgctacttgtccgaaagttactaatgcatatttggttgatttgaggagggtttgtgaagaggctgaaaacagattaaagtctaagaatgttcctttacctattgacaaaaggactccaacaccaccaacattaccaccaaaaagaagaaaatcaagcaatatagagagtgcatttaatattgaggataggaatcatcttagagcagagatagcaaggatgttttattctgcaggcttgtcattccatcttgctagaaatccacattttgttagttcttattcatttgctgctaactgtaatctaagtgggtttcttcctcctagttataatgcattgagaactagtcttttacagcaagagaggtctcatattgaaaggttgcttcaacctatcaaatctttgtggagtttaaaaggagttacattggttgcagatggttag

SEQ ID NO: 36198 - DNA, 487 bp, Glycine max
  Peptide Sequence Number=SeqID_127883
atgggctaccaaaaaggcatggtcatcggctttgccctggctgcgctcggttgcctgctgttttatccggctgtgttgctgcacacttacgccttgtttttagctgcattatttgtactggcctccggcattgtcctgctgcaagtcgcggcaaacccatgcgtggccattatcggccctaaagaaactgcttcgtcacgcctgactatggcccaagcattcaactcattagggacgtttgttgcaccattctttggtgcctatttcatcctgtccgggctcaccaattctgtctatgccgaaggtgtggtgtatccgtacttcctgattgcgggtgtgcttatcgtcattgcgctggtgctttccaaaatcaacttatccgggatggaaagcgcgcaagcagatgaaagccgttggcaggacgttttgaaagacaaaggcttgttgcttggcgtgattggtatctttgccctacgtgggggccgaa

SEQ ID NO: 36199 - DNA, 318 bp, Glycine max
  Peptide Sequence Number=SeqID_127884
atggtaccagtaggtgaggtgtgcattgtgccaggggcgtgttctagtgactacatcgactggttcttctgcatctcccatcctttcatgacaccaggccacgtattagatcctctgcctcatggtcacgccccgcagccccgagtcgtctctcaggccccgcagacggatatccctcgcgtgccggagccaagagcatcgtcgacatctgcggaggatcccagacatgtagtggaagtttgtgatgacattgctgagaggttggagcgccatctgagtctaggggtggcacgcctggctcatcgacacctgaggtga

SEQ ID NO: 36200 - DNA, 162 bp, Glycine max
  Peptide Sequence Number=SeqID_127885
ttcagggtagaggtcgcatggcctggagattggcttaaggcttgggcaggagaggcacctgcagaggcaccagcagaggctcccgacgaggcagatgaggcccgcgaggacaaggggatggccgatttacttgatttcttaggaggaagtggggctgcatga

SEQ ID NO: 36201 - DNA, 399 bp, Glycine max
  Peptide Sequence Number=SeqID_127886
atggcaagtcaagaaaagtgggtctcgtttgcggatatactagctttgctaatctttggggttgtcctctttccgaacgtggacagtttggtggacctagccgcaattgatgctttccgtgcatatcaccatagcaaggagagcccagtggtggctattttggcagacttatttgatacatttgaccgaaggtgcgagaagaacagctcacggatcgtctgctgcttacccgctcttagtgtgtggttggtttcacacctattccaacaagacataagacacccgtgtccgcttcaaagctatcactcggaggcagcacaatcgattggtttcctcgatggaaggaaggaaatgagggagttcttttctcatgtggggactaccctaacattccgttga

SEQ ID NO: 36202 - DNA, 513 bp, Glycine max
  Peptide Sequence Number=SeqID_127887
gtcatgtgacatgcacccttgtatcatccagaggcggcgggcccgatgatacgcggagataccttacggttatccgcacccttttgtcatccagaggcggcgggcccgatgacaagcagagaccaaagaccaaatttggtcattctgcacccttgtatcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggccgatgatacgcggagataccttacggttatccgcacccttttgtcatccagaggcggcgggcccgatgacaagcagagaccaa

SEQ ID NO: 36203 - DNA, 192 bp, Glycine max
  Peptide Sequence Number=SeqID_127888
atgtgggtgcaagccattggtctgtttgctcaagcgacctgtgctcctgagtttggacttccaagaccgttgaatcagagattactcatcttgcacgttggtgggggcaccgtaaaacaacgaagaagtgagttatcaagaataggatgttggacaaatggcctcagtttccttaagaaaaaggagggttga

SEQ ID NO: 36204 - DNA, 411 bp, Glycine max
  Peptide Sequence Number=SeqID_127889
atgaatgctaaccgaaatagaaattctattaggggtgtattcattgatggttcatggactgacgacccacacaaggtgaaggaagaggtgaaatcctttttcttccataggttccaagaaccaattggtcagcaacccaagattgatggaatcaggtttcaaactgttaatctacagcagaataacgagcttctggcacctttcatggacgaagaaattcagaaggcaatttttaaagctgcagcgaagttttttatgaaggaaggcaattcacaaaaggattgcatggatttaatggaaatcagtatgcttaccaaaagaaaaggctggcttgggcatcaaggatatcgaaacattcaacctcacactacttggaaaatggaagtggcaattaatgcaagaaaatggtga

SEQ ID NO: 36205 - DNA, 318 bp, Glycine max
  Peptide Sequence Number=SeqID_127890
atgttggtgcgcatggtccgcactcttctctttgcagcggcacgggtgaaatcttgccccagtatgcatagtagctgtgtgatagcctccctctctggttgtgctcgcacagttggccctcctccaatatcagggggggcccaggaaccgttaaaaggaaactactgcccactgaaagtgaggacgcgtagtcctctaaaggcgagggcgtgtagccctctgaagttcaggacgtgtcgcctttcgaaggcgagggagtgtagtcctatgatggcaaggatgtgcaatcctctgaaggtgagggcatgccccccttga

SEQ ID NO: 36206 - DNA, 369 bp, Glycine max
  Peptide Sequence Number=SeqID_127891
atggcagcccaagatgaagaatcagaagatgaagaagacttctcactctttgtgaagaagtttcacaaatttgtcaagaatagaagaatcgagaggcgtcaaaatttcaaccatggaaaaagattccaagaaggctctccaactcttaaatgctacaactgcaaccaacttggttacatcaaagcaaattgcccctcaaacgagcaatggcctgagaagagtgataagaaaagccatgaagaaagaaggaccaagaaggcttacatcgcttgggatgataatgattcatcagaaggatctgaaaaggaagaaatcaatattttaacaaaagattatgagagtgaagaggacatcactcaaagggattaa

SEQ ID NO: 36207 - DNA, 501 bp, Glycine max
  Peptide Sequence Number=SeqID_127892
atgagtcatccgacgttttccacatgggcgtactgcaaccgcggcgtaaggcgacgcggttttaccgggatccaccacgcgacttgccagctggttccgcctgctgtagagcgaatcttggcgcgcgcttaccggccttcagcgttggcggccatgatggcgtctttgaacgccgggcatcttatagaaccttgttatgcccatgctgttccggacagcaccaggtcagggaacgcgtccgggctcgttgttccgccaggccttccatggcagatcgcgccacgtcctgccagcgcccaggtttttccacacgtcggcggcaaaggcggacgctgctgttgtttgatcggaggtgtgtcagcgcgagaattcagcggcggcgatgtagccggcgcttccgccagcagtttcctcttcagtgcgttgcgtcatactttcctggctccagttttttattatccggcccacgcgggttgcgtgaagttagcgccttgcccgtga

SEQ ID NO: 36208 - DNA, 207 bp, Glycine max
  Peptide Sequence Number=SeqID_127893
atggggaattgcactaagcaatcctacggcgcatggctccaagctcgtgggtggaggacgcatgaacgaaaacgcaattcatggggctccgaaaaaggattgagaatggagaattgcactaagcaatcactacgcatggtccaaactcgtgggtggaggacgcttgaacgcaaacgcaatttgcatggggctccgaaaaagggttga

SEQ ID NO: 36209 - DNA, 174 bp, Glycine max
  Peptide Sequence Number=SeqID_127894
atgaggaagaagaaggaccatagcggcgtaggaagtggagaaagaagaaggaaagaagaaaaaccacagtcgcgcgagaagtggaggaagaagaagaactgcaagagaaagaagaaccgcaagaggaagaagaagaaccacaaccacgaggaagaagaagaaacgcaaccatga

SEQ ID NO: 36210 - DNA, 594 bp, Glycine max
  Peptide Sequence Number=SeqID_127895
atgggaacaaatcaaaccggcaagaggttctaccaagtcaaggtcaaaagcccagataccaccagcatcaagggattagggcggttgatggaacccctccaaatgcaagccttccgcaagacttacggaaagatcttagagttgaccatagcagaggtgtccatagaagccattgcatcactcacccaatactacgaccagcctttgagatgcttcacattcggagacttccagttagtaccaaccattgaagaatttgaggaaattctaggatgtcctctcgggggaagaagaccatatctttcctccggtgtctccctctttgagcagaattgcaactgtggtcaaggattcagcaagatgtttggaccgcataaaacagactcggaacggcatggcgggcctaccacgggggtacctagaagacaaggcaaggggtatggccaatcaaggagattgggtcccatttatggatgtgttagctttgctaatttttggggtcgtcctctttccaaacgtggatggtttggtggacctagcagcaatcgacgctttccttgcatggggggggtagcaaggaaagtccggtggtag

SEQ ID NO: 36211 - DNA, 615 bp, Glycine max
  Peptide Sequence Number=SeqID_127896
atggatatgagcggtggcgccaaccagatcggtgtgcgcgcttataacgagcggcttgtgctctccctcgttcgccgccatggcgggttgtcaaaagccgaaattgccagactttgcggtctctccgcgcagaccgtttcggttatcatgcgctcactcgaaaaggacggacttctcatccgcggcgaaaggctgcgcggcagggtcggccaaccatcgaccccaaatgcgcctcaatcccgacgccgtgttctccttcggtgtcaagatcggccggcgcagcgtcgatctggtgttgatggattttgtcggccacatcaggctcaagcttcgcaaggacctacccctatcccgctgccggaatggatattgcccttcgtgatcgagggtatggccgaactggaatcgaagctttcccccgcagaacggcagaaaatagccggtgtgggtatcgccgccccgttcgaactctggaactgggcgcaggaggtcggggcgccgcagattgagatggaacggtggcgggatgtcgatattcgggcgggcatcgccgaaaacgtcagctacccggtgtttctgcagaatgacgcaaccagcgcctgcggtgctgaactg

SEQ ID NO: 36212 - DNA, 375 bp, Glycine max
  Peptide Sequence Number=SeqID_127897
atggcgccgaccaggcaccctttggacccagataagtccaacagggccctgggttttcccgcactgatcacaggactctgccagtcgttcggagtccccgttgcacctaccaaggaggcggctaaccacagggcccatgtgcggaccaatgagaccctttaccagctgagcctcagcatgcagagccagggctttgcttctttttcatgccctactccagaccagttcagggcagaggtcgcatggcctggggattggcccgaggcccagacaggagaggcacccccagaggcccccgacgatggagaggaggcccacgaggacgaggagatgaccgatttgcttgacttcttaggagggagtggagctacataa

SEQ ID NO: 36213 - DNA, 1214 bp, Glycine max
  Peptide Sequence Number=SeqID_127898
ccggcccgctttccatccaggcgctgaaagatgaggggcgttatcagcgtttgaccgaggggtatcttccggaggcggagattgttttcctcgatgagatctggaaagcgggaccggcgattctgaacaccctgctcacagcgataaacgaacgtcggttccgcaacggcgccagcgaagagaaaatcccgatgcgcctgctggtggccgcctcaaacgaactgcctgaagccgacagcagcctggaagcgctgtatgaccgtatgctgatccgcctgtggctggacaaagtgcaggataaatccaatttccgttccatgctggtcagccagcaggatgagaatgaaaacccggttgccccttcactgcaggtgacggatgaggagtatcaccagtggcagcaggacattggcaaaatcaaactgccggacgcggtctttgagctgatctacctcctgcgtcagcagctcgatctccttccctcggcgccctatgtctccgatcgtcgctggaaaaaagcaatccgccttctgcaggccagcgccctgttcagcgggcgtgatgccgttgcgcccatcgacctgatcctgctgaaagattgcctctggcacgatgcagaaggcatgaacctgatgcagcagcagcttgaggttttgatgaccggacacgcctgggggcagcaggcgatgctcaaccagctgggggccatcgcccagcggcgcattcagctccagcagcagcaaagcgataaaaccgcgctgaaggtgaatcgtctggggggaatgttcgcccgcaaaccgcactatgagttacccgctgaactgaccagcccgacgctgacgctgttgcttcagcagccgctcaagctgcatgacatgcaggtcgtgcacattacgcttgagcgtgaggcgctggctcagtggctggataagggcggagagatccggggaaaactcaacggcatcggtttcgcgcagccgcttaatatggaagtggacagtagccagcacctggtgatccgcgacgtcagcctgcagggatcgcgtcttgcgcttcctggcaccgcctcagacagcgttcccgaagagattaagcagcagctggaagcgctggatacagaatggcaccagcagcacacccgcttcagcgagcagcaaaaatgcctctttattcatagcgactggttaggtcgcatcgaagccagcctgcaggat

SEQ ID NO: 36214 - DNA, 390 bp, Glycine max
  Peptide Sequence Number=SeqID_127899
atggccaagttcgacccagacgtagtcctcgagttttatgccaatgctttggcctacagaggagggtgtgcgagatatgtgatcttgggtgagggccagttcctgggatacccgtttagtgctggaggagggccaggagtgcgagtatggctagaggaggaaccaggccgatgggactttgcccggactgtggctgggagacgggtgcggatcatgcgcaccaacatgaccaccctgacccagatatggatgacgttgctgctcagcaacatccaacccagcgatcataattctgacctccccctgccgaagtgtcagctggtatggtgcccaccaggcaccctttggacccggataagtccaacagggccctgggatttcccgcattga

SEQ ID NO: 36215 - DNA, 422 bp, Glycine max
  Peptide Sequence Number=SeqID_127900
ggctctgtggggcagtaatagcgagcttaagctccagagagaggaaagggacacattgcgagtagacggtttgattttgaaggatgaattgagggtttgcctaaggtccaagaggagtttgtctcagtggttatgcgagaccgaaacgaacatgttagccatcatcagcaagtatcaagaagaattaaatctagccacagcccacgagcacaaagtggcgggcgaatatgcccgagtgtacgcggaaaaggaggctagaggaagggtgattgactcgttacatcaagaagcaacgatgtggatggatcggtttgctcttactttgaacgggagtcaagaactcccccgattgctggcaaaggccaaagctatggcggacacctactccacccccgaggagatccacgagctcctcccctatt

SEQ ID NO: 36216 - DNA, 261 bp, Glycine max
  Peptide Sequence Number=SeqID_127901
atggatcccgtgaaatacatctttgaaaaatcggccctcacgggacgaatcgctaggtggcagggaagtgccttagcagatatttggcccagcaaccccctccaggatatcggcgatgcaccccgagtcccagatgaagatatcatggccctgtttgaagagaagcgaacgcacgaggacatagacaaatggattgttgctttgatggggcgtcaaatgtttgggtcacggagtaggggcagtccttgtatccccggatga

SEQ ID NO: 36217 - DNA, 288 bp, Glycine max
  Peptide Sequence Number=SeqID_127902
atggaagggaaagcatttgtttggcaaaggcattacacgactcataacaacaataagatgaaatcttggcagcagattcttcaggatgtggctttaagatttgacatggggaattatgatgatcccgtatcagaattatctaaactacgccaagaagctagggtagatgttactaaagaaatggctatcagctttttcttgggaggattacatgcttcattagaaaaatcagtttgtattcataaccctagttctctacaagatgcaatgcgattagctagattgtaa

SEQ ID NO: 36218 - DNA, 228 bp, Glycine max
  Peptide Sequence Number=SeqID_127903
atggctccgagaaagctttccaataagatatctaggagggacgccgcggccgaaggaactagcgccgctcctgagtttgacagccatcgtttcaggagcgcagaccaccagcagcgtttcgaggccatcaaaggatggtcgttccaccgagagagacgcgtccagctcatggacgatgagtacaccgactttcaggaagagatagctcgccggcgttggacgtcgctg

SEQ ID NO: 36219 - DNA, 235 bp, Glycine max
  Peptide Sequence Number=SeqID_127904
gaaagaatgcaatgagcaatgtgtaaatcatgaagattttgatgatatcaagaagaatttgcttgagaaagagggagatgtaaatcatgcaagctttgatggtgtcgagaagaaatcaaattttatcatcatcaaaaagggggagaatgtgaatgtatgtatacatgattttgatgatgtcaaagaagaatctaacaaggctgcttcaaatgatgagcatttgcttcaagaataa

SEQ ID NO: 36220 - DNA, 414 bp, Glycine max
  Peptide Sequence Number=SeqID_127905
atgcaagaacaaccagagagggaggctatcacgcaactactatgcataccggggcaagatttcacccgtgccgctgcaaagagacaagtgcggtttgtgagcaccaacatgaccactcttacacagatatggatcgtgcccgcaagacacccagtggacccggagaagtccaacaaggtcttagggtttccagctctgattacgagcctctgtcagttctatagagtgctcatcgcccccaacaaggtcatcaggcccctattaacagggctttcatcgagaagtactgtgcccccaggtaggcgtagggcaaggcatcatagcagcgggcaacagatgcatcgccaccacctctggagttcacctcagctcatccacaaaaaggttagagtgttgcctaggacacatggctga

SEQ ID NO: 36221 - DNA, 348 bp, Glycine max
  Peptide Sequence Number=SeqID_127906
atgcgtctaccggggaaggagagtatgctgatgaaatcccccataaccgtaaatgagattttggatgttagcatttcgtttctaaatgaccatttagaggaaacactgggttcaactaaaatagaagaaaatcactcaaagtgtatcaacctcgcacaggacttcccttggaaacgggttcttttggtggggttttcggcttttgagttttttggctttttccttttctgcttccctttgacgcaaggcgagcaagtcaccgacgcacaggattttggtgacaattctgtattgttcagatattgtctggtcaaaagacctttctgcacatttcttctgcttctttga

SEQ ID NO: 36222 - DNA, 231 bp, Glycine max
  Peptide Sequence Number=SeqID_127907
atggcatgcaacctttggttgaccgcttcgaggtacttggcaccctttattgcacaatacgtgaagatgttcctccagaaggcggttgcttctggaggaagcaacttggctcgcctggggggaggagtgaaggtgatgcaatcctaccccgcaagggcattggctagaagactccaagtagattgggctagagatccaaggaaaggccctagggttctcatgagccttagg

SEQ ID NO: 36223 - DNA, 357 bp, Glycine max
  Peptide Sequence Number=SeqID_127908
atggctcccgaagaccaagagcagttgactcaacaaataagggaccagctggaggagtcaatcacagaaaaagtgactcaacagatgatgttatccttcagccatatgcagttccagtttcagtcacaaatgcaatcacagggacttggactgcctccggaacctaaggttggtccttcacctgctcgtgtcaacataaaggagagttgtgttaatccctcagggaacgatcctgacacgggtgactcagacaaatgcaggttgtacatcaaagaaaatcctccccgcctggttgccctaggaagagtttatgagggatccacaacggttcataacatccctttgttgcatggctaa

SEQ ID NO: 36224 - DNA, 179 bp, Glycine max
  Peptide Sequence Number=SeqID_127909
catgcgtattcctgagtctttcatctctatgaaatattgtcgagtattggcaatcaaaattgcgattccttgggttatggggttgaagcaagatcatgctttttacgtaaaggttcatcaagtcaagttgaagcatgaaagtaaccatcttgcaaaaattggggcaaaagatggatcag

SEQ ID NO: 36225 - DNA, 213 bp, Glycine max
  Peptide Sequence Number=SeqID_127910
gcgttggaccttgaacaatctcaagtgactttaatgaagatagtggaagcaatgccttccaagattattttgatgatgccaaagaatcaagagttaagcaaattccaaagattcaagaatcaagtttcaagtttcaagaatcaagattcaagaatcaagtttcaagaatcaagattcaagaatcaagtttcaagaatcaagattcaagaataa

SEQ ID NO: 36226 - DNA, 351 bp, Glycine max
  Peptide Sequence Number=SeqID_127911
atggtaaaattttttttttcttcttttttttttcttctttttctttttcattttctttctctcttcacaataattagctgtccaaaatatgagagttttacaaaatacatagtgtcatccagagcaaaggtgtccacagtggtggtgtcgcaatgtgcccttcgcgggcgagcgagggcgaggctcacgggtgcgctttccaaaggaggaaaggtcgacaaaagcggggcttttgctcctacgtaccctccatcaaagaggaaatcagacctacgtagttctttcttatgcgtgaatcaagtgattcttttttacttgaagggtgatcattttaagggcgttggaccttaa

SEQ ID NO: 36227 - DNA, 630 bp, Glycine max
  Peptide Sequence Number=SeqID_127912
atgggtgcactgcttattgtaccacctatcgagataccactgccactcgtcctcgctaatgcttcggctcccaggtacatgtatgtttccccttcttatctatcgtcatctttggatcatatccttcctgatgtcaatgttcctattggggacttcttggagctatcttggagtagggtcagtcatcctaaagttttatctcgaatggtgtttgaatctttcgacatgaagccttatagcataggtgtgcatgagcaaatcgttgctcctattaaggtcaatgctcccgggatactcatcctgggtcaagctgccttttttccatctgagtcagtaatcccgagatgttcatcccggatggtatacaacccctcaagcattggacctcgtgcttttgttatgtggcattccagaatccagaggtgtaggtatcatcatctactcaaatctcttgaagaatatctggtgaagcttttggtcgtgtttctgattgtggaatttggacaagagaatcatcattatcattatctcacgagagacacagaccaccctcccactgttcaaccctcctgtcctgttctacaaccgtcttcttgtcctgtttcttgggttctttctgaacttgtttga

SEQ ID NO: 36228 - DNA, 1064 bp, Glycine max
  Peptide Sequence Number=SeqID_127913
atggtgacgtttagggttttgcacaatctgaccaaggagttggaccaccttgattgtagtaagaaaaagggtaaagttggtggtgttaatgtgtctggcttatctaagggacatgaatcccaagggattgtggatgattatgtgagcaaggacaaggaggtgttgctgagtgttgacatggctttggagccgaaatctattttgcgacctagggttaaggttcccaaggatcagattaaggaagcatgcagaccttggaagaaggcaattgttgtgaagttgttaaggaaaaaactgagtatgagatttctgagagttaggttacccaagctttggcaacctttgggtgagatggagatgatagacctggagagtgactattttctcattaggtggtccatgaatggtcatggaccagtatttgttggttcagagatggaccctgatttttttccctatgagagacaaatgagaaagatggattcgaatatgttgcgagcaaagaaggatatggaattagggaattatgtgacgaagagggcaaaatttgctaggatttgtattgaggttgatttgaacatggcacaaaaagaagtatgcctcttggaaggccatgagattaatggtgtgggagttgggagctctattatgtcatttcaaaaaggtcctaagtttgaagttcttcaagaggatgataatgatggtttacctaatcagagagcacatagggataatgctaataagaaagataagaacaattttagtgcttgtgcaaagaccttcaaggtttttctacaagaactcattcttcaccctgaagatctatacaacacctttactgcaagatctatgcaagatcaaatcttgagcacaagtgttaggggagatgctccaaacgggaaaggcaagtctttgccaaagattcttgttggagtagaaaatatggcgagcaatgaaatcacaacggaagctccaatcatggcgaccgagctcgacacggatccagctgctccggcatctggtgccggcgccggcgccggcaccggcgactgccccgaaactaa

SEQ ID NO: 36229 - DNA, 1119 bp, Glycine max
  Peptide Sequence Number=SeqID_127914
atggatatcaagtgcccgattttcaaagtgatgaagaagcagttaagcgattgggacttttgcttaggaaaattgagggaagttcaatgcactcagtgtatcttaaaaccactcgttcatgatgatgcaataacccttttccggcattatgcgtcattggaagaaagctgttctagtatttctgaagaagtcatccaaaaggttgtgaaaaactgcaagggtttaccactttccatcaaagtgattgggagctcactctgtaatcagccttttgagttggacctagggttatttcctgaagaccaaagaattccttttacttctcttattgatatgtgggcagagttgtatggactagatgatgatggcatagaggcaatgtccatcatcaacaaattagactccatgaatctggctaatgtctcggtagaaagtgatctgccattcattatattcacaactgatgccatatgggttgcatttgcagatgaaaattgtacttcagattggcccctaatgatgcaactggctcaagttgaggcatttgaaaacaatcacatgctaattccaaacgcttttccgaatcttgaagagttaaacattgaccattgcaaagatatggtggcattgcctaaggggctctgtgatatcacctccttgaagaagctcagcattactaattgccacaaactctctgcactgccgcaagaaattggaaatttgatgaatttggaactcctaagcctcagttgctgtactgatttggaaggtataccagcttctattggaaggctttcaaatctacgacttatggacatctcaaattgcataagccttcctagtttaccggaggactttggtaatctgtctagtctgcaaaatctctacatgagaagctgtgcaaggtgtgaattaccattctcagttgctaatcttgagaatttaaaggtggtggtatgcgataaagagatagctgcttcatgggacgatttcaagcctatgcttcccaatctaaagatagatacttttgataatcttgagaatttaaaggtggtgataggcgatgaagagacagctgcttcatgcgaagatttcaagcctatgcttcccaatctaaag

SEQ ID NO: 36230 - DNA, 1041 bp, Glycine max
  Peptide Sequence Number=SeqID_127915
atgacagatcctaagtccaatttatacactgaaaccttcaacttcatgcccctctattctcacctctcttcttttagtacttctcaatcaaacttattctcttcttactcaaacaacaacactttcgccattcaatctgaaacctcttcctcttatgctcctccttctcctcctctcagagaagcccttcctctcataaacaacataagcctcagaaaacaaaaggaaaaaaatgaaccatcaaagagtggtggtggtatggttgaagaggaaggaggaaagaaaagggacatggatgagacgacccttttgatgactagtactactactgaagagggtgatgctgaaactgtgacagtagcactgcaaatagggcttcctagcgtggctgcttctgatgatcttaatgggtcaaggaagatccctgcagcttgtgcacaaatgaatgaaaaggaggatgcgaggagtgtgatttctggacacccttttgatagattgaacaaggttcagtattggattcccaccccttctcagattctcattggtcctactcagtttttgtgtcatgtgtgctctaagagtttcaacagatataataatcttcagatgcatatgtggggacatggatctcaatatagaaagggccctgattctctaaaaggaacacaaccatcagcaatgctacggcttccatgcttttgttgtgcaccaggttgcaagcacaacatagaccacccaagagcaaggcctctgaaggacttcagaacccttcaaacacactacaagagaaaacacggcattaaaccctacatgtgcagaaaatgtgacaaaacgtttgcggtgaaaggtgattggaggacacacgagaagaactgtggcaaaatatggtactgtttatgtgggtctgatttcaaacacaaaagatctctaaaggatcacataaaggcctttggccatggccacggtgctgttgacattgattgcatgcaagaagatgaagcggcctccgaaattgaacatgatggggatatctcaatgtga

SEQ ID NO: 36231 - DNA, 2058 bp, Glycine max
  Peptide Sequence Number=SeqID_127916
atgatgagtgaatcaggtgttaaggtctgtgtcttcaacaatggcgacaccctttgtggtggagctgaaggtatcacatttaacagcgataacaagaagtgtattattgttcaattagacattaccatatctgaactgaagcacattgttgattcaatattttgcatcaaggatgatggatctcccttgggtggtcaattatccgctcacacatccaacatgaccttttgtgattcttcttcttctccttctactaccctcacccaaacccagaatccgagtgaccctcaaatcatagttcctaacagaaagcgtagggtgaaggcttcttctgatacccaattcaaagagaattggttggcttcactctcttacccttttccagaaaagacgcatcttttgagtggagagcatgaaccgacccaccaaaatgatggctctaaatgggtccttggaattgatccagatgtctctggcgctgttgcactcttgaaaacacacggttctgtttgttcagctcaggtaccgtgcttctttttgtctctgctggctaaagttctttccttttctgtcctttgttacattacatggtttggttgcggtttcattgtccttgatattgtgggaaattgtggtcaatctggctgcaattgtggtcgtggtgacccaaaaagcttgatactgcagctgaaattgcgaggtgctacttgtggtcgtggtcatggttttgctgcaatccttgatattgtaggaaattgccaaatgccaaccaattcggctgcaactgtggttgccaagaccctgaaaaccttgatgctggtatttgactctcctcatgtgaaaatacttgtcggcaagaacaagaggacccgaagacgcttagatgccaagtctgttgttgagttggttcgtggttttgatgctccaattgctgaggtggagtttgaaaaagggaaagatagagttgtaatgaatgtacagatggcaagcaagaagagggagaatgatgtgcagaaatcatggaaggaatataagtgggaaaataacagaatgtggggggaggagttgaaggatggtgggtatttgggtgagctgaggggtatctctctcggtcttaaggattattgtatcttaggaaagtatgctgttgttaggatatacggaggagggaaaggagagctagtgttagagatggaggaagcacgggttaagggggagctgccagcattcgtggggcatggagggtgttgcaatgcattggttctacatttggagccaaaagatcccggattcagattgggagtcattttccacaacttgatcaaaagattcggagatagctatggtagccatttctttgacagattgactaccttgaagcaagaagagcaaattgagacaaaaacccgcattgaaaaaaaaggagatttccacaatgttcttgaaatagaggaccaacatttcctagctgagacacacatgttgcgcaagatattgaatgaagtggctgattacgaaaacagcatggatggaagtgggtctgattgctgtgaagcagagtctagttcttggacagcaaaggtggaactacccacctttgatggaggcacaaaatggggaactaacttgaagggtagcaattttgagagtgatgaagaaaccaaaaatgatgaaacaaagttagctagagaaacaaagattgaaaaagttatgatggacggagaagttgatccattgatgaagagggagacagccaaggaaaatagagtgaagaatgagggctgcgaagaggattttcttgataatccaataacagagttgatcaagatggaagttgaaggtggagatgcaaccaagcctcattgttttcaatattcagatttccataaaaaagttgttatgatgaaacaaaaatcattgttggacccagattcgatcatgaaggtggttggaacatcaacggtgttggaatcttggaatttcaacttgctgggtgagccttttgtgttaaactttgttgcatctatgactgacagcttagcagtggagctaaggtag

SEQ ID NO: 36232 - DNA, 417 bp, Glycine max
  Peptide Sequence Number=SeqID_127917
atgtttttcctcctgagtgtcaagctggataacagagataggtggagtgctccggatcatttctccaatgtgctagatcattggagagttattgttgctgagaatggaaggcttaaaaacatagacaccattgcaaagaggtttgcgcagttgtcaatggcatataaaggagaagtgcaagcaactgtgaccactgttgttcctcttccccctgaagaggaaaaggcattgaaggagactcttcaggaaataataggttctggagcaaaggttcatcttgaacagaagattgatccaagcatacttggtggtcttgtgcttgaatttagccagaaggtctttgacatgtcaattaagaccagggcacaacagatggagaggatcctccgtgagcctgtatcgattgccaacatctag

SEQ ID NO: 36233 - DNA, 441 bp, Glycine max
  Peptide Sequence Number=SeqID_127918
atgggtttccacataccaggtattattagacagacattattttctgcaaccaaagcaactcaaaagggactcgaagttccaaaaggctatcttgcagtctatgttggagataagatgaagcgatttgtgattccagtatcatacttgaaccaaccattatttcaagaattactgagtcaagcagaacaagattttggatatgatcatccaacaggtggtctcacaattccttgcaaggaggatgactttctaaacctcacttctcacttgaatgagctggatgattatatccgaactcttcctcagcttgactcaacaagtcttggaatgaaggttgggtcaagtatgatatggggatcacaaaccgcctcattctctctccaatgtagactgcaagatagccctttggcacctccacagcttttgaagatgtttggttag

SEQ ID NO: 36234 - DNA, 1869 bp, Glycine max
  Peptide Sequence Number=SeqID_127919
atggaggtactagagcatcccttattggcagagatacccgtattagccgaaccatgcatggatcaaagcgtggacaaaaccaacaacgaggttggagtgttatccaaaacaagcatatcatctcatgacttttgcaaccactctgagtccttcaagaagctcgtggagatgggtttgccgtgtaatgaatcagttgaggaaaagctgcattggttgcggttacaaatcataggtaatgaagcagagttcgattccccatttggaaagcgaaaagttgtctatgctgatcacactgcttcaggccgcagccttcactacaatgagaatttcatcatcaaacaccttcttcctttctatggtaacacgcacacatgtgacagttatgtgggaagcaggacaacaaaaatggtacacgaagcaagtgagtacattaaaaagtgtttaggtggtggagaagatgatgcacttatattatgtggctcgggcacaactgcagctatcaagaggcttcaagaagtgatgggaatcgctgtgccatctgttttgagggaaagggttttgaagagccttagcacagaagaaagatgggtggtttttgttggacctcatgagcaccattcaaacctcctttcttggaggcaaagcttggctatggtggtagagattggtcttgatgataaagggttgcttgatatggatgctctaaagctacaacttgaggcctacaaagacaccaatcgacccatgttgggatctttctcagcttgtagcaatgtcacgggaatctactcagatacacgagcaattgctcagcttcttcatcggtacaaagcctttgcatgctttgatttcgcagcaagtggtccatatgtggagattgacgtgaggtcaggggagagtgatgggtatgatgcagtgttcctgagtccacataagtttcttggtggtcctgactctcctggtgtgctcctcatgaacaaggccctgtacctgctaggatcttcaccaccgtccacttgtggaggtggaaccgtgacttatgtcaatgccttcaatgaacaggatacattatacttggagaacatagaggaaagggaaactggggggacgcctccaataatccagacagtgagagcagcattggcattttgggtgaaggaatatataagctatgaagatattgaaaaacgggaacaactgtacattaacaaggcactcgagagacttggttcaaaccccaacattgaggttctaggaaacttaaaggccaagagacaagctatattgtcatttctgatatactctaccaccaccaattcttgctcagctggtgagtggagtgatggtaacaaagaaaatgaaggggagcttgatttgtgggcagaaacggggaaccaaagaggtaaaccacttcatggtccttttgttgcagcattgctcaatgacctctttggaattcaagctcgaggagggtgtgcttgtgctggaccttatggacacgaattgctccacatcaacaagtctcattcacttgccattagatcagcagttcaagagggctatattggagtaaagccagggtggactcgagtaagttttccatactacatgagtgaagaggattttgagtacattctgaaagccatagagtttatagctgtgtatggccaacgattcattcctctatatagtttcaatttgataaatggcagctggagattgaagacacagaaatttgaggcacaaaccaaggaaggcactgacaaatttgaggtggctaaatgtgttgctagtagcctccgcaaattcccttctcagggtatactccaggaggaagtggatcccaatatcttctgctttagaatttaa

SEQ ID NO: 36235 - DNA, 834 bp, Glycine max
  Peptide Sequence Number=SeqID_127920
atgatgccttactctcagatctttcaaaacaaccgaaactacgccgtttggccgccgtacccgccggaaaacgcggcggtgttccctcaccctacggcgttcaatccgcatccgggtcgggtaactggaaacaaaaggaaagacttttaccgaaccggttcgggtccgccggtgatccgctccggcgcgaaaggttgccggattaaccacccgaagcgaattctcggccgcggcggtgccgccaatcggctcacgccgccgttcgctccgcgcaacacaacgtcgttcataatccggacgaagaattgtggcggcatggtgtcgccgccgactcctgaggcggcgacatcatccccggcgatcctgccggcggcgtctctgtctccggcgacgttcgacgagaaggctgcgaaggagcagtggggattcaacggctacggctccatgaagggccttattcggctccggccaggaaattgtgattccggcgccggcaggttcgaaatggtgtaccctaattccggtgaagaacataaaaacttggacaaaagggttgctgaacaagatacccatattgcacagcttgaagagcagaatttgacgctgaaggagagacttttgttcatggaaagacaattggatgacatgagaaggagggttcagttcttggagacctacggaacgaccagccgcggtggtgagggcggggcggagaatttccccgcagccggagatgtttgctcagtaaagagctatataaacaattctggtgttgacggtgataataataatgttgatgaaaataataattgggaagatattttgcagtggtag

SEQ ID NO: 36236 - DNA, 570 bp, Glycine max
  Peptide Sequence Number=SeqID_127921
atgaactgtagagaaaccactgtggctgtggaggatgttgctgcagctgttgttgctcttgttgttggtgctggtgatggtgctgctgctgctgcaagccagcatcggtggctaccgccaccgcactcgaaggagttcccttggcttcaacaaatctccacatgtaccacgaagcaacggaccggtaaggcctccacttgtcacacaactggtccatctgcgagggccggggcaagtcctcgaggttgtagagtgagaaagtcctcacgttgggaaccggcagagtcgctcctgcgcttccggttgccagtggaaaccctaacggtgaaatcaaggattgcatcgtggccgttgtcggagtcagaatcatctgctataatgttgaagacattgatgcatgagttctccgctttggattctggcgttgagaaagccctcacgctggtagccggttgggttccggaggctgtggcggcggagggggagagaggcggaggcagaggcggaggtggaggaagaaggttcgtgagtttgggagggggtggatggcttcgggtttcgagggcttag

SEQ ID NO: 36237 - DNA, 303 bp, Glycine max
  Peptide Sequence Number=SeqID_127922
atggaccttagttgcacatgggtggctatgcttggaggggaatggaggatagggtgcaaaggttttagtagattgatagtgaatcagaggctggtgactgtttttgcaacaaatcccaactctgtaggtgaaaaatcacccacagaaggatcagatgtaaatgaaactagcaatgctgctcaaggacctcctctccttactattctggctggattctttgtcctttttgttgtttgttggagcatttggtccattataacgtggctgataagtttaatagttaatgtacctgctccaaaataa

SEQ ID NO: 36238 - DNA, 1704 bp, Glycine max
  Peptide Sequence Number=SeqID_127923
atggatctcatgcttgtaccatattcggccgaccgttctttgaacctcatccagtggccacctttcttacttgctagcaagatcccaatagcagtgtccatggccgaagacagtttagggaaaggacaagaactggagaaaagattgtcaagagacaagtacatgaaatctgctgttgaggaatgctatgcttcttttaaaagtattattaacttcttggttcttggagagcgtgagacaatggttatacagaatatttttcaaagagttgatgtgcacatagaaaacaaagctgtgctgaatgaattgaatctgagtgctgtccccagtctatatgaacgatttgtcaaactgattgaacgtttgttggagaacaaagaggaggacaaggattcaattgtgattctcttgcttgacatgctagagattgtgaccagagacataatggatggagacattgagggccatggtgggtcttatgggaaagatgaaaggttcacaccccttgaaaaacaatatacattttttggcaaacttcaatttcctgtcaaaacagatattgatgcttggacagagaaaataaaaaggcttcatttacttcttactgtcaaggagtcggctatggatgttccatccaacttggatgctaggaggcgtatttctttcttctctaattcattgtttatggatatgccacctgctcccaaagttcggaatatgatgtccttctctgtcttgacaccttactttaaggaacctgttcttttctccctaagtcatctgggagagccaaatgaagatggagtctctatcctcttttacttgcaaaagatatttccagatgaatggaaaaactttgttcaacgttttgataataaaagtgaagagaaactcagagtagagaatgaagaagaacttcgtttatgggcatcatacagaggccagacattgaccaaaactgtccgaggaatgatgtatatccgacaagcattggagctacaggcttttcttgatatggcaaaggatgaagaattaatgaaaggttacaaggctgcagaactagagagcaaggaaagtacaaccggtgagcggtcgttgtggactcaatgtcaatcattagctgacatgaagttcacttatgtagtttcatgtcaacaatatagtattcataagcgatctggtgatcccagggcaaaagaaattttaaagcttatgattaagtacccatctcttcgagttgcttacattgatgaggttgaagagcatagcaaaggctcatcccgaaaaacagataaggtttattattcagctctagtgaaagctgcattaccagcaaaatcaaatgattcatctgaagcagttcagagtttagaccaggtaatttacaagataaagcttccaggacctgcaatattgggtgaggggaagccagaaaatcaaaaccatgccataattttcacacgtggggaaggcttgcaaacaattgatatgaatcaggataattatatggaagaagctttcaaaatgaggaatttgctgcaagaatttctcaaacaacatgatggtccaagaatgccgacaatacttggactcagagagcatatatttactggcagtgtttcatcccttgcgtggtttatgtctaatcaggagcatagttttgtgacaattggacaaagattgttggcttaccccttgaagtaa

SEQ ID NO: 36239 - DNA, 1551 bp, Glycine max
  Peptide Sequence Number=SeqID_127924
atggagatattatcacaaatgtggtctctgttagggttacttaccgttctccagaacgttcttccatcgcagcttctctccttgcttcattctctatacgaatctctgcaagatctactttctccgtattcgtatttcgagattcctgaattcaacggctactgcggcgtcgaactcaacgacctctaccgccatgtgcacctctacctcaacgccgcgaaccacgcccccgccgccgcgtgccgccgattaactctctcctgctcgccgtcgtcgaaccgtatctccttcgccgttgcgccgaaccacaccgtccacgacgccttccgcggccaccgcgtcgggtggacgcaccacgtggagactgcgcaggactcgctcgaggagaggcgcagcttcacgctccgtctcccgaagcgccaccgccacgcgctcctctcgccatacctcgcgcacgtgacctcacgcgccgaggagttcgagcgcgtctcgagagagcggaggctcttcacgaacaacaccaccgcttcgggctccttcgaatcgggttgggtctccgtccccttccgtcacccgtccaccttcgaaaccctagccctcgagccagaactcaagaaacagataaaaaacgacttaacggcgtttgctgacggtaaagagttttataagcgagtgggccgggcctggaagcgtgggtatttactccacggcccaccgggctcgggtaaatcaagcttaatcgcggcaatggcgaattttctctgttacgacgtttacgacttggaattaacaaaagtctctgataactccgagttgcggtcgttactaatacaaacgacgaaccgttctataatagtaattgaagacattgactgttccgttgacataacggcggatagaacggtgaaggttaagaaaagtcagggcgcgaagctgtcgttgaggagtagtaataagaagggccaaacggggtgtgaagagagtgggcgagtcacgctttcagggcttttgaatttcaccgatgggttgtggagctgttgcggtgaagagaggattgtggtctttacaaccaaccacagggatagtgtggaccccgcgctcctcaggtgcggccgcatggacgtccatgtcagcctcggcacgtgtgggacacacgcattccgtgagctcgcgcgcaactacctcggagtggactcgcatgtgttgttcgaggcagtggagggatgcatccgcagcggtggctccctcacgcctgcgcacgtgggagagatactgctcaggaacagaggggatgttgacgtggccatgagggaggtcttggcagcgatgcaggggaggatgctagtcgccacagctgccgctgatcagccggaaaatgaggaggcgtcgacggctgccggagttaggtcgccagagagcgtgctgatgatggggtcgccggagaattgggatgtgaagaggaaggaacaacatgggtgtaataatttggataagaaagtcaagtttttcgttaggttaaggtcgttgaccagatctgatcctggtagataa

SEQ ID NO: 36240 - DNA, 1041 bp, Glycine max
  Peptide Sequence Number=SeqID_127925
atgaagagagaggtgactcaccctcagaccctccctgacgaattgatccatgaaattctattgcgtttcaaaagtgtgcataaatcatggctttctctcatatctgaacccgggtttgctaaatcccactttgatctagccgcggcacccaccaccgacttcttctcaagtgcttcaatattgatcctgaagttgataattcttatgttgatatggtctctaacattccacttccattatctgctatgggaagcatgcatgaacacggacaacaatgatttctttgattttgtcataaccggtcagcgtatacaaagacaaactaatcatgtgtgtatccatcctcaaatgtccggcattgggaatgattcattagctgatgactacgtcgtggcgattctacaattgtcactagatcaagatttgccgtcatatcccaaggtcgattttttttcttcgagaaccaattcatggagtcgcatcgagggaacccttccttgttatttttcagggcaaaaaaatgtcaggcataagttcgtgcacaagttcatgcacatgttcttgaatggagctcttcattggatgattgaatcttataatgatcttggtctaattattgagtttgatgtgagggaaaggagattatcagatattccactgtcacgctatttaaccattgaatgggaatataaattacatcatttgactgtgatggaaggacttgtgtgtttgtgtctctctgactatatggatgatctcggcactactgaaatatggacgatgaaagaatacaaagtacaagaatcttggaccaagttatttgttcttcctaataatagttatcattgtttgcctttgtttgtcctaatacgtttcatcaaaactggtgaaattttgggatcaaatggcgctaacatattattattgagaccttacaacaaaggtgaggagggtcttcagctttgtgcacgtggacaaacacatttttctctaacttgtatgtatagagagagtctgttatcactcccggtggaattttag

SEQ ID NO: 36241 - DNA, 147 bp, Glycine max
  Peptide Sequence Number=SeqID_127926
atgaagaagacaattgttgatggggtcaccatcaccaaagagatcactggagaggagggaggaaagggtaaaggttgcaatgggttcttgggagggggctaccctcagaagaaggttgaaaaatatatcaagatgagtatgtggtaa

SEQ ID NO: 36242 - DNA, 1185 bp, Glycine max
  Peptide Sequence Number=SeqID_127927
atgttgcagagtgacataaaattggtgaaagacattgggttggactccttcagattctccatctcttggacaagaatatttcccaaggggaaaggagccgttaatggcttgggggttgaattctacaacaatctcatcgatgaggttctatcaaatgatttaaaaccttttgttactcttttccactgggacttcccacaagctcttgaagatgagtatggaggatttcgtagttctaatgtagtggaggattttcgtaaatatgctgacttttgctacaagacctttggagacagagtgaaacattgggtcactataaatgaacccttatcatatagcatcaatggctataatggtggcacctttgcaccaagtagatgttctaagtacgttgccaattgcagtgctggtgactcatccattgaaccctacattgttggtcactacttattacttgctcacgaggctgctgccacattgtacaagaaaaaatatcaggctcgtcaaaaaggacaaattgggatcacccttccgactcacttctttttgccaaaatcaaatagtgttgccgataaacaagcagcaaatcgagctctggactttttctttggctggcatgctcgtccagttatatttggtgactatcctgagagtatgaaatcttcagtgggttctagactacctaaattcacaaaagctcaatctgaaggtctcaaaagttccattgattttcttggtgtaaattattacaccacatattatgcagaaaatgctgcacctactgatttggattggctctatatctatccgaagggaattcatcttcttatggtacacataaaggataaatacaagaatccaaatatttacgtcaatgaaaatggcattgctgaagcaaggaatgactcaataccagtcgatgaagcccttaatgatggtatcaggattagataccttaagagccaccttagactccttcttcaagcgatcaaggaaggtgttaatgtgaagggctactatgcatggtcattttcggacagctttgaatgggatgctggttacacagttcgatttggtcacgtatatgttgattacaacaacaatttgaaaagatacctcaagtcctctgcgttttggctgaaaaagttccttctcaacgacaataataaagtcttatcctattag

SEQ ID NO: 36243 - DNA, 567 bp, Glycine max
  Peptide Sequence Number=SeqID_127928
atggaagctgcacaaggctggaaataccaaattttgctttataggagcaagtattcaagagtggttcgatcaacaaagcagggggggccttcaactgctttctggtttcataataaatttcccgccagagttctttgtcttcttattgcacctgtgctttatttcaagagacccaaggtgttcatcaatggcgaagttcaagaatcttgctttgatcgtggtgaccagaaagaagtgaggttgtcagaattggataatacgtatctctttggtctacaaaagataagttttgttgataaattgtttcaagtgccttttgaattggaatggaaccatgtggaggttacatatgaaagtcataaatcttcactatataaaccaaatgttaatctagagcagcatttacaaaacacttatgtccttctttcttttccgaggtacaagaattctaacagagcaatcagaggaggagctttagagagcaccagagacgccaccattgctaacagagaacatttaagcgactacctcgaggtaagggatgagttactcacgcttggagattag

SEQ ID NO: 36244 - DNA, 228 bp, Glycine max
  Peptide Sequence Number=SeqID_127929
atggttgaggagcgtatacaaatacatttaaaaaagaagaagaaaaactcaaactcagtgtctttaccttgtagagctataggttccttttatatcaaactaatcgtacagttcgaggaggaatgtggagttgggggcgatgataacgcggcgggaagaaggtggagagatgacattgggaaagagagaaagggagaggaagagggagaagaagaagatgaaggatga

SEQ ID NO: 36245 - DNA, 789 bp, Glycine max
  Peptide Sequence Number=SeqID_127930
atggcatccttagatattcattcactgcttttattctctgccattttccgtgttattttgattgtgtatggagagtggcaagatgctcatatggaggttagatacactgatgttgactaccttgtcttttctgatgctgctgctttaatggctgtgggcgattccccttataagagaaccacttatcgctattctcctttgcttgcctttcttctcattccaaattcgttcatccatcgctcctggggaaagtttcttttctcggcttcagctgagattcgtcctcagtgttgtctagcatgggcaaagctcttggttgaaaccagaccacacattgagatgaaggatgcaagtgacatcttggttagagatgagggactcatttgttggggatctgcttctgtgagcttggggttttccaatgttggaaccctggaggccccaggcatggagattcttggaagtatgcctatccttgattacaaggatgcattagccatgctggtgatgcttgatgaaggattgccaaagtcttatctacagtcaaggtatgaggctgcaatggaggcagccaaagaggccaaaactaaggcaggtcagggtgatcacaaacaattaaggcaactttccaacacaccctcacatgtagtagggctatgggttcggagtggtaatgcagtcggtgtgggactagacacactctgcataatgaagccagaggctgcaatgaagtggagagtgaattgtaaaagttacttctatgcttatgcttacattgctgagctctag

SEQ ID NO: 36246 - DNA, 90 bp, Glycine max
  Peptide Sequence Number=SeqID_127931
atggctcaatcaaccccacaaataggaaaggcggcgagtgaatatggaagatggcttactcctttattggttgggtattggattaggtaa

SEQ ID NO: 36247 - DNA, 783 bp, Glycine max
  Peptide Sequence Number=SeqID_127932
atgaagaagaaaaatcgcacttatgcctattgtgtagctaagtatggtcccaagtgggtgaagacgaggactattatagatagtctttctccaaagtggaatgagcaatatacttgggaagtgtatgacccttgcactgtgatcacaattgttgtgtttgataatggaaaattacactcactcttatctgcttataaacctgcacacacaaggagccaggaagatgggggaaattcaattggcttgttttgcaaacttatgcacaacctttgtttccaaggatgcactttgtcgatatttcagttggatagtttgaggaaccaagttgctgcaatcactacattgaggttcaaaagggctgaagcaccacttagtaaagaggttgtggagtacatgctagacgcgggggaaaatgtgtggagcatgaggagggggagagctcaatttcacaggattgctgttcttctaaatgttttggtctttgttgctaaacattttgacgagaaaaaaattaccacggtgcttagctacttcatgtttctctatgttgttttctgcccatggataattttgccatcaacgatcttattcctccttttggttgggatttggtgctatagaacatggccaagatatccttcccatacggatatcaaattgtctcatgttgatacaaccactgttgaggaattagaagaagaatttgataatccttttccatctaaatttagtggtgataatctgagaacaagactcacactcccccactcatctttgtggtga

SEQ ID NO: 36248 - DNA, 3054 bp, Glycine max
  Peptide Sequence Number=SeqID_127933
atggctggaaaatcgggcaaggggaggaacagaaaagggtcccataatgcatccagtgcttcagaatctgcagtccattccgatgttcctgtgaaggataatgtggaagtcactttggaatcagcaaaagctgatgctgctgaagttgcagctggaggcgattctattgttgccaatcccgaggtgaaggagaatgaaacagcaactgaagggagccaacaaaagcaaggtgatcttcaactttaccctgtttctgttaaaacacaaactggggagaagcttgagcttcagttgaatcctggagactctgtcatggatgttagacagttcctcctcgatgctcctgagacatgttttattacatgctatgatttacttttgcatacaaaggatggatccactcatcaccttgaagattataatgaaatttctgaagtagctgatattactactggtggctgctccttggaaatggtttctgcattttatgaggatcgatctataagggcccatgttcatcgtacaagggagttgctttccctttctaacctccatgcttcactatcaacatcacttgccctacagaatgagatagcacataataaatctgcaaattcaggagataccttgaaacctgaagttcctgagcttgatgggcttggttatatggaggacatcgctggctcattgggtaatttattatcgtccccattgaaggatattaaatgtgttgagagcatagtgttttcatccttcaatcctcctccaagctatagaaggcttgttggagatttaatttatttggatgtgatcactcttgagggtaacaaattttgtattacggggagtacaaaaatgttttatgtcaactcaagctcagcgaacaatcttgacccaaagccaagtaaagctacttttgaagcaacaactcttgttgctctcttacaaaagattagccccaagttcaaaaaagctttccgtgaagtattggagggtagatcagctgcccatccttttgaaaatgtgcaatctttgttgccacctaattcttggcttggattataccctgttcctgaccacagacgcgatgcagccagggctgagaatgctttgacacttctttatggcaatgaaccaattggcatgcaaagagactggaatgaagagctgcagtcttgtagagaatttcctcatacctctccacaggagaggattttgcgggatcgggcactttataaagtgacgtcagactttgttgatgcagctattaatggcgctattggagtgattagtggttgcattcctccaataaacccaactgaccctgaatgctttcacatgtatgtgcacaacaatatattctttagttttgctattgatgctgaccttgagaagctgtcaaagaagcgtgtggatgctaattcaaaaacttggagctcaggcaattcgcaaagttcttctgataaagcttccactctacttcatggagaaagtcaggttcctaatgggggaaaagatgacggttcaagttcagaagatcttaatggcacagaaattactcaagatgtttctccagaagctcagctggccgagaatgagcaagccacatatgcttctgcaaacaatgatttgaagggcacaaaggcttaccaagaagctgatgttcctggactttataatcttgctatggctataattgactacaggggtcatagagtggtagctcagagtgtcttaccaggcattcttcaaggggacaagtcagactccctcttgtacggctctgttgacaacggaaagaaaatttgctggaatgaagactttcattctaaggtgtcagaggctgccaaacgccttcatttgaaggaacatttagtccttgatggatctggaaatcttttcaaattagctgcaccagtggaatgcaagggcattgttggtggtgatgaccgggtaactcctcgtgatgccaactatactggacctggttctcgattttgtatcttgaggtcagaattaatcagtgcctattgccgggcccaagcagcagagatattgaaatctaaggagaagaatcctcaagaggcagacaatttggtcactgattcccaaaatgctgccgaagctgatcacctggtaaatgattcccaaaatgctgctgatgctgaccagctggtaaatgattcccaaaatcttactgatgctgacaagctggactcaacaaaggaagaaaaaactgaggatgttaaagtgcttgcttctgtgactaccaaagcctctgatggttgcgaggatattgtttttaatcccaatgttttcactgaattcaaacttgctgggagtccagaggaaatagcagctgatgaagataatgttagaaaagttagtcaatatcttactgatgtggtacttccaaagtttatacaagacttgtgtacacttgaagtttcaccaatggatggccagacattaactgaagcattgcatgctcatggaattaatgttcgctatattggcaaagtggctggagggactaaacatctacctcatctgtgggatctttgtaataatgaaattgttgtcagatctgctaagcatattatcaaggaacatgcagggcaacggtctccaggaaaacattccaaagggcaggctcggtggaaaggcagggcatctttaagaaagactcaacctttgtatgcgagtatcagctcggaagttctttggtcagacattcaagaatttgcaatggttaaatataagtttgaattacctgatgatgctaggtctcatgccaagaaaatttctgttatacgtaatctctgtctgaaggttggtgtaactgttgcagctcgtaaatatgatcttagttccgcaactccattccaaacatcagatgtcttggatatccgtccggtggtcaagcattcagttccttcctgttcagaagccaaggaacttgtggaaactggaaaacttcaattggctgagggcatgctcagtgaagcctacactttattctcagaggcattctcgattctacaacaggcatga

SEQ ID NO: 36249 - DNA, 852 bp, Glycine max
  Peptide Sequence Number=SeqID_127934
atggacatcactgccttcaaatccctcaacattccatttccaacctttccatcaaaattttctccttttcgtccattcagtttctttcacttcaaaccttttcgcactccttcctcacctcgcttcatctcccattgctctctcaatgggtcagcagagataacaagcaaggaaggtactttgcctcgtggcgttggagaggcagtgaatgaagcgtcaagttccaagattcttcaggttgtgctcgtgtcccctcaggacctagccgagttggtgaagagattggaacttgactatgggctatgtctccttccacttcctgtaaggatacatgaagtcggaaccaagggtattgttgttaagtgcatgctagatgagagtggagcttttgttgatagtttacaaaaatattttttctttgctaatgcgttaaacatattggatatgctgtcaatgctagaagagttttcgagagcttctctactggaagtttttccagtagagaagctctcaaaagctcttctacctttgtatccaaacagtgttaatactactgcccaagaccttacaggggatgaagaccatcctgtccaaatgtatgagtgtgtgcagttgtttgttacagagataatgtatgtgtgtgtgggtcactgggttggttacaaaagtggtgatagcattggggttatagggagagagtatgagagtaatgagattccaggaaacactgggtgcattgctagaacttgcgcagcatcagctgttggattacacttagttgggccattaggatttcaggtggatgatactaaactaaagcgtgctgggttggattactggccgtatccatga

SEQ ID NO: 36250 - DNA, 369 bp, Glycine max
  Peptide Sequence Number=SeqID_127935
atggagaacggtttccatcttcctcatcaacagcctctccatgcacaacacgaccaagtacaaaggttggggatccccttgacgaagtcccttttaggagcaaagctatatattcgtaggaaatatcggaggtctaggaaacccaaactcaagcaaagtagcacggaggaagttccaatccagactgtcatatcccttttccaagtcaagtttaaagaccacaccccctttcttctttttggatttagccatagtatgaataatttcttggagaataacaacattgtccatagtccatctctcaggaataaaactactctaaagaaggcttaccaagcgctgaagaaggggtctcatcctgttcactaa

SEQ ID NO: 36251 - DNA, 663 bp, Glycine max
  Peptide Sequence Number=SeqID_127936
atgcttcactggttcgatttgttcaacctaggctccaatttcgttattataggctcccacaccaccttccttctcggattgatacctattgccaaccctagatggaagcagtttaaatcagacctcacgaggaaatgggcccttgcagccgatcaggacggtgtcgaggacactgtctgtgagaaatacgacatcagcaaggaaaagtgggcccagttttgtcacactcgcagagacccttcttgggaggatgtgcgcaagaaggcacaggccatccagaagcagaatactaccccccatgttttgtctcgtggggattatgattatttggagcagaagctcctggctgagaagatgaagaagaagctggaggaagctgcacaatcaggaagcgttgatggcatcatcgaccctccatccccggtcagacgccacgtgaagtggaagatggcccgcacgaagaaaataggggagatgacgactgaggccgcaaaggaaatcgctgagaagatcgatttctttaaggagcaggccacacagggatccttcgtcccccatggacgtcaggatgttctcgtcgctgctattggacgtccagagcaacctggacgtgtccgtgctactggagtcggtgtcaccataaacgggggatgcgcgtctaga

SEQ ID NO: 36252 - DNA, 504 bp, Glycine max
  Peptide Sequence Number=SeqID_127937
atggatgacattactgcaattactattcagcaccagatgcaggacaccatggtttgcaaagctgatcctagtggtttctattccactaagtcagaatataggctattgatgactttcaacagacctattcctcaaaggaggattttgcagactattgaagcatgcaatgcacacaaaaaattctctatagagactaaatggggcactatgatgggcagctatccttttttagaagaacaaccaattccgcttacagggagaagtcatgtctatagctttggagtggtgctgctagaactactaacagggagaaggccagtggggaattttggggaagaaggtatagacattgttcaatgtaccaagttgcaaacaaattggagcaatgacaaggtggtgaagattcttgatgagaggctatgtcacattcccttagatgaagcaaagcaggaacaaagtgtggagagaccaaccatgagggaagtggttgaaatgcttgcataa

SEQ ID NO: 36253 - DNA, 408 bp, Glycine max
  Peptide Sequence Number=SeqID_127938
atggcatcctttagccagatgcaatcccagattcagtcgcagatgcaatctcagggacttgcactgcctcctaaccctctggttggtcccttcggtccttgggtgagcacaaaggggagttgtgttgatcccttaggaaatgatcctgagacgagtgactctgataggtgtggcttgtacatagaagcagatcctgcccgcctggttgccatggggagagtttatgagggatccattgtagttcataacactcctttgttgcctggccaagtaaaggtgagtgtggaggaggttacagatgcagatgctccagttcctgtacccactgatgaggtttccttagtgggccaggcacttcacaccttccttgcttggccgacacatctggtcaagtctttatcacagcag

SEQ ID NO: 36254 - DNA, 306 bp, Glycine max
  Peptide Sequence Number=SeqID_127939
atggtatttcttggataccatgagacaggagggtacaagctatttgatccaaggtccaagcaaattgcaattagcagggatgtggaatttgatgagtttaaaaactggaggctagaacttgagtctacaagcaggaatgcaagattcttgattgaagcagattacagtggtaataatgttgttgtaacagctgtcacacctgaccaaggaattctgagaaagtcaacaagagtgacacaagttccccagagtttgagagattatgaagtctataaagatgatcaaatcactgaaggtggtgaccta

SEQ ID NO: 36255 - DNA, 380 bp, Glycine max
  Peptide Sequence Number=SeqID_127940
atgggtgatcaagaggagacgcaggaacagatgaaagccgacatgtcggctctgaaggaacaaatggcctccatgatggaggccatgttaagtatgaagcagctcatagagaagaaacgcggccaccgccgccgctgtcaggacacgctggggcacgatggcagccctcacctgggatacaaccgagcggcttacccttatggattgccgcccaactattccccccccgtcttgcaagaagatgcgggccacattgcttctcccgtccatgaaagagagcctcctcagcagcccgacgaagtccataaagaccctcaagattatgctcgaagggatgtcgagttctatcccccgatccccgaagggccggccccaggcac

SEQ ID NO: 36256 - DNA, 567 bp, Glycine max
  Peptide Sequence Number=SeqID_127941
atggtacaacaagctgtaattgttgggtttggttggtggccatgggtgaaaataatggagggggattcagtcatacacacagtggcatatgcagatgatgttgtcagggtaagtgtagaaacagttattgatcctgaggctgaggtcccctatgccacgtcagaaatacaatatgtgaagcaggccgtcgatacatttgtagcttggcccacacaccttgtgaaagctgtattagatgaggttccacaaagtattccacacaacgaggatgcacatgtgccgaagccgactaatgtggacgcagatgatccgttgcgtggattgataaagtttcttggaattgtagatgcatctgcatcgatattcattacatattcagatgttagtgaaataatagcaggagacaaaagtctgaacatatctgtcatacaattatggttaatgtatattcatgagtggagtcagatattcagtcaaggtttcatgtatgcattccttgagccacagtcgttgatgaccttgtctcctgaaactaaggcagttgcacctaagtggattgaagtaaag

SEQ ID NO: 36257 - DNA, 447 bp, Glycine max
  Peptide Sequence Number=SeqID_127942
atgtcgggacgacacagaccaactgatacttttgcaggggggagattggcattgcggtcgctgggcagaatgttgctaagtagcaatgtcatctatatctgtgtaagagtggtcatgttggtgcgcatgatccgcactcgtctctttgcagtggcacgggtgaaatcttgccccggtatgcatagtagctgtgtgatagcctccctctctggttgtgttcgcacagttggccctcctccaatatcagggggtggcccaggaaccgtgcggatgtggagcacactgaaaatgaggacacgtagccctctaaaggtgagggcgtgcagccctctcaaggcgaggatgtgtagtcctctggaggtgagggcgtgcagccctctgttggcgaggacgtgtagtcctcttcaaggtgagggcgtgcagccctctattggcgaggacgtgtag

SEQ ID NO: 36258 - DNA, 1035 bp, Glycine max
  Peptide Sequence Number=SeqID_127943
atgctagccgacctatatgacaccttcgaccgaagatgtgagaagagcagtacgaggattgtttgttgtactccagctctttatgtatggttggtttcacacctttttcgccaagaggtaaggcatgcttgcccgctagaaagtcaccgctcatgcatagagaaagaaggagcaaattgggaccaactcttagcaagcaaagaaggagcgtctgtcaactggttccctcggtggaaagaaggaagaaccggagttcttatttcatgcggaggatttccaaatgttcccttgatggggacgaggggttgcatcagttacaatctcgttcttgctataagacaacttggctaccctatgagaagggcgccactagaggatgagctcgtgcctgtcatttcacaaggtttcaataagaccaatatggagacacttcagaaggtccgcaaggcatgggaggtgttgcaaaagaaggacaaggaactcaggggctgtaacaatgggcccatcggtggctaccgtaattggttaaaagcccatgtgcaaggtttggtttggcttccgagtttgagaaccgataaaagagaggaagttgaggcaccggaggaagacgaagaggtgcaagcccttagggcggaactcgagcaagcccaaacagtcaaagaaaggttcaaatcagcagctctaaagatccaaacgaagaatgccgaactgagagatacaaatatagctaccaccaaggctttggaacgagagaccaagagggctcgtagggaagaacacggccggaacaagttccgaggggctctgtggggcagtaatagcgagcttaagttccggagagaggaaagggaccaatcacgagtagacagtttgatcttgagagatgagttgaaggcttgctcgaggtccaagagaagtttgtctcagcggttatgcgagacagagaccaacatgttagctatcatcaccaagtaccaagaagaattaaatctagccacggcccacgagcatagagtggcggacgagtatgcctaa

SEQ ID NO: 36259 - DNA, 441 bp, Glycine max
  Peptide Sequence Number=SeqID_127944
atgcagctaccgcaaaagcccttgaacaagaaaccaagagggctcgcaaggaagagcatggccgtgaaaaattccatggagcgttgtggggcaacaacacgtttatgcgagacagagaccaatatgttagctatcatcatcaagtaccaagaagaactaagtctagccacgacccatgagcatagggtggtggatgagtatgcccaagtgtacgcggaaaaggaggctagaggaagggtgatcgactcgttacaccatgaggcaaccatgtggatggaccgatttgctcttaccttgaacgggagtcaagaccttccccgattgctagccaaggccaaagcaatggcggacatctactccgcccccgagcagatccacggacttctcgactattgtcagcatatgatagatttaatggcccatataattaggaaccgctag

SEQ ID NO: 36260 - DNA, 629 bp, Glycine max
  Peptide Sequence Number=SeqID_127945
gactacatgtcctcgcgttgagagggctacacgccctcaccttgggtactacttaccctcaccgtcagaggactacacgtcctcgccttgagaggactacacgactacacgtcctcgccttcaaagggtcatgtaccttcaacttcagaggactacacgtcctcgccgtcaaagggtcatgtgccttcatctttgtagggctacatgccctcaccttcagaggactacacgtcctcacctttagaggactacacgtcctcgcctcagaggactacatgttccccattttcaaaggggggcatgccctcaccttcagaggattgcacgtccttgccatcataggactacactccctcgtcttcgaaaggcgacacgtcctgaacttcagagggctacacgccctcgcatttagaggactacgcgtcctcactttcaggaccagtagtttccttttaatggttcctgggccaccccctgatattggaggagggccaactgtgcgagcacaaccagagagggaggctatcacacagctactatgcatactggggcaagatttcacccgtgccgctgcaaagagaagagtgcagaccatgcgcaccaacatgaccactcttacacagatatag

SEQ ID NO: 36261 - DNA, 267 bp, Glycine max
  Peptide Sequence Number=SeqID_127946
atggctgaatctcaaagaagaaacagtatcaattcacagaaagatcttccaatggcatttgcatggaataagtttgatagattggaagtgcaagatgtcacctggtcaatttttggtcacttgcacgagactgtatttgaaggagacattaggtttgaagaggaggataagccaaagaatcaggcaaatctggctttacaggtgaaggcagattctgaagctgtatatctcatggtgcaaccacaagtttcaaggaatctccattga

SEQ ID NO: 36262 - DNA, 342 bp, Glycine max
  Peptide Sequence Number=SeqID_127947
atgaacccccctgttgtaggcaaattctacatgaggaagatactcatcccaagacttatggttgctgtcgcaacctacccttcgacgggagggcgacgtgagggctcacgggtgcgtcttccaagaaaggaaaatgcacggagtcgccaccaacgtttattcgaggaaaacatcgaaaaaaccgaaaaaagacgtggtctgcgaactttaagtgtgaaaggttcaggagttgtatttacgcacggggaagtgacaaagttatgcgttggctttaggctttttcaaaagtccacgtttaaccaaataaaagcaaagaggaccattcaaggcgttggaccttaa

SEQ ID NO: 36263 - DNA, 480 bp, Glycine max
  Peptide Sequence Number=SeqID_127948
atgaatctggggatccccacggtcatgtggctccgcatgccaccggtctcttgggacacggtaacaaaaagtggggtgatcgacaaaagcagggcttttgctcctacaggaaacactgggtccaacaaagataggagaaaatcactcaaagtgtatcaatctcacacagtgcgtggcgagaaagtcgctagcgcacaagattttgtcagcaatcaaagggagaggaccactttaggtcgtggtttcctttttcttggttacttggtgacaattctgtactgttcagatattgtctggtccaaagacctttctggatggcaaggattgacattctcaccctgggtcaaggtttatgataagttgggattttggctcaaggcttgtagaacggctggtcatgatatatgtcagggtttggccagcggttcagggataaaggggatgtcctacattatttccatgatacacatgcaacaatga

SEQ ID NO: 36264 - DNA, 285 bp, Glycine max
  Peptide Sequence Number=SeqID_127949
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccgggccccccctttccgctgttatgggacgcgtttgtctcattccacgcttga

SEQ ID NO: 36265 - DNA, 513 bp, Glycine max
  Peptide Sequence Number=SeqID_127950
atggctaacactgcggctagacaagtggaagagcgtgtagagattgaaacgtatcaagaaagcatttttcaagttacctccatccatcatcagatgatcactgaagaggaaacgtttgaagtctccagtactccagaatactcctgctcggccgctgttggctatgccatgaaacattcagatataggtgatgcttgttctaaggaggaagaggtggaacatgaaatagtattaacaacttcaaccatgatacaacattttcctttggaaaaagaattgggtgatgagatagacaacttagtcgataatgaagagtgtgatgatctgaaagacaattgtgttgatcgtgtggtttttgaaaaattggagaaaatgagaccaccagaaaagcccagagcagaattaaaaacccttccaacacatctaaagtatatattcttggaagatgacgagactaaaccggtcataattagtaactctttaaagaaggaagaagaggatcaactggtgtag

SEQ ID NO: 36266 - DNA, 657 bp, Glycine max
  Peptide Sequence Number=SeqID_127951
gtcctcaccatcagagggctacacggcctcgccatcagaggactgcatgtcctcaccttcgtagaggctacacgccctcaccttagaggaccacacatcctcaccttcagagggctacacgccctcgccatcagaggactgcatgtcctcacattcttagggctacacgccctcacctttagaggactacacgtcctcgccaacagagggctgcacgccctcaccttgagaggactacacgtcctcgccttgcagaggactacacgtcctaaccatcagagggctgcacgccctcacctccagaggactacacgtccttgccttgagagggctacccgccctcgccttggagggctacacgccctcgccatcaaaggactgcatgtcctcaccttcttagggctacacgccctcacctttagaggacacacgtcctcgccaattcagagggctgcacgccctcgccatcagaggacatgtccttaccttcgtagccctcgctcagaggactacacgtcctcagagtccttgagaggactacacgtcctcaccatcagagggctgcacgccctcacctccagaggactacacatcctcgtccttgccttgagagggctacccgccctcgccttgggtactagttaccctcacctttag

SEQ ID NO: 36267 - DNA, 225 bp, Glycine max
  Peptide Sequence Number=SeqID_127952
atgggtaccttagagccctacactggggcaatgaaaggcacaatgcataaacctcaagcgaacctaagggccgattaccccctcctcacccaatgggttcccagctacaaggtcatgacgaaagacaacgattggtacctcaaagccttacactggggcaatgaaaggcaccatgcaaaaacctcaagtgaacctaggggcagattagaagttctcacccaatag

SEQ ID NO: 36268 - DNA, 102 bp, Glycine max
  Peptide Sequence Number=SeqID_127953
atggcagcagtggtagtgacaactgatgacaatggtgtcatggtggtggtagcgacgttgacaaaggtgatggcggttgacaatggtggtggtgacggttga

SEQ ID NO: 36269 - DNA, 198 bp, Glycine max
  Peptide Sequence Number=SeqID_127954
atgcaatttgggatgtgtcgcaaccgacccatcggcgggagggcgacgcgagggctcatggctgcatcttccatgggaggaaaatgcgcggagtcgccaccaacgtttattcgaggaaaacgtcggaaaaaccggaaagggtgtttcccttgctcctacgtattcctcaattgtgataaggaaatcagacctacgtag

SEQ ID NO: 36270 - DNA, 360 bp, Glycine max
  Peptide Sequence Number=SeqID_127955
atggtggtgcttatgggatatgagtggaaatggtgtgagtttttgggttactcctttactggaactaatccaataagaattggcattccttcgggatgtggcatggagaaactcaaggatttaatcaaacaagttgcacctacaggggttccccctaatggaattcacggatcacaattggttagacgattattctttcgacaaccaggtcattctaagtattccgaaaatttgattgaatatgacataacagaattgaaaaatgatgaagacgtgctaaaagtgttagcacaatccaactattggaaacgattctgcacaatagaaattttggctatttttagcaaaccagtaatctaa

SEQ ID NO: 36271 - DNA, 346 bp, Glycine max
  Peptide Sequence Number=SeqID_127956
ggtggacccttgggtacacgccctcaccttcagaggactacacgtcctcacctatagaggactacatgtcctcgccatcagaggactacacgtccttgccttcagagggctacacaccctcaccttcagaggactacatgtcttcacctttagagggttgcacgccctcgcctttagagggttgcacaccctctcctttagcgggctggacaccctcgccttcaaagggccaccccctgatattggagggcgaccaatggtgcgagcacatccagagagggaggttatcatgcagctactatgcataccgggacaagatttcacctgtgctgctgcaaagagatga

SEQ ID NO: 36272 - DNA, 86 bp, Glycine max
  Peptide Sequence Number=SeqID_127957
gttacgcatacacggagaagatgcactggcgacatcttggggatattcgtgggaataagcctagtgcagctgaatggcttgattaa

SEQ ID NO: 36273 - DNA, 300 bp, Glycine max
  Peptide Sequence Number=SeqID_127958
tctagccaagtgaaggttggtgttgaggaggttagagatgcacaggctctcgttcctgtatccactgatgaggttaccttagtggggcaggcacttaacaccttccttgcttggctgacacatctcgtgaagcctttatcagaacagatcttgaagcctttccaggttaactgggatgctaccgtgttcggggtgtttaatccagacttcccgctgtacataaagcacgaagatctctctgaaatcacacacggtggtcaatgtctcagcatatctgtcttacagttgtggattctgtaa

SEQ ID NO: 36274 - DNA, 666 bp, Glycine max
  Peptide Sequence Number=SeqID_127959
atgggtgatcaagaggagacacaagaacagatgcaagccgacatgtcgactttgaaagagcaaatggcttccatgatggaggccatgttaggaatgagacaactcatggagaaaaatgtggccaccgctgcctctgttagttcggctgccgaagcagacccaactctcctagctactgtgcactatcctcccccaaacgcagtaggacgagaaatgagcacattggggcacagcaacaacccccatttgggatacaaccgggtggcttacccttatggattgccgcctaattacacgccaccagtcatgcatgatgatgcgggtcatgtctcttcccccatccttgaaggggagcctcctcgacagcccgacgaggtccacaaggatcatcgagtgtatgcccaaggggatgtcgatttttaccccccgatcctcgtcgaggggcccccggcacccaacacattgcctcagcacaacctcacagcacagccaatattctggtccatagaaggaccacccccgacggcggaagaaagaaggaaactcgatctcattgaggagagattgaaagttgttgaaggctttggtgactatctgttcgcgaacatgacggatctttgcttggtaccggatgtcgtcatcccccccaaaattcaaggtacctga

SEQ ID NO: 36275 - DNA, 540 bp, Glycine max
  Peptide Sequence Number=SeqID_127960
atgacaccaaccccaatcaactcctcccctgatcatgagttctccacctgcctcccctcctcctcctcctccttctcctcctccttctcctcctcctcctgctccttcggacgcatcgacttccccgtctgcctaaagcggacatgcaaagcctcacgtctacgatcgttgtctactagaccacctggtgctgagagaccagtggtccatgttgatccagctaccggcaaggtcgacggtccccacatggagaaattaagaacatatttggggattgtggcacgtgataaggtggacgtgacctacgagaactggaaggaggcggaatttgatatcccagaggcttttgaaagtaggacgaaaaggaagttacttcagaccgtgggcgagagatggaggcagtttaaatcagacctcacgaggaaatgggcccttgtagccgatcaggacggtgcggaggacactgtctgtgagaaatatgacattagtaaggaaaaatgggcccagttttgccagtctcgtagagacccttcttgggag

SEQ ID NO: 36276 - DNA, 570 bp, Glycine max
  Peptide Sequence Number=SeqID_127961
atgggcgtggacttcgcctacatgggcacgcgcttcatcgccagcgaggaagccaacgccagcgaaggctacaagtccgccatcgtcgaggccagcgcctcggacattctctacaccccgttcttcaccggcatccccggcaactacctgaaggccagcatcgccgccgccggcctcgatccggccaacctgccgcagcccggacagcggcgcctccaatttcggctccagccgcgtcaagccttggaaggacatctggggcgcgggccagggcgtgggcaacatcggcagcgtgcagccgacgcgccagatcgtcgacacgctgcgccgcgagtacgccgaggccaagacccagctggccgccaggaccttcgcatgagcgccgggctgcgggtcacgcgcgacggcgcggtgctgacgctggtgatcgaccgccaggaccgccgcaacgcgctcgacacggccacctacgccgcgctgaccgaacagctcgcgctggccagcgccgacaccagcgtgtcggcggtgatcctggccggcgccggcgaacacttcaccggccggcaatga

SEQ ID NO: 36277 - DNA, 282 bp, Glycine max
  Peptide Sequence Number=SeqID_127962
atgtcacacggaagtccgattcgggcgcataataaattgagacgctcgaaattgaacaacgaatgctctcgaggaattccaatgatcataactgtcgcaacctacccttcggcgggagggcgacgcgtgactcacgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcgtggggaaggtattag

SEQ ID NO: 36278 - DNA, 202 bp, Glycine max
  Peptide Sequence Number=SeqID_127963
atggctttcactcttatccaaggaaggaccaagcccatggaattttgggggctgcacattcaaaacccaaggaagataagggagactacttcttgcccttcttctagtggaagtgaagatgaagtgaggggtgaagagtctagtgggaaagtctacccacatgaagaaggtgacctcttaatggttagaaggcttcttggag

SEQ ID NO: 36279 - DNA, 358 bp, Glycine max
  Peptide Sequence Number=SeqID_127964
atgagtcttcattcttcatctagtgttaatggaaggcatagggcacatcatagacctcactcccattggagagaaaaggaaagaaaacttgaagaggctaacattaacctcctatacttccatgggaaagacaatgtagaggctaacttagattgggaaataagggtagagcaacaacttaaaagaatgtctacttcaaaatcttatggctctcactcttatcaaaagaaagaccaaggtcaaggcatcttagggatgacaccttctaagccaaaagatgataaggggaagacaatagaaaagaaaccccttaaggctagtatgcaagagaagactagctccataaagtgctttaaat

SEQ ID NO: 36280 - DNA, 141 bp, Glycine max
  Peptide Sequence Number=SeqID_127965
atggaagagaatcttgcttgtggggcttctatggaggctggatctttgagcttcaatgaggtggctttaatggtgattttccaccatggagatgcagcggaagacaaaggagaagaggtgagaggaggcaccatccactaa

SEQ ID NO: 36281 - DNA, 354 bp, Glycine max
  Peptide Sequence Number=SeqID_127966
atgtggattctgcatatgactgagataagtctgcgagcggggaatgccgatgtgtatggattcctcgagccacgatccatacagagatctgtgcaatcacaatttgaatcagaaagttatattaagaactggatgcagaattcaaagaggggtgtgtacctaggagcctacttgaatggtgctttgaaagaatttgatgatactccacaaagtaaatccaaggttgctgctaggtggattgctgttagatatttcaatgatgctaaaccattgaaactagagagattgaaggcgcttcgtatccagtgggcaagctactatttgaaagttaaaaatgaaacaattagtatttag

SEQ ID NO: 36282 - DNA, 171 bp, Glycine max
  Peptide Sequence Number=SeqID_127967
atggataagagcttgaaggtaggagaagatgacttgagggagagggagagaagaggcacgaaatttatgcctcaaatgagcccactaatccaagatcaagtccaagattctccactaagtgtccttaggtgtcatgaggcatgtaaacaccaagacatgcacaaagtgtga

SEQ ID NO: 36283 - DNA, 417 bp, Glycine max
  Peptide Sequence Number=SeqID_127968
atgcatgagtatcatatacccttttgcttatgttcggtaaatattgtcatactgtgtacattcccgcattgtgtcttttgcataggcattgcatatgggttcttcttgatccctactgtaaacaaaccaacggagggtccgtgtcgccttcttaaaaacgtgcgttggggcattttgctacccctagacgtcgtatctaagaaggggacaaattccccggacccccgcattcctagattgcatctgtgtcatatgcattccatcatgcattcatccatcccacccatgagatatcggagttttgatttgcaccagcttttgtctcactttaggcggttgatggaacccctccaaatgcaagccttccgcaagacttacggaaagatcttagagttgaccatagcagagtgtccatag

SEQ ID NO: 36284 - DNA, 192 bp, Glycine max
  Peptide Sequence Number=SeqID_127969
atgttaggcttagcaggcacttgccagatggcttctaggaaatgcaagagtattggttcaagacccacaacacaatatgatacaaggagattttactcctttgatgctttgaaccgatacatggataatatcttgggaagaaacattgtgccagaaaggaaggtggagattgttggatcaagtggcctctga

SEQ ID NO: 36285 - DNA, 320 bp, Glycine max
  Peptide Sequence Number=SeqID_127970
gagaagaagcaaagacttgtgaaatgctcgagtgcgacgaagatgatgctcgagtgcgacgaacacgatgctcagatgtagacagggaccttgaagtaaaggtgggcgtggaggaggttaaagatccagatgttcccattcctgtacccactaatgaggtttccttagtggggcaggcaattcacaccttccttgcttggctaacacacctggaagttgtgtctctggcaaaaccacctcaaaacacagatccggaggtcgatgatctgctttatctgatgacaatgaccatcccagagcttttcttggggccttactag

SEQ ID NO: 36286 - DNA, 321 bp, Glycine max
  Peptide Sequence Number=SeqID_127971
atggcggtgatggatctcagccttggggatcccttgtatcgaaagtcttcctggcggttttcttatgtggtggctcgtggtccacaggaatctccctggtatttcttcccatcgattttttcccaacagtggtatcaagagttagagtggagaagagtcatgcaagaagagatgcaatccttgcatgagaataacacctatgaattggtggagtggagaatagccatgcaagaagagatgaaattcttgcatgagaataacacttatgaattggtggtggagaagagccattcaagaagagaagcaatccttgcatggtga

SEQ ID NO: 36287 - DNA, 396 bp, Glycine max
  Peptide Sequence Number=SeqID_127972
atgacaatcaccgctttaggagcgctgtacaccagcagcgcttcgaggccatcaagggatggtcattttctccgagagcgacgcgtccagctcagggacgacgagtatactgatttccaggaggaaataggtcgccggcggtggacatcactggttactcccatggccaagttcgatccagaaatagtcctcgaattttatgccaatgcttggccaacagaggagggcgtgcgtgacatgaggtcctggagggtcaagagtgcgagtatggctagaggaggaaccggtctgatgggttcgatgaggaggccatcgctcaactgctatgtatactggggcaagattttgcccagactgctgcagggaggcgagtgcgaatcatgcgcaccaacatga

SEQ ID NO: 36288 - DNA, 387 bp, Glycine max
  Peptide Sequence Number=SeqID_127973
atgaagtcgctgagaggaaaagagatcgcgttggtgaaagtgcagtggggaccaacgaggggtttcattctaagcgttttgatatatatattgcctactttcgaaaatgggcctcgacgggtgcagagaaatgcgaggaactggaaccagagagatgacacgcaaaccgaggcagaatttcagcatccaaaaggtcaaaatttttctcctttgtggctgagtatgaagtcaaataaagggataaagaaatttcagcagctcttcttctcccttccacgtagcttttcttcttccttcttctccaccattgaagcctccattgaagctccaaaattgctcatcatttctactccaaattgcaaagagaagccattttcggagtcttga

SEQ ID NO: 36289 - DNA, 189 bp, Glycine max
  Peptide Sequence Number=SeqID_127974
atgaggacgcgtagccctctaaaggcgagggcgtgcagccctctgcaggcgaggacatatagtcctctaaaggtgataggtactagtacccaagggttcacctttatgagaaagcaagagatcgactcatcgagagggcagacgcatgcaacctttgttgtgaaatttggaaatgctgaccgcacatga

SEQ ID NO: 36290 - DNA, 412 bp, Glycine max
  Peptide Sequence Number=SeqID_127975
aaaaaaaagaaggagtagagatgagagtcgtcatggactaatcacagaaagggtaagtaaagcggggcagctgtcataccctaatttcgtccggggattattacttgatgacatgcaacctttgattggtcgtttcaagatacttggcaccctttgttgcacaatatgtaagtctcgagacatgccggaagtcaaaaggaagcagggttatgtgatccgtgcccagtggagtcgccaactgtcgcaacatgcccttttgcgggcgtgcgaggcgagggtcacgggtgcgctttccaaaggaggaaagatgcgcggagtcgccaccaaagtttatttgtggaaaacatcggaaaaaccgaaggaaaccggtcaaaatgaaaattctaagttcgggagttgtatttacgtttga

SEQ ID NO: 36291 - DNA, 252 bp, Glycine max
  Peptide Sequence Number=SeqID_127976
atgcatattgttgtggtaaaacaggggcaggatcatcttgagctaccttctggggtagggacaaaacatgaacatcagaaaccaatcaaggtacttaggaacggatgcaagtggggatggggtcacgaccgaccgatcgttgcccctttctctgcactaaacaagcagagaatgtcgcgcaaggcagcccagtatcctttgaattcgcagtattttactaccattgtttgttttttagtaattaacgcctaa

SEQ ID NO: 36292 - DNA, 366 bp, Glycine max
  Peptide Sequence Number=SeqID_127977
atggctcatatagtagtcatgactcttgcaagagcccaagtgaagaacttcatgaatattatgaaggaaggaataggtcacattttagacctcactcccataggagagaaaaggaaagaaagcctcaagaggctaacattaacctaccatacttccatgggaaggacaataggacacattacttatcaatgccccaccaagaaaatcatgattatgaggggccaagacacttatagtagccaagatgaggctactacttcaccttcctctagtgaaagtgaagaagcaaaaggggaagaatctagtgaagaaatctacccccaagaagaaggacaacctttaatggttaaggaggagtgtaaggag

SEQ ID NO: 36293 - DNA, 228 bp, Glycine max
  Peptide Sequence Number=SeqID_127978
atgatatattatggggcctcaattggacatctgaggcaaaacgtttgcccgtcagaattcgcccgagtgttccttgttgatttccgaatttcgcccgagtcttccttgttgcttcctgggagtctccataggtttctggccttatgcggagatccaaggaaagggtatggccgtttgtatttacgatgggcttcatttttcaacaacgacggtctcaacatatcataa

SEQ ID NO: 36294 - DNA, 426 bp, Glycine max
  Peptide Sequence Number=SeqID_127979
atggataatgaagagggcgtgcaggaacagatgaaggccgatctatcggccttaaaagatcaaatggattccatctcggaggtcatgtatagcccgcaagcttacccctatggcttgcctccagacttcactccccgtgccaccccagaagatttaagccaagcccctaccttcgaggggcaactcccaccttatgacgactatcccgggcaagacgatgaggaaggagatacccatctcggccccctgctccatctcaaagatccatccccccatgaactaccccaaccaaacatagtccgtcatgtctcggcttcacccacacccgtaaaagaatctgttcccttcgtgaaagataagggaaagattgaggcgcttgaagaaaggttaagagcagtcgagggcctcggcaattacccattctag

SEQ ID NO: 36295 - DNA, 624 bp, Glycine max
  Peptide Sequence Number=SeqID_127980
atgattccgatgatgctccgcagcgatgagccagtggtccctgcgccagatgttcaggatggcccgatggaggcactagctgctgtagaggacattgtggcagacattcctacggacacaggcacaaaggctgctgaggatgagcatgagggattttcgagtggtccgagcgacccatccgtgttgacccagtatgcggatcacgttgcttgcagcgtatggacgaaagaggagcgtcctgaattgaagctatcctctcatgggaggaaggtccatagtttaggcagacctgtccctgccattgaggaacttgttgctggtacaggactaagtcctttgatcgcgtgttcggtagacaccggcgatcggggacttttgtccgtgtttgtggagcggtggcaccgagagatgtctagtttccattttctagtgggagagctcaccatcacgctggatgacatctcctcgcttctccatcttcccgtgattggcgacttacacgcttttgagcccttgcacgtggacaatgcggttcagatgttggtggacttattgatggcctttgcagagtctgctagggctgagacagcccagtgtcgtggaccgtacgtacgcttgcaatgg

SEQ ID NO: 36296 - DNA, 654 bp, Glycine max
  Peptide Sequence Number=SeqID_127981
atggcaattccattcaagacaaaagatgtcaacgaggaagaagcttcgccaagtatccccattgaaaaacctttattcaaacctttcaaagttagtgagaaggctaaacgaaaaattagggaacttagaaaaactaaatccttaattgaaggcgtaggtgataaccatagtgaattacttaacaagattggtagtttacttaaggtcattccagatactccccaagcctcggaaaatacttccaaaatggtaacaagaagtacctccaaattaattaatgttattaatgaagatagtgaccaaaactcagataacacaactgagataggatcagtgtcagaaaagaatataaatccaattaattccaaacactggaaaacaccctccaaattatattatcaacgtccaactgcccctgacctactattagaggaaagagatgcacaaacggagtataacatcatgaatacactccaacatatgaccatggtagccacgacttaccaaacctcccatgaatgttcagaagaaaccattatagacatcttagtggcaggattttctggacaactgaaaggatggtgggataattatctcactaacgaagaaaagtcaaaaatttacagcgcagttaagacagatctcaatggaaaa

SEQ ID NO: 36297 - DNA, 843 bp, Glycine max
  Peptide Sequence Number=SeqID_127982
atggcgcttgccgccccggcgggcgatctgccgctgatgccgtggcccgcccatgtggagcgcccgcaggcgcagggggcgttggcgctaaataatcagctgacgatcaacgtcagcggcgacgatctgggcgaggcggcaactcgctggcgtgaacgtgttgcgcggcaaaccggctggacgctccagccgcagacggcgccggcgaaaagcccaaccattaacgtgatcgtcagtaaaaaagtgcctttcctgccgcagccggatagcgacgaaagctatcagctaaccgttaacgcagacggcgcgaccctgaaagccaatacgcgttttggcgcgctgcgcggcatggaaacgctgctacagctggtacaaaacggtcctgacggcaccaccattccttatgtcgccattgacgatgcgccgcgcttcccgtggcgtggactgctgctggattccgcccgtcactttatgccgctgtcggcgatcaaacggcagattgacggtatggcggcggcgaagcttaacgtactgcactggcatctgaccgacgatcagggctggcgtttcgcctccagccgctatccgaagctgcagcagcaggccagcgacggcctgttttatacccaggcgcagatgaaagacattgtgcgttacgcggctgaacgcggtattcgcgtggtgccggaaatcgatatgccgggccacgcctcggcgatcgccgtggcttatccggaactgatgagcgcgccggggccttacgcgatggagcgccactggggtgtgctgaaaccggtactcgacccaacaaaagaggccacctacgcgtttgccgaggcgatg

SEQ ID NO: 36298 - DNA, 477 bp, Glycine max
  Peptide Sequence Number=SeqID_127983
caagttggtgcagggaagctgcccaattccttaattgcagtactttggaatttccttttacttatcttggaactccagttggggtgtcctctggctaacaatcaagaccagccttggtctagaattttaatctctaagtatggtgggtggaaggagttgatttatggtggaaggaggaatttcacttcccaatggtggcaggatttgaagagtatcttccagcagcatcacaatgaatgcttaactgataatttaaaatggagagtgggaagggggtccagcatcaatttctggaagcataaatggatggaggacaactgtactctccaaggaaaatatccccagttatatttaataagtaaacagcagaattcatcaatcaattatatgggagattttgtggagggtaggtgggaatggaagttatcatggagaaggacttccaaatgcactttaatttctggtcaaccaatctaa

SEQ ID NO: 36299 - DNA, 504 bp, Glycine max
  Peptide Sequence Number=SeqID_127984
atgaaggacggtgaattaatccaatcggaattacctcccgcaacacaatatcaactaccaaatgtcaaagacagtaacaataaacatgtcatggtagttccatttaagacaaaagatgtcaatgaggaagtaacctccaaagacattaagagcctaatggaacaggcaaattataccaataagtatttacaagttttaggagaaaccattaaaactaaggtagttcctaaacaaaaatcagttgaggaagcttcgccaagtattcccattgaaaaaccattattcaaacctttcaaagttagtgataaagctaaacgaaaaattagggaacttagaaaaactaaatccttaattgaaggagtaggagacaaccatagtgaattactatacaaaattggtagtttacttaaggtcattccagaaacaccccaaacttcagaaaatacatccaaaatgctacaacctaccaaacctcccatgaatgtttggaagaaaccattatag

SEQ ID NO: 36300 - DNA, 465 bp, Glycine max
  Peptide Sequence Number=SeqID_127985
atgactagaagcaaaagggtgagcatgaatgaaggtgagaagaggataggtgaagaaaaacaacaactggtgactgaaccagaaattgacccagtggtagaacctttgagtgagactaaggaagaagtggaagccaaagatgatcagcagaaggagataccaataattgtgagtgaaaaagaaataagtgaaaaggaaaagaaagaaaaagaaagagagaaagaaaaagaaaatgaaaaaaatgaaaaagaaaaagagaataagagaaaagaagagaagaaaaagaccaagagtgagctggctagagaaaagagaaaggacgcaagtccaagcaaaagggagaaaccaacaaagaaagacaaggaacgacatctagctcgtttccttgatatctttaagaaattggagattactatgccctttggagaagctcttcaacaaatgtcgttgtactctaagttttaa

SEQ ID NO: 36301 - DNA, 207 bp, Glycine max
  Peptide Sequence Number=SeqID_127986
atggacacccgtctccgtgtgattggtgatcccatgaatggagttcaacgggtaacaacgaaattgggtaggggtcacaactcactctttgaggattcacctagtgagtgtggtggtggggccgccactgtgagatatgggctaatctctaaaggacactcacgaaacaagatacaagcgcaaggtcgtgtaacgcgctaccactga

SEQ ID NO: 36302 - DNA, 460 bp, Glycine max
  Peptide Sequence Number=SeqID_127987
atggcttctcgtaagagaaaagcactagcttcagtgtcccaggctaggtgtgatagatcaatatttgtatcccaatatgcctgggactgctatgcaaacaatgtcctttgctggaagatccttctggaaaggaatgtgaagttgtacattacaaaatttgatgaattcaggagagaaattgagaggaggaattggtataaggagctcactaacttctttggagggagcattgacgtggcattagtgaaggaattctatgccaacctttatgaccttgaagataaatcaccaaagcaggtaagggtgcgagggaacctaattaaatttgatgatgacgccctcaacacctttttgaagacaccagtggtcatcgaggaaagggagagcttgccctcttactccaggttctgcaggttgaggccagatcttcaagagcttgcagcccgtctatgcatccctg

SEQ ID NO: 36303 - DNA, 273 bp, Glycine max
  Peptide Sequence Number=SeqID_127988
atgtggaccatcacgggggaggagcttgccacccagctcgcccaggcgagcaaggttgcttcctccagaagcaataggcctctggaggaaggatctggaaggcccaagtgggccagattgctatttgtacccccctttttactaaatgcacccccttctatttttttgctttcgaagaagttacggaaactcacgaattgcgcaaaaacacctcatttcgatttccgccacattacggaatttcacggatcgcgaaagcctgcttccttttga

SEQ ID NO: 36304 - DNA, 224 bp, Glycine max
  Peptide Sequence Number=SeqID_127989
cattccattcgctctcccttgaggagatttcactgtcctttgcttcggggaaaagaatgaggattcctcttttacaggccaaggttcaaaaaggtccgaggttgtgtttcaatggggtcttttatcgtgggaacccaatcttgatatctggggcgaaacaaatctgggtgacaaggtgtcggtctcgggccgaacttccacattattccataaggcacgcttga

SEQ ID NO: 36305 - DNA, 201 bp, Glycine max
  Peptide Sequence Number=SeqID_127990
atggaggttgaggaaccttggctagggttatggctaccattgcattatcgagtagatatgggagcgggccttatggctgatttaggggtgccctttgtggatgattgggtgttcctggttgatagggtggtgggtaatgagaagggtcgatatttgctgagtaatgacattgttgagctggtgggaaatttggccatgtag

SEQ ID NO: 36306 - DNA, 564 bp, Glycine max
  Peptide Sequence Number=SeqID_127991
caagatttgcagttgtggtcggagattcagcgagagagttggatcgtatgaagcaaactcgaaatggcgtagtgggcctaccacggaaatacttggaagacaaggcaagggatatggtgaatcaagaggaatgggtcccgtttgcggatatactagatttgcttatctttggggttgtcctctttccaaacgtggacggtttggtggatctagccgcaattgatgctttccttgcatatcaccatagcaaggagagcccggtggtagctatcttggcggacttatttgatacatttgaccgaagacacccgtgtccgcttcaaagagtcgattgggaccaatacttggctgggataggaggcagcacaatcaactggtttcctcgatggaaggaaggaaaggagggagttcttttctcatgtggggactacccaaacgttccgttgatagggacgaggggttgtattaactataaacccgcacttgccataagacagctagggtaccccatgaggggagcaccaacgggagagagcctctcgcctttccttgtgagagattttg

SEQ ID NO: 36307 - DNA, 177 bp, Glycine max
  Peptide Sequence Number=SeqID_127992
atggtgctggtagcggctattgcaaccgcattgacctccattatctcctttatgctcatcatggcctccatcattgtggccatttgctcttttaaggcctccgtgtcagccttcacttgctcttgcacctcttccacttcacccattactctagcacgggttcggacatggggttga

SEQ ID NO: 36308 - DNA, 897 bp, Glycine max
  Peptide Sequence Number=SeqID_127993
atggccaagtttgatccagaaatagtccttgagttttatgccaatgcttggccaacagaggagggcgtgcgtgacatgagatcctgggtaaggggtcagtggatcccgtttgatgccgacgctatcggtcagctcctgggatattcgttggtgttggaagagggccaggaatgtgagtatggccagaggaggaaccaatctgatgggttcgatgaggaggccatcgcccagctgctatgtataccggggcaggattttgcccggactgctgcagggaggcgagtgcgaatcatgcgcaccaacatgaccaccctgacccagatatggatgacgttgctccttagcaacatcctgcccaccgatcatattccgaccttcccatgccgaagtgtcagctggtggccctgggattcccccgcactgatcacaggactctgccagtcgttcggagtccccgtcgcacctaccaaggtgattcggccgcccatcacccgggcttttattgagaagtactgtacccagagacaggctcagggtgatgctccacaggccgcaggcgcgcctccaccacctcatcaggctggtcaggctggggcatttgacatggagcagtatttacggcatttggttcgccagcaggcggccaaccaccgagcacatgtacggacccatgattgtctgtaccagatgagccttagcatgcagagccagggcttcgcttctttttcatgccctactccagaccagttcagggcagaggttgcatggcccggagattggcccgaggcccaagcaggagaggcacccccaggagctcccggcgatggagaagaggcccacgaggatggggagatggccgatttgctggatttcttgggagggagtggagatacgtga

SEQ ID NO: 36309 - DNA, 294 bp, Glycine max
  Peptide Sequence Number=SeqID_127994
atggcaattactttattctcctgtacaaaatcaccggataaaaatgcggaacaacatactgaccgtgcttcttctgcaacagaaacacaatcagccgcccaattagaaaataccaatacagcagaacaaatcaacaataaatcaaatgaaaagacagctgtcaaagaccctgttaacaatttttctatagatcctttaatcaaagattatttaattttaaaaaatgcacttgttgccgataacgatcaagctgttgctactgccggaaaacagttattagctaccctagagaag

SEQ ID NO: 36310 - DNA, 618 bp, Glycine max
  Peptide Sequence Number=SeqID_127995
atgccgaccagggatcagcggatgttgcttttaggactccgctggcacctttatgagaaatcaaagtctttgggttccggggggagtatggtcgcaaggctgaaacttaaagatgacagactgagagctctttcttattctatgggtggtggtgcatggccgttcttagtggtggagcgatttgtctgggactatggccgcttaggccacggaggccgaggccccctactgttggttggcaaacggacggcgggcgcacgcgtcgcttctagcccggattctgacttagaggcgttcagtcataatccaacgcacggtagcttcgcaccactggcttttcaaccaagcgcgatgaccaattgtgcgaatcaacgggtaaacccacccctgtctcacgatggtctaaacccagctcacgttccctattggtgggtgaacaatccaacacttggtgaattctgcttcacaatgataggaagagccgacatcgaaggatcaaaaagcaatgtcgctatgaacgcttggctgccacaagccagttatccctgtggtaacttttctgacacctctagcttcaaattccgaaggactaaaggattgataggccacgctttcacg

SEQ ID NO: 36311 - DNA, 307 bp, Glycine max
  Peptide Sequence Number=SeqID_127996
ggtgcactgattgatgattggaaattcaatttttctgtgcatgatgcccgccgattggtctgcaccaaccaagcggatatgaccgaaaggcttcttggcggttcattggcttttgagagccgcatcctccattaccttattgttcgcatcttactccctagatcttcaaaccttgctcagggtgctagaaatgttggtgaagaaggaaatgaaggagaggattcatctcttctttcgaagattatggacaggtttgatggtcttcaaacctttgttggtgagaggtttgatactttggaaactgcaa

SEQ ID NO: 36312 - DNA, 309 bp, Glycine max
  Peptide Sequence Number=SeqID_127997
atgggagaagcccgtgaagagccccgggaccatgctctaggcgagtttgaaccttacactacatatgccactaaggggccaacgtttggtggcatgcctcagccccatacctcaggggcccctcaacaccacccgctgcaacccctgcatttctcgatggggagactacctctgaccatggaagaaagagagaaatatgatctcatagaggaaaggctgaggaccattaaggggatcggtgattatccatttgccgacatggcgaagctatgcttagttcacgacgttgtcatccctcccaaattcaag

SEQ ID NO: 36313 - DNA, 477 bp, Glycine max
  Peptide Sequence Number=SeqID_127998
atggatttaaaagcagttccattgagtcttgatgaatttaatcgctttaaattgggagacgaaaaggtgcgccgtgtatgtccgtcctatttagacgtggaggagattatgcaagagatatttgtacagctttttctgaaacgcaattcaatcccctctgcggaagccatctttccatttttatttattgtagcgaaacgcatggctatcactttgtttcgaaaagaactatcgagacaaaaatttcaagtgtcgcacttggctgaatgggatgaactgagtgatgaattggaaaggaagatcgcccataaagatctggataaaatactgcaaacaattgtgtcccgtttaccaccgcaacagcagcttgtttttaacaaaagcaaaatagataagatgagttatgctgagatttccgaagaaattggtatttccaaaaataccgtccgtaaccacctcgtagcagcatgccaattt

SEQ ID NO: 36314 - DNA, 783 bp, Glycine max
  Peptide Sequence Number=SeqID_127999
gatggtattatttcttctgaggtgcatggtatttctatgatcattgatcaatctttgttcttttcattgacaaaattagccagtcaaggtgcaccttttgagggcaccattgttgatgactgtaaattcgattattctagtcatgatgctcgccgtatggtttgtaatgaccaggctgaaatgaccggtagattgctggccggatcattgacctttgataattgcatcatgcactatattattgttagaattttgcttccccggtcttcaaatttggctgaagcctctgaggaggacttgattttgatgtgggctttccttaccagtcgtcagatcgactgggctcacctggtttggtaccgaatgcatagggcattacgggccaatgcacctcttccatatcctcaattggtcaccctctttctccgtcattttcaaattcctcttgatgatgaaccttttgttcaagtcaagcgttcctttgctataggtgctggtgcagtcacttcatttggttacagtaaggatcgtaatggtcaatggctgaagaaagatgcacttcctccacaagatgagcgtactccttctcctcctcctcagcgagatgattcagcccttatgactgaagttcttttagagttacggggtcttcgcacttatgttggtgaacgttttgattctttggatactcactttgcaggaatggatatccatctcacacagcttgaagaagatgtgggttatattcgtcagagctttgatcttccaccaccacattcttag

SEQ ID NO: 36315 - DNA, 269 bp, Glycine max
  Peptide Sequence Number=SeqID_128000
gtatctccgcgtatcatgggtgcagaatgaccaaacttggtctctgcgtgccatcggacacgactgtgtctgaatggcaaaggggtgcggataaccgtcaggtatctccgcgtatcatgggtatctccgcgtatcatgggtgcagaatgaccaaacttggtctctgcttgtcatcgggcccgccgcctctggatgacaaaaggggtgcgaataaccataagggtgcggataaccataaggtatctccgcgtatcatgggtgcagaatga

SEQ ID NO: 36316 - DNA, 303 bp, Glycine max
  Peptide Sequence Number=SeqID_128001
atggttacccaaaacaatgagagtagcaaatttttgctctgggaccgtgaatgtgctgaattgattggtgaaacagctgatgatgtgaatagggtcaagattgaactggtgaatttgtgttgtttctggaaggatggtgatcttgatttgaatgcttcccctcaagcacttgacaaattcttgggtcatgtgcttgcttttaaggcatgttccaaaatagatccttccaatgttgattgcaataatactacacatgctgaatgttttatgctttatgcaacaatctctgtctgtcatagctga

SEQ ID NO: 36317 - DNA, 450 bp, Glycine max
  Peptide Sequence Number=SeqID_128002
atggcgcctaccaggcaccctctggacccggataagtccaacagggccctgggatttcccgccttgatcacaggactctgccagtcgttcggcgtccccgtcgcacctagcaaggtgattcggccacccatcacccgagcttttattaagaagtactgcacgcagagacaggtccagggtgatgcaccacaggccgcggacgcgccgccacctcatcaggctggtccagccggatcgtttgatacggagcagtatttgcggcatttggttcgccagcaggcggccaaccaccgggctcatttcagggcagaggtcgcatggcctggagattggcctgaggcccgggcaggagaggcaccagcagaggctcccgacgaggcagatgaggcccgcgaggatgaggagatgaccgatttacttgatttcttaggagggagcggggccacatga

SEQ ID NO: 36318 - DNA, 49 bp, Glycine max
  Peptide Sequence Number=SeqID_128003
ggggattcttatttcctcctcactagctttgtttatcatcttttgttag

SEQ ID NO: 36319 - DNA, 318 bp, Glycine max
  Peptide Sequence Number=SeqID_128004
atgataataaaggaaaatgctaatatatatgtacaaaacacgtttcgtaaagatgcaccaagtctaggaacaaaaagaacggcaagaaaggtgcttaaacacaccatcctaaggagaaacgaagttgacatggcttttaacaaagtaattcaagagaaagtgtgggtaacagtactattgttaggtgatagcaatatacacacagagagggacactacattcacagacaggggtgctgctagtaatacacacacaggcataaccaggcccatcagaaacaatcaaccccctcactacctgaaggactacatcacgtga

SEQ ID NO: 36320 - DNA, 378 bp, Glycine max
  Peptide Sequence Number=SeqID_128005
atgagggttcactgtaatcaagcaagtcggagacctagcatgatcacagattcacctccactcccttatgctcccatgaacccgggtatagggccctttttcactcacatggagtcgccaactgtcgcaacctacccttcggcgggagggcgacgcgagactcgcgggatgcgtgttccacgaaaggaatacgcgcggagtcgccaccaacgtttattcgaggaaaacgtcggaaaaaccggaaaagacgcgatctacgaacttttaagtgaaaaggttcgggagttgtatttacgcacggggaaggatgtttccctttgctcctacgtaccctccttggagaggaaatcagactgcgtagttctttctatcaagtga

SEQ ID NO: 36321 - DNA, 195 bp, Glycine max
  Peptide Sequence Number=SeqID_128006
atggtgtgtgttgctagtgctacaaatgtatctgctcaagtgagcaatatccctatgctgaatgagacaaattttaaggtttggaaagaagtcgtggaaattgttctcggttgtatggatttggatttggcactgagaacgaaacgacccacttctactccggaagcctccaatgaggtaaaaattgagaaatga

SEQ ID NO: 36322 - DNA, 378 bp, Glycine max
  Peptide Sequence Number=SeqID_128007
atggcggtgcagctaatccgtgatcgagtagagatggagtgcctagagggagcttgggagaccctcgaaggcacacgagatgaacctgcacggacgcttcagcgcactgtggagtggatactacccacgcctacaccatatcgtctagtggagcccgttcaagtgatcgaggtaacgtcatccgaggaagaccctgaggaggacctggaggagctacctcctgagcctgctgtggatgcccttgactttctagagggtgatgaggatccacttcttgaggtggattctcccgaggaagtcatgtcggcatctgaggcagactctacggaggatagcggcccgagggagatggcgatcagcggaggctcttcatcctag

SEQ ID NO: 36323 - DNA, 327 bp, Glycine max
  Peptide Sequence Number=SeqID_128008
atgtcgagcgtctcgatatattatgcgcctgaatcggacatccgagtgaaaggttatgaccatttcaatttctcgagagctttcgttgttcaatttcgagcgtctcgatatgtgatgttcctgaatcggacctccggggtgacaacttatgaccatttgaatttctcgagagcttccatctgttcaattttgagcgtctcgatatatgatgctcctgaatcggacatccgaagtgaaagttatgacaatttcaatttcttaagagcttccgtggttcaatttcgagcagctcgatttgggatgggcctgaaacggaactcggagtga

SEQ ID NO: 36324 - DNA, 839 bp, Glycine max
  Peptide Sequence Number=SeqID_128009
cttcaacgaccccgttggtgccgagcaggccgccgagcaggccgttgagaatgccctcatcgagggctggcgagccgagatcccgaccgaaaatgcggcgatcttctgggacgaggccggcgttatcgacgaaacgctggccgacagggaccgtcgcatccggctcgtagtgacccttgatgacttcggcataacccttgctgctggcgaattcattcaggggatcgaagggttggagccccttggcggtcaaaatgccctgggccgtcctgacgccgagatccatgccgttgagggcaaaatattgctgaaccgctttttcggcatcggcggcattggctgccgccgatatggctgcgaggtcggcggtctgctgcaattgccgtttctgcaatgtcagagcggtgcggtgagccccgccgagatggcgatgttgcccgttctatccctaaggaagcgggggagcagggaatggatatctcgcatgtcatgctcctccgatccggatggtggaaaaacgccggatgaccggctcgggcagggtgtagctgtagaggctccagatcggcaggttgcgggcgtcatattcgaccttgaccgtgaactggttggaattggcgggatcggtggcgacgttgacggtgaaacgcgtcttgtccatgaaggcgtagctgagatcgcttttgctgacgaaatcgcgggcaagctgctggcgttcggtggtgttcagcccggcaacggccgttcttgccgcatcggcggcgatctgctgcaccgaataggcggccatcagataaatgccgtagcgatcatggtgagcaggacgagaaagaatatcg

SEQ ID NO: 36325 - DNA, 582 bp, Glycine max
  Peptide Sequence Number=SeqID_128010
gggagactcttcctgcttactccaggttctgcagactgagaccagaccctcaggagctggttgcccgatttgtatccctggtaagggatttgttctaaatgctgaggggttgccatggaagcttctgatgaaggacctcattactctggtgcagacttggaacgttatgtcttatttcaaccttgcccctacatcacacacttctgatctgaacatggatagggcaagggctagaggatctgagggtccatcttctgctactccccagacatcaactgcaccagctcctattcctttagcactagttcccgctactttcgatccctccactcagagcacagacctcatgatggcgatgctgccaggagtccagccttcttctcatggaggaggtgaggcctccacagctcaagagcctaagccagatccggagactacacctgctggtcaggaggatgattcagaggccattcccccagagtcatttgtaccaaaaactgatccagagacagatccagtgattgcagaggccagtccacaggcatcactagtatctacaccaatgctggagctgagcacccc

SEQ ID NO: 36326 - DNA, 789 bp, Glycine max
  Peptide Sequence Number=SeqID_128011
atgtcacagcaacaacttaaaaggaagtctacttcaaaattttatggctctcactcttatccaaagaaagaccaaggtcaaggcatcttaggggtgacaccttctaagcccaaagatgataaggggaagacaatagaaaagcaaccctttaaggctagtatgcaagaaaagactagctccatgaagtgctttaaatgtcttggaagaggacacattacttctcaatgccccaccaagaaaacaatgattatgaggggccaagacatttatagtagccaagatgaggttactacttcaccttcttctagtgaaagtggagaagcaaaaggggaagaatctagtgaagagatctacccccaagaagaaggacaacctttaatggttaaggaggagtgtaaggaggtaagtgtctcctccaagaggttagctaagaaggaaaggcattttgaaataaagacaaatattaaagaaatttcccctcttagacaacctccacattttctcctttgtaaaaagacacttgttagcattgccacacctcttaggcttgagtttattcctcaagtaaaggagttgttggatgagggtttggttcgcaagagcttaaatccttgtgctttgttggttcccaaaatatgtattattaggcaccaaatccctaaaataggtggtatgatgaatgttttgagtggtgcaaccctcttttgtaaaatcacttgtgcacccaacatcttcatgatttgtgtacatagggacacattaagtaggtactcatatgggacaccttag

SEQ ID NO: 36327 - DNA, 623 bp, Glycine max
  Peptide Sequence Number=SeqID_128012
gggtgaatccaggcgccgcatcgcggcgcagagcggaaatgatgagggccgcgcccgcggcccttggcttgttgcgaggatccacatgattatctatttgcacggcttcgattccaccagtcccggcaatcatgaaaaggtgttacagctgcagtttatcgatccggacgtgcgcttcatcagctacagcacgctgcatccgcgtcacgacatgcagcatctgttgaaagaggtggacaaggcggtgcagcagggcggcgacgcgcacccgttgatctgcggggtcggcctcggcggtttctgggcggagcgcatcggcttcctgtgcggcattcgccaggcgatgttcaacccgaacctgtatccagaagagcacatgcacggcaagatagaccggccggaagagtatcgcgatatcgccaccaagtgcgtggaggatttccgcgagaaaaatcgcgaccgctgtctggtggtgctgtcgcggcacgacgaggtgctggataaccggcgcagcgccgaattgctgcatcactactacgagatcgtgtgggatgaacagcagacgcacaagttcaaaaacatctccccccatctgcagcggctcaaggcgttcaaggcgctgg

SEQ ID NO: 36328 - DNA, 171 bp, Glycine max
  Peptide Sequence Number=SeqID_128013
atgttggtgcgcatgatcgacactcgtctttttgcagcggcacgggtgaaatcttgccccggtgtggatatggagcacactgaaaatgaggacgtagcccctcttaaaggcgagggcgtgcagccctctgcaggcgaggatgtgcagtcctctgatggcgaggacatatag

SEQ ID NO: 36329 - DNA, 240 bp, Glycine max
  Peptide Sequence Number=SeqID_128014
atgaatattgaggaatccattcatgttacttttgatgaatctaatgctatcttgtcaagaaagaatatgctagatgatattgcagaatctttagaacaaattcatattcatggacaagattctaaaggaaaagggaaaggaagcaatgaagatcctccagaagaagtcaagaagaagtatatgttgaacaaccaccaagttttgaaatattggataagccaaatcatgtctataaattga

SEQ ID NO: 36330 - DNA, 246 bp, Glycine max
  Peptide Sequence Number=SeqID_128015
atgcatgctttgttagggtcattcaacagtggaaactggtctaattctaaagtccttgatagtatggagctaagttgttgtactatcacgaggaatcggggagtgccagatgaggctattagactcagccagttttcattttccttggcaggagaagccaagaggtggctctacttatttaagggtaacagtctgaaaacctgggaagaagttgtagaaaagtttctgaagaaatatttcccatag

SEQ ID NO: 36331 - DNA, 351 bp, Glycine max
  Peptide Sequence Number=SeqID_128016
atggatgagtttgatgcacaggtggcctggccaggaacccaactttctctttctggagggggtggggcctccgcagcccaggagcctgcttctgaggatgcagcagcgacagcagagggagaggatgaactcacccctcctaagcccttttattttgatgcggatgcactcatggctcaggaggatgggacttccacatatcagatacctgagccatctcctgcacctgttcctaaggagacccagccatgtacaccagtcagggagccagagcagcctatccaggattcatcagcagctccagcactagatcttaatgaagatcagccacaggatgagcaggacatttaa

SEQ ID NO: 36332 - DNA, 342 bp, Glycine max
  Peptide Sequence Number=SeqID_128017
atgggggagacacatgaagtaccccaagaccacactctagacgactctgagccttgcctcggatatgctactgaggggcaagcatttggtggtgtacccttgccaaacactttggggggccctcagtatcgcccacaaccacaacccttacattttgcggtgggaagagtccctcctgctatggtggaaagggagaaattggatcatatagaggaaaggctaagggtccttgaaggaggcaaaaattatgcctttgctgacatggcagagttgtgcctagtgcctgacgtggtcattcctccgaagttcaaggtgtcgaacatcgattgtgggatcctctag

SEQ ID NO: 36333 - DNA, 2271 bp, Glycine max
  Peptide Sequence Number=SeqID_128018
atggctgccgcagcctgtacggccctgctcggcgtgggcctggttccgcagctgatgcccaccgcgcaactttacagtgccggacagggtgagcttcgcgacctggtgctgcccgaccagacccaggtgcggctcaacgcggacagccgcctgcgggtacgcatgggctggctcagccgcaaggtggagctgttgcagggtgaggccacgttcgacatcgcccgcgaccgccgtccgttcgaggtggaggtgaacggcctcgagattcgagacattggcacggtgttcgatgtcgcgcgacggttgaagagcacgcgcatcggcgtggtttccggcgaggtggagatctggagccagggtgcggacgcccggcgtcttgcgcaactgggcgaaggccgggtggtgcaggtcgacgcgcgcagccatgcggtggagtcgctggatgtaccgttgtcgatgctgctggactggcagcaacgcaaggtgtccttcctggatgagcggctggacgaggtagccgctgccttcaaccggcacaaccaggtacaggtccgcgtgctggacgaaggcgctgcatcggcacggttgtcgggcagccttcctcgaacgcgacccgcgtttcctggtgaggcgcgaaggcgacaccgtgcgggtcggcagtcgctgaggccgacgtggccgtggactgtcagaaaaaattcatcgaatccgcgttctccacttccggtggatgcgggctcttacttgggagaagccactgccgagccacgcagcgggcgcctgctgccttctctcttccaaggacccgtgatgcgcaacacgctctacctgtcgatcatcctcgccctgtctccctgcagcgtgccgctggcggtcgcggccactgccgatggccttgaggcccgcgtttcggcgccgatcgcggcgcagccgttggcacgtgcactggagcagttgtcgcgcagttccggagtgcagttcctgtactcggccggcggtgatgcgcgcatggccggtgcggtgccgcgcggtgctaccgtcaagcaggcgctggacgcactgctggccgggaccggcctgggctacaccgtggtggatggcaacgtcatcgccatcgatccggcgcccgtaagcaacgcgccgaagccggccgcgccgaagccgcgcgaggcagaggcggtggtggcgccaaccctggacaccgtcaaggtgattgccgcgcacgaggtgatcgaccagaagaagtcgtcgccagtgatcaaggattcggtggtctacgacgagatggacagctacggcgacgagaccctggccgagagcctgatggccgctccaggcctgagtgcggtggaggatgccggcgagccacgttacgtgaccgtgcgcggggtacaggccaacctcaactacaccaccatcgatggcatcgcaattgccagcgtgggaggcagtggctccggcgagcgaatgaacaacctgcagctgattcccagcgacatcggcacccgtaccgacatctacaagagcttcagtgcggagcaggcaccggatgcgatcggcggcgtgatcgacatcatcagccgcagtgctttcgaccggtccggcaagtacgtgtttgccgatgtggcgggcatctattccaccgccgagaccaacgtcgagcgcagcgcaggcggcaaccacgagactctgggccacttcggcaagagcgccaaggtggtgttctccaaccagttcggcgccgaccaggagttcggcatcgttgcggtggcacgctacgagcagcgttcacgcaacagcgtcaagcgctgggtggagtcgaactactactacaacgacgctggcaaatacctcaccgacggtaccaccggtccggacgaggcaaagggctggaacgggctgcgcgcgcctggcaacttcagcaccggcacctataccaacttcatcaccaacttcggtggctccgccaagcttgagtggaagccctcggatgatccgttctacgcatcgctgctgctgtactcgtaccggttctacgagaactcgacgatgaacaagaccgatctgtacggcaatgccaagtttccgatccgcaaccagaccgaggacagcggcaccacccagatcaacagcatctacatcaagaaccgtcacgaccgctgggatcgcagcaaccgtggtgccatcgccagtttcaactgggacatggacgaccgttcgcggctgaccctgcgtggcggccataccgaagagaccttccacaacaaccag

SEQ ID NO: 36334 - DNA, 819 bp, Glycine max
  Peptide Sequence Number=SeqID_128019
atggtgcacgttacgacatccgcatgcgtgcgggtgccgcgtgaaatggtgaagctgccggcaacgggaaaacgttctgttgtggcttgcaggccaaaccgttatgaaacctttaagaatctcgtgacggctgcactcgctcggagcattatgcaagaacaggacacacggcaacaggcgaacccggccgccatcaccgaagacgataacgtctccggcggcggtttgcgttttgtcatgagcggctcctggcgcaatagcaatctctccggtgttttccccagtctcgaaaagatcgaaaaaagcagatccgccggcgcggtggaaatcgatctttctgccgtcgaggccatcgataccacgggcgcatggatcatccagcgtctgcgcaaggaccttgaggtcaacggcgccaccgtcaccgtgacgggtaatgaccatattgaagaggtcatcggccagttgcccgaaaaggtggagatggagggcgaagccggcccgaaggaggggcttgccgagcgtatttttgcgcccatcggcaaggccgtgatccagaacggcgcggatttcctggcgggcatgtatattctcggctccgccgtacgcggcgcgcagatgaagctcgggcgcggacggggcgtctcaccggcggcgatcgtcaaccagatcgaccatatgggcgtgcgcgccgccaccgatcatcatgttgatgtcgttcctgatcggcgcgatcatcgcccagcagggtgcgttccagctcagatatttcggtgcggaagtcttcgttgtcgatctcgtcggcattctgcaattgcgtga

SEQ ID NO: 36335 - DNA, 222 bp, Glycine max
  Peptide Sequence Number=SeqID_128020
atgattgtgatcatgtcaatgacaacccaacaaatgagttctaaaagggcaccacatcattgcacaattgaagctcaattggagcttgtaggcctaggatcttcttcatcaatggattcctttgcttcttggaagatgaatgacaacggaatggagaaggaagagagagaggagatgccacttcaaggagaatatgagtctagaagaagctcaccaccatag

SEQ ID NO: 36336 - DNA, 699 bp, Glycine max
  Peptide Sequence Number=SeqID_128021
atggcacgcagagacaaattatggtcattctgcacctttttgccatctgcggacgatcgtgtccgatggcacggagagatcaattgcggtcattctgcaccttttcgccatctggagacaatcgtgtccgatggcacgcagagacaaattatgccagaggcgacgtgcccgatgacaagcagagacaaattatggtcattccgcaccttttcgccttccgcagacagtcatgcccgatggcacgcaaagacaaattatggtcattctgtaccttttcgccatctggagacgatcgtgtccggtggcacaggcggcaagcccaatgacatgtggagacaaataatggtcattccgcaccttttcgccatccggagacgatcgtgtccgatggcacgcagagacaaattatggtcattctgcgctttttgtcatccagagacggtgagcccgatgacatggggagacaaatcatggtcattctgcatcatttcgccatctggagacgatcatgtccgatggaacgcagagataaattatggtcattttcgccttttgtcatccagaggcggcgagcccaatgacatgcgatcaatggcagcggaatggagagggagtaatgatgattggagatgctacttcaaggagaagatgagtcaagaacaagctcaccaacatagaaagccatggataagagcttga

SEQ ID NO: 36337 - DNA, 79 bp, Glycine max
  Peptide Sequence Number=SeqID_128022
atgacgggagatgcatcaaagtttattcatatttctcccaataatagtggacatctgacctatggagacaacaacaaag

SEQ ID NO: 36338 - DNA, 291 bp, Glycine max
  Peptide Sequence Number=SeqID_128023
atgtccaaatctttgatgccacattctgacttcatcttctttggaggatggacatgtggaggagtagctggtttctttgagctgactgatgctgatcaagtttgcagtcagtcccttcaccagcagtactttgttcagactagggaagtccatcatgaactagcttttcccatttccaatgatctttcctttagagccatctccaaatgtcacatagctagtggagcagggctcaatgttcagcaggaattctttgactcctgtcatgtgtcgggaacagccgctatctag

SEQ ID NO: 36339 - DNA, 441 bp, Glycine max
  Peptide Sequence Number=SeqID_128024
atgtgccagatttgggatgaagactctcgagatagggcgagctattataggagtataggtccaatgaaagaacataaagaatggacctcaatatacatcggggaaaaaccatactcgacccttcctaagcaatatggtaaccgccccaacaatcagaggattgttgctatagggtttgcgggtgatagtggtagcaaacccaatactttccccactaagatcacttgttacagatgtggtaagccagggcacatctcctcaaattgtcctgataaagggcatattcagagagattgtccatatcccaagaaggagcagaatggtgggggcctgaatgaccaaactggacatccgaaggccatgggaagagtctttacccttaacagtacccaagctttgaaatctaaagatctaattcatggacatttttggttgatctga

SEQ ID NO: 36340 - DNA, 492 bp, Glycine max
  Peptide Sequence Number=SeqID_128025
atggtcttaaaagaagagttagccgcttgctcaaggtccaaaaggaacttgactcagcgtttgtgcgagacagagaccaacatgttagctatcatcaccaagtatcaagaagaactaagcctagccacaacccacgagcatagggtggcagacgagtatgcccaagtgaaaaacaccataactaaacgcgccacaaggcatccctatcgcaccagatccaaatctaggacgatgggtgaccaggaggagacacaggaacagatgaaagccgacatgtcggctttgaaagaacaaatggcttctatgatggaggccatgctaggaatgaggcaattcatggagaagaacgtggccaacactgccgctgtcagttcgactgtcgaagcagatccaactctcctagccaccgtgcaccatcctcccccaaatacgctaggacgaggaagaaacacactggggcacaacaacaacccccatttgggatacaactga

SEQ ID NO: 36341 - DNA, 330 bp, Glycine max
  Peptide Sequence Number=SeqID_128026
atgacatacgggactttcgcaacgtgcccctttgcgggcgagcgagggcgaggctcacgggtgcgctttccaaagaaggaaagatgcgcggagtcgccaccaacgtttatttgtggaaaacgtcgagaaaaccgaaggaaacaggtcaaaatgaaaattctaggttcgggagttgtatttacgcttgaggaagaattgtggaaattgtgttaccttaacttttattcccctccattttttgaggtcgacaaaagcggggctcttgctcctacgtatcctccatcgaagaggaaatcagacctacgtagttcttccttaagcgtgaattaa

SEQ ID NO: 36342 - DNA, 420 bp, Glycine max
  Peptide Sequence Number=SeqID_128027
atggagcaacgtggccatagaatgtattacacgccagcaacattttctcaatatccttcacagatgtatcaatatcatttccaaggtcatgacactgatatgtctgcaagcgaacattcgtttggtggtgttgtggaaacacaccctcatttttcatggccgactatgacccattcacaacaacatgatcccccaatggcaacacctaacgccccattggcttcgcaatggaatgtactcggagcaatacctgatatgggtgacttattaggtgttgatttgcgtcacgagttttctgttgaggctgagcaagtagaagcggggagacagcgcggcagaagaaatcatgattgtcaagcccgaagatgggatcgaccatgtggcacatcctcatggcatcacggacaccataatgaatga

SEQ ID NO: 36343 - DNA, 273 bp, Glycine max
  Peptide Sequence Number=SeqID_128028
atggtggggacatctgttaattggtttccccgatggaaggaaggaagagccggagttttgtcttcatgcgaagggttcttaaacatccccttgatagggatgaggggttgtatcaattataatcacgtccttgctgtcgcaacgtgcctttcgcgggcgagcgaaggcgaggctcacgggtgcgctttccaaaggaggaaagatgcgcggagtcgccaccaacgtttatttgtggaaaacatcgggaaaatcaaaggaaaccggtcaaaataa

SEQ ID NO: 36344 - DNA, 708 bp, Glycine max
  Peptide Sequence Number=SeqID_128029
atgcaacacctcaaagcactattcgccgccgtttgtttcttactcccctataccctgcatgccgcggacctcagcggcctttggcaaaccacggatgatcgcaccggcaaaccgagatcgctggtccgtattgttgagaatgctggtgaatacagtgcagttgttgaaaaaggcctgcttgctaccgacactggtgaagcagtctgtgacaagtgcactgacgaacgcaaaggtcagaaaattgttggcatgacaatcgccaaacacttgaaaccctcaagcaagagtcatgtttatgaagatggtgaaatccttgaccctgaaaacggcaagacctacaaatgcaaaatgaccttgagcccaaatggtaatgagctggaagtccgtgcgtatttactggtttcaatcggcatcggcctgattgcggccaggaatgtgcacagcaccaaagattatgccgtggctggccgtcacctgcctctccctgtggtcatggcgaccgtctttgccacctggtttggggcagaagcggtatttggcgtttccgccacctttgtgcgtgaaggcttgaccggggttgctgcggatccgtttggttcaagcatgtgcctgattctggccgggattttcttctctagccgcctctacaagctcaacatcctgacgctgggagacttctaccgcatgcgctacaaccgttcggtagag

SEQ ID NO: 36345 - DNA, 450 bp, Glycine max
  Peptide Sequence Number=SeqID_128030
atggataaagatgtttttcttttcacgctgatagcgcgccacaaagtccagcatgcctttacggaaggtgtcaccattgttggcatcatcgttggtggcatacacggtaacattgatgtcgccatccatctgcttgagcacattgacgctgccctgggtcaggatattacgacgacgaatcgtcagggtaataaaagtgaggataaacaggccaaaataagccaggtcagccgtatcaatcaacccaccggcaaacgactggaagtggcgcatcaaggaaaacttgagcacggtgctggtcgggtcaccagcaaagaagcggtccaggatcatcagcacaaacaaggcaataaagctcaggataccggcaataataggctgtgctgtcaggctggagaaatacaggcccagcgcggcgaaactggaaaccagcagcaacagtcccagtga

SEQ ID NO: 36346 - DNA, 132 bp, Glycine max
  Peptide Sequence Number=SeqID_128031
tggcatcttctcctatctcttccttctccattccgctgccatttatcttccaagaagcaaaggaatcattgatgaagaagatcctaggcttacaagctccaatggagcttacatcaagttctttcaaaaggg

SEQ ID NO: 36347 - DNA, 210 bp, Glycine max
  Peptide Sequence Number=SeqID_128032
atgttggtgcgcatgatccacactcgtctttttgcagcggcacgggtgaaatcttgccccggtatgcatagtagatgcgtgatagcctccctctctggatgtgctcgcatagttggtcgccctctaatatccccggtggttgcccaggaactgataaaaggaaactactggccccttaaccgggagtgcaagtctcggttaagcatctaa

SEQ ID NO: 36348 - DNA, 642 bp, Glycine max
  Peptide Sequence Number=SeqID_128033
gtagttgtgtctccgccaaaaccacctccgaagccccatccggaggtcgatgatccgctgtatctgatgacattgaccatcccagagcttttcttgaggccttatcaggttagatgggatgccaccgtcttcggggccgttaatccagatttccccctgtacataaagcacgaagacctctccgaaatcgcacacggtggcatctcactgaaacatgtatgcgagtggggaattctgatatctatggattcctcgagccatagtccattcagagcggacactgggcagatggtggtcatcctgcccaaagaacacttagttgtctggttttgttcattgcataacaggccagacaactaccttaagggaattattaatagtgctatcaagggtcttgatgattctccacagcctaaatcaaaggctcctgctaggtggattgtcgtcaagtgtaatagacaaaaaggaactactgagtgcggctactatgtgatgcactggatgtccaccatcattttaggaacttttagaaataattgggaagcgtattataacgatcctagaccgttggagcctgagagattaaaagcattgcggatccagtgggcacagttttatctccgagttagagatcaggcctag

SEQ ID NO: 36349 - DNA, 762 bp, Glycine max
  Peptide Sequence Number=SeqID_128034
atggatggtatcgcgcaggatccgcacgtcgcgatcggtgatgtgacggcgatcttcacgcagatgtacggtaatgccgtctgcgcccgcctgctccgcgacaaacgcggcctgtaccggatcgggatagtttgtgccacgcgcgttacgtacggtggcgattgtaacgcgcggagcctgtcaggtgcatcacccgcgctcgtcgtttgccacgttcggtcgttttttcggcacaaactgacggaacagctcctgactcttcagcggcttaccgcccagataaggtttcagcgccatgcgcgtgaagcgtttggcggcacgcagcgtgtcggcgtcgggaaattcgcgctcccacagcgcgcgcagctgtcggccggtgaaactgcgctgattgaccaccagactggcgataaaacctttctcttcgcgatagctgtaggtcatgctgtcgtcgaccgcctcgccgctgccggcgcagtgcagaaagtcgacgccgtagcccagatggcccagcagtgccagctcaaaacggcgcagcgctggctcgggcgaaccgttggccgccgccagcgtctggatacaggagagataatcgaagaacagttcggagaagggaatttcctgctccagcacccgcgacagcagctcgttaacatacaggccacagtagagcgtgatgccgctgagcggcagcgccagcgacaccgcttcggcgttacgcagggttttgacttcgccacggccgccccagcgcaccagtag

SEQ ID NO: 36350 - DNA, 630 bp, Glycine max
  Peptide Sequence Number=SeqID_128035
atggaggccgacatggaggccatgaaagagcaaatggccgcaatgatggaggccatgatgagcgtgaagaagataatggaggccaatgcggttgcaactactgctaccagcgttgttgctaaggtgaacccgacgtccccatccggcatcaaccaaatgaatcatccaacctcagatatggtaggcaaagatttgggaagtacgggcggcccccatgatgtgcaaattcaaaacgagcacgccttcccgccatatggcttgcctctcaactatacgccacccaatgtggcgtacactcccaataagaatgtcaataaccccactcctatacccattgagagccaacaaccccaaactgatcatgcacatccttggctcggatatgccactgaagggcaagcagttggtggtataccccttgaaaacacttcagaaggccctcagtatcacccacaactacacctcttgcattccacgacaagtaaaaaccctcatgctatggcagaaatgggaaagctggatcatctagatgaaaggctcagggccattgaaggaggtgaagattattcctttgctaacctagaagagttgctcccaatacccaatatcatcacccctctcaagttcaag

SEQ ID NO: 36351 - DNA, 279 bp, Glycine max
  Peptide Sequence Number=SeqID_128036
atgtgggcatgggaacgctgcacgattttggctccaaagagaactcctcctataatagaaaacaaaccactcggacacaggtggctacgacgtggaaaccaacatattggcaatgatgatctaatagttttccgtcgcaaattggatatcatgaaacgacatgagtttctgtgggagccttacacagcaactgttatgtcgatgttgcctcccatttgtttggttggcagtgtggcgtggtgcgcagtggtgccactcattttggtttccatgttgtag

SEQ ID NO: 36352 - DNA, 258 bp, Glycine max
  Peptide Sequence Number=SeqID_128037
atggagggatctggcagcccaagtggtgcccccaatgacggaaaaggagatgataacaatgatagtagacacgttaccgtagtcataaccctagccaaggttcctcaacctccattcttcctaggatacgacccgaatgcagcatgtgcttaccatggaggagtcccgtggcatgccattaagcattatatgaccttgaagcgtaaggtgcaaggtctaattgatacaggctggctgaaatttgaggagaattgctag

SEQ ID NO: 36353 - DNA, 273 bp, Glycine max
  Peptide Sequence Number=SeqID_128038
atgtgccctaacccacatcgcacttttggtcgttttattcatcgtccttcttcatcagcagctaaggcatcacatccatctattaatatcgaaagaccaaaagaaatcaagagaaaaattggggaagcgaaaaagagagaaaatgaaagaaggaatggtttgtggtggccaggtcaaatacttggctttgatcacctttctacttctcatcttacttctccttgttcaggaactcccgttaagcttctcagaaaggaagattccaacaagtaa

SEQ ID NO: 36354 - DNA, 404 bp, Glycine max
  Peptide Sequence Number=SeqID_128039
acagtttgatcttgaaagatgagttgaaggtttgctcaaggtccaaaagaaacttgtctcaacggttatgcgagacagggaccaacatgttagctatcgtcagcaaataccaagaagagctgaatctagccacgacccacgagcatagaatggcggacgagtatgcccaagtgtacgcggaaaaggaggctagaggaagggtgatcgactcgctacatcaagaggcaacgatgtggatggaccgatttgcccttaccttgaacgggagtcaagagcttccccgactactagccaaggtcaaggcaatggcggacacctactccgcccccgaggagatccacggacttctcggctattgtcagcatatgatagatctaatggcccatataattagaaaccgctag

SEQ ID NO: 36355 - DNA, 266 bp, Glycine max
  Peptide Sequence Number=SeqID_128040
atgaattgcgttttcgttcatgcatcctccgcccacgagtttggagccatgcgtagtgattgcttagtgcaattctccattctctacctttttcggagccccaagaattgcgttttcgttcatgtgtcctccaccttcgagtttggagctatgcgtagtgattccttagtgaaattctccattctcaacctttttaggagccccatgaattgcattttcgttcatgtgtcctccacctccgagtttggagctatgcgtagtgattg

SEQ ID NO: 36356 - DNA, 210 bp, Glycine max
  Peptide Sequence Number=SeqID_128041
atgttcaagacccttttggctatgcatttcggctattttgggcaaaagcacggttttcgtgcagaaaaatcaagtcgaagtacttccgtaaacgcttccgtaagcgattctgtggaaattcttcatcgttcttcaccgttcttcatccgttcttcgttcgttcttcgttcttcaacggttttcttttcttccgtttttaacgtgctttaa

SEQ ID NO: 36357 - DNA, 639 bp, Glycine max
  Peptide Sequence Number=SeqID_128042
atgtacaagtatatttcaagagaagactgcttatatacagacaccgactctattgtccttggtaatccacttccggaggaagatgtttcctcttctgtattaggtaaatttaaattagaagataagatcttggagggattctttttagcacctaaatgctatagctataccacagaagagtcagatggcaataagaaggtctataagtacaagggaccgggtagaaatgttataactccagaatggtataaagaacagtacgccgacccttcccgaagtctgataaagaaggtaacttatcaatttcgacccgattggaaagaactctcggttaaaaagaaagagagtacaaccactcttagaactctcagtaactccaagagaatacctttctttaatgaaaaagaaagttttaaaaggaaaacagctattttagaaaaagagaattcggctctttctcagaaattacagaagctggaacaggaaagaggtataatagcccagcggagagtagaagaaggaaataataccgaagataataatacattagagcaaaataatgctaaaagggctgaagataatatcaatggagatctattggatccagatacgatgccgcgggataaaaagcccccctga

SEQ ID NO: 36358 - DNA, 378 bp, Glycine max
  Peptide Sequence Number=SeqID_128043
atgaagaggaatttttggagcttcaatggaggcttcaatggtagagaagaagaagagaaaagcaacgtggaaagagggagaatttgcatgtcgcctctctggttccagttcctcgcgtttctctgcacccgtcggggtccgtttttgaaagcatggagcattatctacaacacttggttcgtcagcaggcggccaaccaccggggctaggtgcactactccagagcagtttggggctgaggtcgcatggcccagagacaggctcgaggcccaggtaggggaggcgccttcaggatcccccggcgatgcagaggaggcccgtaagaatgaggagatgacggacttgctcggtttcttgggagaaagcggagccacgtga

SEQ ID NO: 36359 - DNA, 77 bp, Glycine max
  Peptide Sequence Number=SeqID_128044
ggctccataatgtaggtggagtgatggaagcttacatgtggggcttctatggaggatggatctttgagcttcaatga

SEQ ID NO: 36360 - DNA, 119 bp, Glycine max
  Peptide Sequence Number=SeqID_128045
atcgcgtcttttccggtttttccgacgttttcctcgaataaacgttggtggcgactccgggggtggggctttcgtggaacacgcatcccgcgagtcacgcgtcgccctcccgccgaagg

SEQ ID NO: 36361 - DNA, 288 bp, Glycine max
  Peptide Sequence Number=SeqID_128046
atgcattctgaagctgaagcactggaacatatgaagaaaagagatacaggacatcaaagtgtgtcattgaagaataagacaagagattcaactgtgctgaaggtaggagatttggctaaagttgtgataaaacaagacatgaagggaagaaagcataaatatgagtttgacaacaataaacgtgagaagccagagaaggtaagggtggtggatgatgaaactagcaacgaacatcagctgtatgaagtcctaaggatgccatctagatgtgtatttctcaagatatag

SEQ ID NO: 36362 - DNA, 297 bp, Glycine max
  Peptide Sequence Number=SeqID_128047
atgtacaaagataattggacccaaccttggcccatgggctcagaaatctaccctgaggttcatgagaaccctagggctttcttcagtagctgtagcccaatcctcttggagcctcttgctcatggctctagtgactgctccaccaagatgaagatgctcttgataccacatgatgtagctccatgtggagcttgtaggccttggatcttcttcatcaacggattcctttgcttcttgaggtctgattgcagtggaatggagaaggagaaagatgaatggagatgccacttcaagtag

SEQ ID NO: 36363 - DNA, 336 bp, Glycine max
  Peptide Sequence Number=SeqID_128048
atggctagattgatgctcaaggagaagggactacctaacacattctgggtggaaacagtctacactgctgtttacatactcaacagatcaatatctctaagggctaccgtgtctacaacttgcaaactaggaaactcgtcatcagttgagatgttgaagttgatgagtatgcttcttggaattgggatgaagaaaaagtggagaagaatgttcttatacccgctcaactgcctcaagaagaagctgaggaagaagacccaggtgaaccaccttcacctccaccacaacaagaagatcaagaactatcatcaccagagtctactccaagacgagtaa

SEQ ID NO: 36364 - DNA, 699 bp, Glycine max
  Peptide Sequence Number=SeqID_128049
atgacacatgcacaacccaaaccagttgatttctctttgttgcacttacaagacaaccatatttcaaatcaagtgtgggaaggccaagagagattgattcttctgagtctaatcaccttagctggtttcggtcatgttataaatgttggaaaagttgatattaaccagcatttggatgtggccctacagttgggcttgaagattgatggattgtcagtaaccgatatcatcaccggtgatgtacgtgttgcttgtcaggccttactaggggaaactccacctgataagtatgtaaagggtaaaataatttaccaaagttggttgtggcaaaattttcagcaacttcacattgattctgaagatgttgtcattgcacagcatgctagagctcatatcatgatgcacataggctgttgtttgatgccagatacatcagttcttgtggactccctagaaataaggccattaatgaatgatgttgaggtattaatgattgttcgggcaaaagttcctctcacatgttttgcaattgtggaatggcatccaatagacagggtgatgagacaatttgggctacgaaaaattatttcagatgacccaccaaacctagatcaactccacgacatcgagagggagaacaaatattttttggcctcactatcattgtcactggattgccaaatgaaatcattggaatga

SEQ ID NO: 36365 - DNA, 550 bp, Glycine max
  Peptide Sequence Number=SeqID_128050
gatcctttacatgtaagacctatagctcatgcaatttgggatcctcattttggtcaaccggctgtagaagcttttactcgaggaggtgctctaggcccagttaatatagcctattctgcgggttggttacacttgcaaccaaaatggaaaccaagcgtttcgtggtttaaaaatgccgaatcccgcctcaatcatcatttgtcaggattattcggagtcagttccttggcttggacagggcatttagtccatgtcgctattccgggatccaggggggaatacgttcgatggaataatttattaagtatattgcctcaccccgaaggattaggtccatttttcacaggtcagtggaatctttatgctcaaaaccccgattccaatagtcatatatttggtacccctcaaggagcaggaactgctattctaacacttctcggggggatttcatccgcaaactcaaaaaccaacttcgggattggtcacagtataaaagatcttttagaagcacatactcctccggggggtagattggggcgtggacataagg

SEQ ID NO: 36366 - DNA, 372 bp, Glycine max
  Peptide Sequence Number=SeqID_128051
atgactagaggaaatccatctgacttacaaccctttgatcctgagatagataggacatttcatagattagttagacatcatttagtatcttttgagcatcctgagcattctgatattgatgattttgagcattataattttgaacattctgattttgtacattctgagaatatggcacaacctccaccccgtgagaggactctaagggaaatggctacacctgaattaattccatattgtctgctccaccatgaaaccaccagatgtccaggaggatcacatatttctgaaggcctttcctcattctttagagggagtggcaaaggactggctatattaccttgctccaaggtccatcacgagctgggatga

SEQ ID NO: 36367 - DNA, 318 bp, Glycine max
  Peptide Sequence Number=SeqID_128052
atgaagctttgcttccacatatacgtcctcaccttcagaggactacacgtcctcacctttagaggactatacgttctcaccttcagtggattgcacaccctcaccttcaaagggcgacacgtcctcaacttcagagtgctgcacgtcctcgcctttagagggctacgcgtcctcactttcagtgggctccatatccacgccttaagggatcgtgcccacaaggcacctagtggacccggaggagtccaacagggccctggggtttccagctcgggttacgggcctccgttagtcctacaaggtgtccgttccccctaa

SEQ ID NO: 36368 - DNA, 513 bp, Glycine max
  Peptide Sequence Number=SeqID_128053
atgaccgaccctctcgatgagtcgatctcttgctttctcacaagggtgaacccttgggtactagtacctatcgccttcagagggctgcatgccctcgccattagaggactacacgtcctcgccatcagagggctacacgccctcgccttcagaggaccaaacatcctcatcttcagaggactacacgtcctcgccttcagagggctacacgtcctcgccttcagaggaccaaacatcctcctcttccgaggaccaaacatcctcatcttcagaggaccaaacatcctcatcttcagaggactacacgtcctcgccttcagagggctacacgctctcgcctttagagggctacacgctctcgccttcagaggactacacatcctccatttcagaggagtacacgtcctcgccgtcaaagggctacacactcttgccgttagagggctacacgctctcaccttcagtgggctccacatccgcaccttaagagaatttaaggtcctctgcccttaa

SEQ ID NO: 36369 - DNA, 792 bp, Glycine max
  Peptide Sequence Number=SeqID_128054
atggcggttcactgtgactgtggcttgtgttataattgcgatgaacgatacgatccccaccacaaatgcaaggcgaagttctttctccttatcaccaataacgatgatgacctagtagatcctactctttccgatttaacttcaatggttgttgatgatccctcctccgatattggtcattcagatagttcatcccctgcccgaataagttttcacgatttatcgggacaccttacttctgccaccttgcgtgttgatggttttgttaatgggcacgacgttgtggtcctcatcgatgggggtagttcccacaatttcgtcaaggatggtactaaattactaaaccctcgatccctcgtcaggctgaatatccaagcttcgtccgcaaatcccccatgtaagactacacccgatttagacagccctcttaggtttagactaactcaaactgagtttcattcgcagatccctcatggggattcctcctcctcttctcagcatctcacactcactttctactcaataatctctctcatgacaaaaccaaggcttcaatgcacaagctgctcctcttttatgcttctagggctctttaccccaaataggcctgtggctgctcgggaattctgtgccttggccgttttgcatgttgtcctcagagtaagtgaaattgggcttagcgccagcctcgagcttagcctgttgaaggcacctgatgtgcttagcacactgatcttgcgcttagtgcgcaactttgatgctgatgctctgctagattctcctttgcgctaa

SEQ ID NO: 36370 - DNA, 390 bp, Glycine max
  Peptide Sequence Number=SeqID_128055
atggctgatgcgtccaccgataaagtagaacaacactggacacaagttcagatgatgaggactcttagcctgatgacattgtcaactttgatggtgaagagagagcatgaggatctcaagaaacctcatcaagttcatttagttgagtttgtcttggaaaccacttctcttagtaatgcactactggacgaaaaggtatctagtggatgcaaaaagtttcttaaggattttcaagacttggaagaaagggtgaaatccttaatcacagctcttaaagattcaaaagaagggtgcaaggaaatgcttaaacaaaaactcttagttaaaaaagaatgccccttttctaatgatgaacttgataagatgaaaaagaagaactcagatctctag

SEQ ID NO: 36371 - DNA, 254 bp, Glycine max
  Peptide Sequence Number=SeqID_128056
atgaccacattggcctctgcttgtcaatcggacttggggtctccgaatgacgaggtgcggataaccgaaaggtgtctccgcatgctaccagactcttgggtcatgagagcaaaaggtggggtggtcgacaaaagagagccttttgctcctacggtttgtggtaagttgggattttggctcaaggcttgtagaacggctggacatgatatatgtcaggatgttggtttggccagcggctcagggaaaaaggagaa

SEQ ID NO: 36372 - DNA, 303 bp, Glycine max
  Peptide Sequence Number=SeqID_128057
atgagtcttcattcttcatctagtgttaatggtgagggttctactcctaaggaccccttgtataagatattagatgagttgagatcccttaagttgtggaaagaaaaacaagagagaaaagaaaaaggaaggcataggtcacatcttagacatcactcccataggagagaaaatgaaagaaagcctcaagaggttaacattaaactcccatacttccatgggaagtacaatgtagaggccaatttagattgggaaataagggtagagcaacaatttagattgcatcatgacctctattactga

SEQ ID NO: 36373 - DNA, 411 bp, Glycine max
  Peptide Sequence Number=SeqID_128058
atgagaagatactacatgtctacagatgtaaccttctttgaagatagaccattcttctcaccttccgaagaccattcttcatctcttcaagaagttctccctattccttctccttatcctctagatgacttcgaccaaaatgtcattgttggtccctcttcctcaccggattcacctgaagttgtatcttcacctttgattacaaatcaacccaggacaacgcagattggatttccagtacctgaagcttctccctgtggttctcgttcttcttcagccagtcctccactcatggctccttccacctcttcttctcattctgacacacattggcccattgccatcaggaaagtttctttgttttctcattggcctcctttactattccttccattgtccgtgagcacttga

SEQ ID NO: 36374 - DNA, 255 bp, Glycine max
  Peptide Sequence Number=SeqID_128059
gcagagtataccattccagcaactggtggtggtggtgattctcctcatgtccgagaagcaaacatcccaatggaaaagggaggttatctaatttatggcactgctcatatgcattcaggatggaaggactttatgtacatcaacaccaaatatggaacaggaaaagaggctggaaatgagaaaggtatctcattggaatgtctgtttgttatccacaaccgggttcaatcaagattcatgatggtgaaattttga

SEQ ID NO: 36375 - DNA, 90 bp, Glycine max
  Peptide Sequence Number=SeqID_128060
atggcagatgagcacgaccagaggactacacttgaagactattcaagtagctcggtaccacaatttttcactagcattgcacgtcctgag

SEQ ID NO: 36376 - DNA, 249 bp, Glycine max
  Peptide Sequence Number=SeqID_128061
atgggggttcaaatagcaactaggccacttgggccttccaagatgttcctccagaaggcggttgcttctggaggaagcaacctagctcgcctgggagagctgggtggcaagcatctccttccttttcctataaataggggaaggagggaagaacaaaaatgttcaaccctcctggtatctgagattcacttaaaattagtgagaaaatttgtttccgtgaagaaaatccaagtcgaggcgctttcgtaa

SEQ ID NO: 36377 - DNA, 195 bp, Glycine max
  Peptide Sequence Number=SeqID_128062
atggatgcaactgttctgtcttgcaaaagtttccttctctcagttctgttccttctcagtgtagcttcaatttctaagtccaaaggaactaaagtgcctgtgggagatctatgcataaacagtactaacagaacaccggtatgtaaactatctatgcaaaaagaaagaaaatcacgcaagagaaatgctgtgtaa

SEQ ID NO: 36378 - DNA, 279 bp, Glycine max
  Peptide Sequence Number=SeqID_128063
atgcgtctaccgaggaaggagactatgctgatgaaattttctcaaaccataaatgagatcttggatgttagcatttcgtttctaaacgaccatttagaggaaacactgggtccgataaaaaatagaaggaaatcactcaaagtgtatcaatctcacacggggcaaggattgacattctcaccctgggtcaaggtttatggtaagttgggattttggctcaaggctggtagaaaggctggacatgacatatgtcagttttggccagcggtttgggggtaa

SEQ ID NO: 36379 - DNA, 892 bp, Glycine max
  Peptide Sequence Number=SeqID_128064
atggccgttactaatgttgccgagcttaacgcactggtagaacgtgttaaaaaggcacagcgcgaatacgccaattttagtcaggaacaagttgataccattttccgtgcggccgccctcgccgctgccgatgcccgtatccctctcgccaaaatggccgttgccgaatccggcatgggtatcgttgaagataaagtcatcaaaaaccacttcgcttccgaatatatctataacgcttacaaagacgaaaaaacctgtggcgtgctggacaccgatgatacctttggcaccatcaccatcgctgagccgattggcctgatttgtggcatcgtgcccaccaccaacccgacctctaccgccatcttcaaggccctgattagcctgaaaacccgtaacggtatcatcttctctcctcatccacgtgccaaagatgccaccaacaaagcggctgacatcgtactgcaggctgctatcgcggccggcgcgccaaaagacattattggctggattgatgcgccatcggttgagctctctaaccagctgatgcatcacccggatatcaacctgattctcgccaccggtggtccgggcatggtgaaagcggcttacagctccggcaaaccagcgattggtgtgggcgcgggtaacaccccggtagtaattgacgaaacggccgatatcaaacgcgcggtcgcctcgatcctgatgtcaaaaaccttcgacaacggcgtgatttgcgcgtctgaacagtcagtgattgtcgtggactctgtctatgatgccgtgcgcgagcgcttcgccagccacggtggctacctgctgcagggcaaagagctgaaagcggtgcaggatatcatcctgaaaaatggcgcgctgaacgcggcgattgtcg

SEQ ID NO: 36380 - DNA, 1000 bp, Glycine max
  Peptide Sequence Number=SeqID_128065
atgatggggactgttgcctcttacaagttacaaagcctttctccgaagaattcattgtctctttttgtcaaatgggcattcaaaaacgaaggcgaagaggaaaaacatcctcatttggtaaatatcggaaaagaaattgtgaacaaatgcaaaggggttccattggctgtgagaacattggggagtttactattttcaaagtttgaggcaaatgagtgggaatatgattatgaatttgatagtgttgaggtagctaggctttgggaggcacttggtgtccttgcaccaccaagaaagaatgagacaccggaagatgttgccaaacagtatctggatgaattactgtcaagatctttccttcaagattttatcgatggtggcactttttatgaatttaaaattcatgatttggtgcatgatcttgctgtatttgttgcaaaagaggagtgtctagttgtaaattcccacattcaaaatattcctgagaatattcggcatctgtcttttgctgagtataattgtcttggaaattcattcacctcaaaatcgatagctgtgagaaccataatgtttccaaatggtgcagaaggaggcagcgttgaatctttgctaaatacctgtgtgtcaaagttcaaattattgcgagttttggatttaattgattcgacatgcaagactttgccacgttccattggtaagttgaaacacttgagatatttcagcattcagaataatcgcaacatcaagagactccccaattctatttgcaagctccaaaatttgcaattcttggatgtttcgggatgcgaggagttggaagcattgcccaaaggattaagaaaattgattagtctacggtatttggagataactacgaagcaacctgttttgccttacagtgagattgccaatttgatctcgcttgcacttctgactattgaagttaccctggagctgcttctgcgtcatgggagaatcaattctcagatttcaatgttgg

SEQ ID NO: 36381 - DNA, 348 bp, Glycine max
  Peptide Sequence Number=SeqID_128066
atgaaagatgatgagaaaagaaaagtgcaagatgatcaaaaagctaaaaatattttaacttatggtttatcttctgatgattattttcgtattgcaaggtgtaaaagtgcaaatgagatttggaaaatgcttaaagtcattcatgaaggcactgcagtgtatcacttacttggtgtcgggaagacatttgaagatgatcagctaaacatcaagatcctcaattgtcttacaagaacttgggaattgaaaatcaaaacaatcaaggaatccaacaacttggcatcaatgtcgatggaagctctctctgaaaaactgcttgcgtatgtacatgagtttggaaaaagatga

SEQ ID NO: 36382 - DNA, 600 bp, Glycine max
  misc_feature (61)..(61): n is a, c, g, or t
  Peptide Sequence Number=SeqID_128067
atggcgagtcaagaagagtgggtcccgtttagggatatactagctttgctgatctttgggnttgtcctttttccaaacgtggacggtttggtggacctagccgcaattgatgctttccttgcttatcaccatagcaaggagatcccggtgagaagagttgattgggaccaatacttggctgggataggaggcggcacaatcaactggtttcctcgatggaaggaaggaaagaagggagttcttttctcatgtggggactacccaaatgttccgttgatagggacgaggggttgtattaactataatcccgcacttgccataagacagttagggtaccctatgaggggagcaccgacggaagaaagcctcttgcctttccttatgagagattttggcacgcaaagtctcaagattgtacaaagagtccacaaggcgtggaaaagcccattaaggaaagatagaaaagttaggggcatccgtaatggcatcatcggtggttatcatgaatggctaagagttcatacacgagggttagattggctctccaagttgaaaattatcaacgaggataacttcgaagctccggaagaggatgaataa

SEQ ID NO: 36383 - DNA, 357 bp, Glycine max
  Peptide Sequence Number=SeqID_128068
atgggagaaagatacgtaggagcaagagcctcgcttttgtcgaccacaccgtcttttgttgccataactcaagagctggtagcccgcggagacaccttacggttatccgcacctcgtcatttagtgaccccaagtgtgattcacgagcagagaccaatatggtcatctacgccctttccggagatgtcagcattttccgatggagacttttcaagtctcacaagttatccagaactacgtaggtctgagttcctcatgggaggatacgtaggagcaagagcctcgcttttgtcgaccacaccaccttttgttatccagaactacgtaggtctgagttcctcatgggaggatacgtag

SEQ ID NO: 36384 - DNA, 426 bp, Glycine max
  Peptide Sequence Number=SeqID_128069
gtcaatgcacctccttccctttggatagggcttgggattgacaaatcaaaggcccaagaacgagccaaagatcagctcttttcacaagccggaatgaagatgaagcttacaacgagacgagaaagaaaaagtccaccttctgcagatgatccagcggagttgaacacagctgatattgatccgctgctacatccgctgaaagatctgttgccagttctgatcgatggggataggcatgaaggccaatcattccggttatctgagtttccctcgacaatgccggagatgttctcagatgctcttagatcgggggttgagaagtacggaagtgacagagaagtcaaccttctttgccaagggactaaactatctgctctatctgatactgaactagatgccgcaaaagtcccaactctggctcaataa

SEQ ID NO: 36385 - DNA, 540 bp, Glycine max
  Peptide Sequence Number=SeqID_128070
gtggaggttgacctgctttgtgacagatgtggaatggagcctgaatctaccattcatgttttaaagggctgcccctgggcatctggcatttggctactctgcccattagcccttcatactcaacagatgcaggctctcaacttctcagattgggtgaaggagatggggaagtgtcttgatgaagagcagctggaacttatgctagtagttgcatgggctttatggagtgatagaaatttgctgctgttccaggacatacagaactatcctgtggatgtggtgaacaaagcaatcagcttcttcgaagagtataagaaggagaagctaaaaatagtgcaaacacctataggttggcaggccccaccccatggtgtttataagattaatactgatgctgcaatttttaaccagcaagggattggctgcttgcttcatcccgcccttccttccctcacctcacgcaaggctactagagaaggggtgaaaccagccaagggcgggctccaaggcgacaatagcaatcgagtggccaagcgttga

SEQ ID NO: 36386 - DNA, 402 bp, Glycine max
  Peptide Sequence Number=SeqID_128071
atgagtgagatagaggaagttcaagaacagatgaaggttgacatggaggccatgaaagaccaaatgaccaccatgatggaggtcatgatgagtatgagaaaaatgatggaggtcaacgaggctgcagtcgttgccacaagtatcgccactaaggtggacccgactcatccatttggtatcaatcaagtccaaagcaagcatcccttcccaccatatggcttgcctccctactatgcaccacccgatgttacacatgcacccgatgagaatgttgacaacttcgctcccatacccattgagagtcaacaaccccagtctggtcatgcacatgtctctcaacccatagggagacacatgaagtaccccgagaccacactctggttgacttggagcttcacctga

SEQ ID NO: 36387 - DNA, 474 bp, Glycine max
  Peptide Sequence Number=SeqID_128072
atgccatatgtggaagccgcggaggagtcattggaaacggccttccaatcttttgaggtagtaagcattgcctccgtagattccctttctgggcagccttgcctgtccgatacagcaatgatggtggcccgggtgatgttggggtatggctacgagcccggaatgggtttaggcaagaacaactacggcagaaccagcctggtaagcaccagaggaaaccgcgggaagtttggattaggctataaacccacgcaagtagacataaggaaaagtgttgcggaaaggaagagtagaggccaaagtccacaattgggtcgacaagtcaaaggggccccgccctgccacatcagtaggagctttataagtgtgggtctaggacacgaaggccaagttgtcgcgatatgcgaggatgactctccgagtgggtcggatttggtacgaccatgcccttcgggtttccgactaggaaattag

SEQ ID NO: 36388 - DNA, 146 bp, Glycine max
  Peptide Sequence Number=SeqID_128073
atgactacaggtgattcaccccaacagaagacaagtcaaggaaatgagaaaaagaaagaagatgagaatataactcaagactccacctcaacaggagagaagtctaagaatcgatatagaagaagaactcaagaatattacgaaag

SEQ ID NO: 36389 - DNA, 291 bp, Glycine max
  Peptide Sequence Number=SeqID_128074
atgcaatcacagggacttgcactgcctcctaagattgaggttggtccttcagctgcttatgtcaacacaaaggagagttgtgttgatccctcagggaacgacccagacacgggtcaaagaaatgcgggttctatgggaccgacgaaacatgcagatagatcagatcatgatgtcgatgatcccctatatctgatgacattgaccattccacaactttttcttaagtcgttgcagtatttcaatgatgttagaccattgcaaccagagagattgaaggcgcttcgcatctag

SEQ ID NO: 36390 - DNA, 285 bp, Glycine max
  Peptide Sequence Number=SeqID_128075
atggcagtggaatggagaaggaagaaagatgattggagatgccacttcaaggagaagatgagtcaacccactgatccaagatcaagtccaagattctccactgtggaagcaagactacaggagattttgatgatgccaacagtcaagtgttcttcatggataattcaagtgaacttcaagaaatccaagaaatacaagttacatctacaagttagattctcaagttggatttacaagttatatttgaaagcacaaagtgaattggtaatcgattaccagtcttaa

SEQ ID NO: 36391 - DNA, 450 bp, Glycine max
  Peptide Sequence Number=SeqID_128076
gaaagaaaagcgtcaattgctgctaggtccaccaacccatccacgtttggaaagaggaccactccgaagatcaagagtgccaggacatcgatgaacagagcctattcgtcttggctcgccaaggttctcgcctttgcttccaaacatttccttggtactccaaccaccctattttcaacttgcttccccgggtccaattcctgtgccgagattttgattattttggaaatcctagccaaagaaggattgaaccctgagaaaagatacggtttccttcctcctagagggcatcccaagatctcttcaaactattctatcgtgggtgttaactggaagtccccaaagggaggcaatggcctctgtggagacctctgccatagtcaggtcccagatcttgccataggccttgtgaaaggcttgtcgctggagttaacccatcaattgccctaa

SEQ ID NO: 36392 - DNA, 420 bp, Glycine max
  Peptide Sequence Number=SeqID_128077
atggatgagactgatctcaacctgaacgcgctatgcctctactacgaactgtatagatggcaacaacggaagggagctctctatgctgaccaaaggagcaagaggagtagtcgaaaaggaaggataatcatctcttatggaacgggtctagctttattagctggacaacttactgtgacttccactgccgactacttgctttgctcaggcttaggtgtgcaggctccggtactaccttgcatggctgagagcgattctggatttggactaggccttagctgcaatggtggaggagggtggggatggcttctagatctacttattggaatcgaagaatctactgctcggtcgactgactcaaccatgatctttattggggactgctttctatcaatcagaatcgccggaccgctctactga

SEQ ID NO: 36393 - DNA, 276 bp, Glycine max
  Peptide Sequence Number=SeqID_128078
atgggcgaggaagagaaaaaaccagaggaaaacaaagtggaggagaaaaaagcagaggaagaagaaaagaaagaagaagagaaaaaaaccagaggaatcaaaaaagatgacaaggaatccaaggaggaatctgcctcgccagaaatcatgcaaggcacaacctttgcaatgcatggacactttaagcacgatttttgggcatcttttaagttagggactattttgcaacacttagggcaaaagatagggactattttgaatttttcattaaggtag

SEQ ID NO: 36394 - DNA, 214 bp, Glycine max
  Peptide Sequence Number=SeqID_128079
atgccggttgcttctggaggaagcaacctggctcgcctgggcgagcagagcttgcctgggcgagttgagtggcaagatcctcccctattttgctataaatagggggaggagtgaagaagaaaagggttcagccttcttggcacttcgtattctcttgaaattgttgaggaaaattgtttccgtgaagaaaatccaagccgatgcacttccgtaa

SEQ ID NO: 36395 - DNA, 321 bp, Glycine max
  Peptide Sequence Number=SeqID_128080
atgtccccctatggctcttcaacttggaaagataaggagacactcaagaaggagggaggatcttcattcaaatctcatgaaaaaagtgttacccttggtaaaaataattttaaccctactcttacttcttcagaaatgagttttattaaatattttaagtgtttgggaaagggtcatattgcctcccaatgtcctaacaaaaggactatggttgtgctgggtaatggggatatcactagtgcatttcttctagctcttctagttcttctagtgagagtgaaagtgaatgtgatgtacaatccctggaaggtgatcttttga

SEQ ID NO: 36396 - DNA, 321 bp, Glycine max
  Peptide Sequence Number=SeqID_128081
atggagaattgcactaggcaatcaactacgcatggctctagactcattggtggaggatgcatgaacgacaatcaattcatggggctcggaataaaactcattggtggaggattgcatgaacgacaatcaattcatggggctccgaataaaagtggagaatggagaattgcactaggcaaaaactacgcgcatggctctagactcattggtggaggatgcatgaacgacaatcaattcatggggctccgaataaagtggatcgagaatttcactaggcaacaactacgcatggctccagactcaatggtggaggatgcatga

SEQ ID NO: 36397 - DNA, 243 bp, Glycine max
  Peptide Sequence Number=SeqID_128082
atgagtaaggactgggatcctagcgctgttgatgcagggtatactggtaaaagctctcattcaactacacctggcccctatggttggtcgcctactggtcagccaaatgctgcatgtagagttccatcctctgcattatttttcaatgaaggacctattaatgggaggttgaaaaatcctagtgggcataaccggcaccctatagaactggcagagaccgtgatcaagggtcagaaatcctag

SEQ ID NO: 36398 - DNA, 147 bp, Glycine max
  Peptide Sequence Number=SeqID_128083
atgaagaattttccacagaaatcgcttacggaagcgttacggaaagttttcggaaattttacggaagtattacggaagccgcggaagccccgaaaaccatttttcaaaaacgtggaggagcttgccgcccagttgcttcctccttaa

SEQ ID NO: 36399 - DNA, 177 bp, Glycine max
  Peptide Sequence Number=SeqID_128084
atggtaacggcctctagtaagtttgaagcggattcccttgatgatgacgctactgttgtggaagcaatgacttccaagattattttgatgatgtcaaataatcaagagttaagcaagttccaaagaatcaggcttcaagaatcaagtctcaaagaatcaagattcaagaacaattaa

SEQ ID NO: 36400 - DNA, 273 bp, Glycine max
  Peptide Sequence Number=SeqID_128085
atgggaaagacaacttgggcaagtttgatgcaaaatcagatgaagactaaccctataaggccaagaaaggaaatacttaatgatattacagattctttagaagatatgcatattgatgaaaaaggtcacaaaggcaaagaagatggaaatagtagggactctcaattcaaagaaaatcaaacaaatgtggatcttccaaaggagtggagaacttcaaggtaccatcctcttgataatatcatatatgacatcttaaaaggggtaacaacttga

SEQ ID NO: 36401 - DNA, 351 bp, Glycine max
  Peptide Sequence Number=SeqID_128086
atggcgtgcccgtctccccagcaaggcaggcgcagggcgaggcaccacagtttcctggggacgaccagcagcgggcgacagacgcaccactaccacttccagagtccacttcagctcatctacaaaggctggagcattgcctatgacacatggccgaccagcaagtggccaaccaccggggcagctcaagatgttaaagaagcactactaggaggcaacctagaattgtctacgaagaagctccccgcgaagaggtcttggaagggcaccattgaagagggttcttgtgcagccccacaagtcgacacaggctttgacaaacctcgattccagagcgcggaacatcagtag

SEQ ID NO: 36402 - DNA, 217 bp, Glycine max
  Peptide Sequence Number=SeqID_128087
gtgcggttaaccatatggtaaccccgcatgtcactttcctcacgggtcaagacggaaaaaggacgacaaaaggtgcagaagacgatgttagtccccgcgcgtcaacaggcttgtttgccccttggttgacgaaaggtaccgggcacatttgcccctggttgacgaaaggtgcgggtaaccataaggcttgtttgccactggttgaccaacggtgcgg

SEQ ID NO: 36403 - DNA, 288 bp, Glycine max
  Peptide Sequence Number=SeqID_128088
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggctgaagaagaggaagaggcagctgaggaagacaaagaagcagctgaggaagaaggagaagcagctgaagaagaagaagaagctgctgaggaagaggaagatgcagcagaagagacagaatcagatgatgattctgaagccaccccatga

SEQ ID NO: 36404 - DNA, 417 bp, Glycine max
  Peptide Sequence Number=SeqID_128089
atggtggcacgtgttatgctcaagaacggatttgagcccagaatgggtctaggaaggacggcctcggaaatgctgacagtatggcccgaccgtcttagccaatctttcactagtgtcggaatggtgtccgaggaagaagtggccgcagtaggagaggagttccctcaagacccaccaaattttgtgcaaccatgccaccccgattcccaagatcctaacaatgaaggtttgacaatcgatttcgatcgagatataaagccaaacgataaaagaggaagaggaagaggatgtcctttcaccagagttggagaggaaaagaaagaagtaaaggtaggaaccggtatgaccgcgcctatccaccaaggcttgataacccttcttgaagagtatcaagatgtctttgcatggtcatattaa

SEQ ID NO: 36405 - DNA, 531 bp, Glycine max
  Peptide Sequence Number=SeqID_128090
atggggacaaatcaaaacggcaaaaggttttatcaagtgaaggttaaaagtctagatgtcactagcctcaaggaattgggacgattgatgggacctctccaaaggcaagccttccgcaaagtgtacgggaagattctagatttaaccgcagcggaggtatttactgaagctgtcgtatccctcgcccaatactatgaccagccgttgaggtgtttcacgtttggggacttccaaatggtactgactattgaagagtttgaggaaatattaggatgccctcttggggggagaaaaccgtatcttttctccggctttcttccttccttgagcaagattgcagttgtggtcggagattcagcaaaagagttggatcacatgaagcaaactcggaacggcgtagtgggcctgcctcggaaatacttggaaggcaaggcaagggatatggtgagccaagagaagtggggcccgtttgcggatattttagctttgttgatttttggggttgtcctctttccgaacgttgacggtttg

SEQ ID NO: 36406 - DNA, 639 bp, Glycine max
  Peptide Sequence Number=SeqID_128091
atgggcccgaaatctaccctaaggctcataagaaccctagggccttctcttgcatctctggcccaatctacttggacttttctatccaatgcccttgctgggaaagaatgcgttttacgaagcccttatccaatgcgtgccagagctagagtgatgagtgaaatagaggaggtgcaagagcagatgaaggtcgacatggaggccatgaaagagcaaatgaccacaatgatggaagccatgatgagtataagaaaaatggtggaggtcaacacgactaaagtcgttgccacaagtaccgccactaaggtggacctgactcacccatctggcctcaatccggtaaatcctccaatctcggatatggtagggcagggaggcgaagcattaggaagtatgggcagcccccattttgtgcaagttcaaaacaagcattccttcccaccatatggcttgcctccgaactatacaccacccaatgtttcacacgctcccaatgagaatttcaataactccactcccatactcattgagagccaacaatcccaatttgatcatgcacatgtctctcaacccatgggggggacacatgtgttgaaccgcaaccgcaaccggcaaccactacatgggagggacagctga

SEQ ID NO: 36407 - DNA, 450 bp, Glycine max
  Peptide Sequence Number=SeqID_128092
atggcattaagggtcaaggtagctcgcccaggcgagctgttgcttcaacctgaagttgaagtaaccttgctcgcccatgcgagctcaactcacccaggcgagctggttacttcacccctaagctatttgggggcccaggcaagccaaaggctagcctgggctttactactaagttatgagaaagtaaagaacagaaacaataacttagacaaaagtaaagcggaaataaaaagtgcacaacggaaaagtaaagagcgtagggaagaagaaagcaaacacaagttttatattggttcggcaacgacccgtgcctacatccagtccccaagcaacccacggttcttgagatttccaataaccttagtaaaatcctttacaagcaaagagccacaaaggatgtaccctcccttgttctctttgaacaacaaagtagatgtaccctctacttga

SEQ ID NO: 36408 - DNA, 249 bp, Glycine max
  Peptide Sequence Number=SeqID_128093
atgccgcccagctcgcctaggcgagcaaggttgcttcctccagaagcaacagccttctggagggctcaagtgggcctgctttcgaagaagttacggaaactcacggattgcgcaaaaacacctcttttcgatttccgccacattacggaatttcacgaatcacgcaagcctgcttcctttcgatttttgagacgtctcgggacttcatttattgcatgtcatcaagtaataatccccagacaaaattag

SEQ ID NO: 36409 - DNA, 78 bp, Glycine max
  Peptide Sequence Number=SeqID_128094
atggcagcccaaggacatgaaatggactctcacgacttaatcaaaatgaagagaccgacaaaaggaaaagaagcatag

SEQ ID NO: 36410 - DNA, 738 bp, Glycine max
  Peptide Sequence Number=SeqID_128095
atggcggaaccatcgaagaagcgaaagggcacttcgagtcggagtcaacggcattccgggtcacaggaaacaccaattccttcctccattccctctggatcattgttttcatcagaggaacagcgtatacggtacacaaacctcttttcctctcattctattatagacctaaaattcatagatatggatttcttctcaaatgagagttttgaatgctttcaagcatttgaaaactccattcctattccattcatgtctctgaaattacctgtttattctaatctagtcaaagccttttattctaattttgaaatccatgaaggcaccctaatgtctgaagtttatgggattaagatggtcattgaccaatccctattctatgatttaacccaattgccaagcgaaggtgtaccatttgaaggtgcactaattgacgattggaagtttgatttctctatacatgatgcccgctggttggtttgcaccaaccaagcggatatgaccgaaggatacttgccggttgtcgcaacgtgcccttttgcgggcgagagaaggcgaggctcacgggtgcgctttccaaaggagaaaagatgcgcggagtcgccaccaacgtttatttgtggaaaacgtcggaaaaaccaaaggaaaccggtcaaaataaaaattctaagttcgggagttatatttaagtttgaggaaggtattagcacctctcacgtttgtctcaaaggacaatag

SEQ ID NO: 36411 - DNA, 258 bp, Glycine max
  Peptide Sequence Number=SeqID_128096
atgccaatctccccctgcgaaagtatcggttggtctgtgccgtcacgacatagggattgcgcccgcaagacacccagcggacccggagaagcccaacagggccctagggtgtccagctctggttacgggcctctgttagtcctacaaggtgcccgttccccccaacaagggattgcgcccgcaagacacccagtggacctggagaagtacaacagggtcctggggtttccaactctaattacgggtgggatcctctag

SEQ ID NO: 36412 - DNA, 222 bp, Glycine max
  Peptide Sequence Number=SeqID_128097
atggctcccaactcgatggtgggggacacacgcacgaaaacgaaattcatgggggtccgaaaaaggttgagagtggagaattgcactaagcaatcactacgcatggccccacactcgaaggcaatcactacgcatagctccaaactcgatggtgggggacacatgaacgaaaacgaaattcatggggctccgaaaaaggttgagaatggagaattgcactaa

SEQ ID NO: 36413 - DNA, 504 bp, Glycine max
  Peptide Sequence Number=SeqID_128098
atgaagacccgagccctggcgatgtcattgctgtttgcgctggcggccacgcctgcactggcgcagtcctcgccaccggcgaacgcggtggctcctggcctgctgcgcatcgatgtcgacgcgcgcgatctggcccgtcgcatcttcaaggtgaccgccacggtgccggccaagcccggcccgatgaccctgctgtacccgcagtggattcccggcaaccattcgcccaccggcccgatcgataaattggccggcctgcgcgtgaccgccaacggcaagccgctggcctggcagcgcgatcagtacaacgtctatgcgttcaaggtgaacgtgccggagggcgccagcgagatcgtcgcccacttcgatttcctgtcttcgcagggtggcagccaggggcgggtggtgatgactccggaggatgctcaacctgcagtggaatgccaattcgctgtatccgggccggcgtcgatgcgcgccagctgcaagcgcaggccagcgtga

SEQ ID NO: 36414 - DNA, 651 bp, Glycine max
  Peptide Sequence Number=SeqID_128099
atggccccgaggaaacttgcctcaaagagatccaggaaggataaagcggccgaaggaaccagttccgctcccgagtatgacagtcatcgctttaggagcgctgaacaccagcagcgcttcaaggccatcaagggatggtcatttctccgggagcgacgcgtccagctcagggacgatgagtataccgatttccaagaagagatagttcgtcggcggtgggcatcactggtcacccccatggccaagttcgatccagacatagtcctcaaattttatgccaatgcttggcctacagaggagggcgtgcgagatatgaggtcctgggtgaggggtcagtggatcccgtttgatgcagatgctatcggccagttcctgggataccctttagtgctggaagagggtcaggagtgcgagtacagccagagaaggaactggtccgataggttcgatgaggaggccatcgcccaattgctatgtataccggggcaagattttgcccgaactgctgccgggagacgggtgcggatcatgcgcaccaacatgaccaccctgactcagatctggatgactttgctgctcagcaacatccagcccagcgatcataattccgacctccccctgccgaagtgtcacttgctgatgccatcctga

SEQ ID NO: 36415 - DNA, 1466 bp, Glycine max
  Peptide Sequence Number=SeqID_128100
atgcggcaaggccagcatttgcaagcattacacactttgcagcaagaatggcagatgactattcctgcagtcatgccggatacgcagccttctgcgcagcagcaggaggctttgctggcattgttccgacagcaacaatacacgcaaatggagcaggatctgcaggcattcttgcatcagtatcccgcctggctaggtggttggaaaatgctgtctgacgtattgatgatccagaaaaaggatgcacgagaatctgctgcccaggcactgcttctgaatgtcgatgatgctgaggaacattgctattacggtttggcactcaaggcccagaatgatctggtcgcggcagctgaggcttttaaacatgcaatccagctcaaacccgcctacgccgctgcctacaacaacctgggtattgtgcttaaggatataggccaggtagaggaggcgatccagcagttcaaacaggcgcttatcttgcgccctgagtatgctgagggctttagtaacctgctgttttgcatgacacatgccgaacaggtggataacgaagctttactgcaggcgcatatcgcgtatgccgatttatatgaagcacctttgatggcgcattggcagccacatgccaatacacgtgatgccaagcggccattgcgtattggtttcgtctctgctgatttgcgcgcgcactcggtcgcgcacttcctgttgcctttgttacctggcctggcaaaagacgcttcgctggagttgtttgcctatgctaactatgcactggaagatgaggtatccgccgagatgcgtcagtatttccggcaatggcgcatggtgagccatatttctgatgatgacctggcagcctgcatcaggcatgaccagatcgatatcctggttgatttgtctggccacaccgctggcaaccgtttgttgacctttgccagaaagccggcaccgctacaggcctcctggctgggttaccttaataccacaggtttgtcggcgatggattactacctggcagacagtgccttgctcccgtctggccagtttgaccagcagtttagcgagcagattgtgcaattaccggtgaatgcaccgtttgtagcacatcctgatgccccggcagtcaatgcattgcccgcattaaagaatggttacctgacgtttggctgctttaaccgtcccaataaaatcacgcgggtaaccgtacagcaatgggctgccgtcatgcaagcttgtccaggcagccgcatgtacctgggcgggatgggggaagcgggtagctatgcgcatctgcagcaatggtttgctgaggctggcatcacggcagatcgattgtccttccatgcacgtactgatatgctgggttatttgcagcagtatcatctggtggatgtgtgcctggatactttcccatccaacggcgtcaccaccactgcccatgccttgtggatgggcgtaccaac

SEQ ID NO: 36416 - DNA, 223 bp, Glycine max
  Peptide Sequence Number=SeqID_128101
atggctcaattgatttctcccccgaagaagtccaacagggccctggggtttccagctctggttgcgggcctctgtcagtcctacagggttcccgttcccccagggaggaatcgcacccataaagacactcggtggacccggagaagtccaacagggccctggggtttccagctctggttacaagcctctgtagtcctacagggtgcccgtttcccccagcaag

SEQ ID NO: 36417 - DNA, 354 bp, Glycine max
  Peptide Sequence Number=SeqID_128102
atggcgaatcaagaggaatgggtcccgtttatggacgtattagcattgctaatctttggggttgtcctctttccaagcgtggaaggtttggtggacctagctgcgattgatgctttccttgcatatcaacatagcaaagagagcccgatggtagctatcttggcggacttatttgatacattagaccgaaggtgcgagaaaagtagcgcacggatcatatgctgcttacctgcttctttgtgtatgggacgagggggttgtattaactacaatcccgcacttgctataagacagttagggaaccccatgaggggagcaccggcgcccccccccccctctctcctttccttatga

SEQ ID NO: 36418 - DNA, 195 bp, Glycine max
  Peptide Sequence Number=SeqID_128103
atggttaaggaagagtgtatggagataaacattaaagaaacttcccctcttagacaacctccatattttctcttttgtcaaaagacacttgttagcactgtcacacctcttgggcttaaggttagtcctcaagtaaaggagtttttggatgatggtttggtgattgaagtcatacctgaatcaaataaacattaa

SEQ ID NO: 36419 - DNA, 255 bp, Glycine max
  Peptide Sequence Number=SeqID_128104
gtagctcagaccgaaaaatcagagcctaagttctctgatacagagtatcagaagtatctgaagctaaaatccgagaaatccagcagccaggcttcatcttcctctgtaccatgttattcaacagcatgtattctcaatctattgacggtcccagtccttggatacttgattcaggtgtctctaatcatatttctgctaatggttccaaagttgcagctcaagggagtggtcaagtatctttatcttcctcattga

SEQ ID NO: 36420 - DNA, 228 bp, Glycine max
  Peptide Sequence Number=SeqID_128105
atgaaaggtctttttgttacaaaacttgaaagcaatgaagattggtataacataggcaccaattatagaataaattttgagccaaaacaacaagcacactttgatgcaacctccattggagcttgtaggcctaggatctcttcatcaatggattcctttgctccttggaagatgaatggcagcggaatggagaaggaagagagagacgagacaccacttcaaggataa

SEQ ID NO: 36421 - DNA, 462 bp, Glycine max
  Peptide Sequence Number=SeqID_128106
atgggtcgtaagcaacgctctaaccttttcgtggatcagctgaggctgctgcggtgtttcgccctgcgcctgcctggggacgcagtacttcttgatgaaagctcgattagtagggggcctgatgcccttgctggaggtgacagggggaataggcaccctgtaggactgatagaggcccataaccagagctggaaaccccagggccctgttgggcttcttcgggtccacttgggtgtcttgtgggcggggagattggcattacggtcgctgtgcagaatgttgctaagtagcaatgtcatacatatctgtgtaagagtggtcatgttggtgcgcacgatccgcactcgtctctttgcagcggcacgggatcagagggtgacccaggaactgataaaaggaaactacttgccccttaaccgagagcgcaagtctcggttaagcattaagggcagaggaccttaa

SEQ ID NO: 36422 - DNA, 317 bp, Glycine max
  Peptide Sequence Number=SeqID_128107
atgagcgtagagcagttcattgagaaggttgcctggcctggggctcgaccttcttttatgggggataatgaaagttttacagcccgggcacctcaacagcatgagccagaaccagaaaatgatcactcatctgaagccatcatctctggagctgctgctcatcatggaccaatgccagcgtcagttgatgcaccatttccaggagtggatccatctccacctcagcatgtagtagactcttccattcctgtcttagagatacatgagggccaaaccataccagttttgccttggacacttctcctcccgctactcca

SEQ ID NO: 36423 - DNA, 939 bp, Glycine max
  Peptide Sequence Number=SeqID_128108
atgacttccaagattattttgatgatgccaaagaatcaagagttaagcaaaattctaaagattcaaaaatcaagtttcaagaacaatcaagatcaagattcaagaatcaagagaagactcaatcaagataaagggtacatctacttgggttgttgtactgagaacaagagagggtacatctcttgtggatcagttcaagtggaggggtttccgcgtgccctccaccctgctcccgacgctcccaatgccttcgctcatgacgtttcagcgctcctaatgccttcattcccgatgcttcaccacacccccattatggtggaagccgtgagaaggtcaactctttacactaatagcgtttccctcatgtgttttcttggtacagtaatctcatatgatttctggatgtcgttgattgctgatctcatgctgcccaactcttcccctcccacgattcttcctccccttgacatccactgggtttggttctgtcacactttaaaccccgtaagttacagggaatattgtgaaacaagattctcaaagctgattgggaaagcgggaatctttgatgaagagaacagagaagccatacaggttcgaggtggtctacttgatagctgcgagacaacgatacaaggctttcttgtttatgctgctgaggtgaaggaaaaggagtttgaagaaaccaagaagttgtgggatagggcgttcaatcaaccttatgagaaagctggtggagaggtgcctttgacgttggagggtgttatctcaatcaaatcccctgtctattgggaggattcaggcaccgatgtaaatacaaaatacaggtccttcttccaagatttttactggaggtcccaaaaacatcgaggaatgctaaatcaaggaaaaattgaaaatctgcttcaactagcaacaatgaagatgatagaagcttga

SEQ ID NO: 36424 - DNA, 840 bp, Glycine max
  Peptide Sequence Number=SeqID_128109
atggcagctaatgatcacgccattcttcgtgatcacacatatgcaccaacaaagagaagccatctagaactcaccactcaagatgcaatcttggctcaaaagaagttgttgtcccaacaaatagaagccttgatagagaccctcaacaagcttccacagcaactacaagcggaccacgattggagatattatccaagtaataacttcaaccaagggggttcaccctatcagcatcctagccaaggtccaagtcagcaagagaagccacctatcagtatagaggaaatgctattaagcttcatccaagaaacaagggcattcatccaggagacgagatcacaccaaaagagcacagatgcagccatcagaaacctggagatacaaatagaccaactagctgagtcaattactgaaaagcccactgaaacctttgcggtaaacgctgagaggaagcccaaagaggattgcaaggtaattttgactgagagagaagaggaagaaaagaaaactgaggaagatgtgtgtgataaggaaggagaaaagaaggaagaaagagaaagaaatgaggagaaaacacaacaatgggagaagcactcacaagtagaaattcagcaagaaagtattctccgaatcaatacccctcctcatcaactgattgtcaaggaagaaaggcatggaaaacatgagaaagccttaagtgtcattctttccttgatcgctaccacttctcttgcaataatgttgaaggtgtttctagaatacacgagtttcatggcgtctctaactatgaggcgaaaatgcaaggaagatgtgttctacgtgaccttcatgccaccttga

SEQ ID NO: 36425 - DNA, 270 bp, Glycine max
  Peptide Sequence Number=SeqID_128110
atgtatcagtcgcatattcgaggcgccaatgttgttatctcattgtatgagactaaggttaggtttggaaggcaaaggctggtgttgtcccaacccaagatatctcatagtcatatctttgttgtgttgtgtagaaagaagtatagcaaaggaatggcgaacatagatatcgaagggatcttaaagcagcaacctgatgatggactaatgaagtcaacagtattagccagtttgttggaacttgtgtttgttgaaacttgtgatagatga

SEQ ID NO: 36426 - DNA, 264 bp, Glycine max
  Peptide Sequence Number=SeqID_128111
atgtcagtgaaaaatctcgtcgggcgcctaggagtaaaatcatacggaggccagtcagggtcacttagttttgcgagcacgctccaatcatatgggatcaacataggcttcaaggaacattccaaccaagtgtatttacccccaaggcctacactccgaagagtctatcagggtctttccctcttgattcaagtccaacccaaaaaacatgttaacacacagactttatctatgaactttacaaaacacacgtctcctcaatag

SEQ ID NO: 36427 - DNA, 723 bp, Glycine max
  Peptide Sequence Number=SeqID_128112
atggagactgacagacctgacagccagactcccaatcaactgagacccctggcctgctcctgctcctgctccatcctacatcgatcccatggctcggccagttgggctcaacgtgaaactaaagtgcttgctgcagtttacgggcccaaagctggaaccaagaagaacgaaaaccccaaaaaagcatccattaaagttatttggaaaccgaagactggacaaattggaaaagtggagaaggagtatgagatgatattgaaaagaactttggaaagcatctgcattcgaacaatatatcccaacaccaccactttggttatagtccaggcaagttttgttctcaatattagaaatttgcttcttccatgtgcaataaatgcagcatgcgttgcacttgtggatgcgagaattcccctaaaacatcttgttgtagcaatatgttgttctataacagacagtggttgtattatattggacccaaccaaagatcaagaggagaaaatgaaagcattcatcaatttagtttttccaaatacaattgtttctgtcctcccagagggatcactacaggagggtagtgagactatggcacatggaatcatgacatctattacacagggtgctatgtcaggtttgggagggtttgtggcatgcagagcactctcacaaaggaatactgatcctaccaaagcttcacgcccttgggacattgcaatactatag

SEQ ID NO: 36428 - DNA, 189 bp, Glycine max
  Peptide Sequence Number=SeqID_128113
atgttcctcgtattcaacactagtgctttgaaaggacttgatgatactccacaacctaaatccaaggctactgcttggtggattgttgttaagtattttaatgaagttagaccattggaagcagagagattcaaggcgcttcgcatccagtgggcacagtattatctaaaagttagaaatcaaacatag

SEQ ID NO: 36429 - DNA, 543 bp, Glycine max
  Peptide Sequence Number=SeqID_128114
atggatccaaaaagatcaatagaggatcaattctccaagctgcatccttccatgccagtaaacaccagaattggaatagtgggtgctggttcaagtggcttatcaattgcttatgcactggataggcttggttataataatatcactatcttggagaagcatcatacagttggtggcatgtgtgaattagtagaaattgaagacaggctgtccactagaaaaatcactatgaactcccacaagcttgctgttattgatagcttctctagaaaataccaagaggttaaagttactgatgattatgtatttgttatgtcaccaacattgcaaatccaagtgaagaattctggtcattttggggttcatgctctcagtgaagttgcttcacacttagctccagattatgttgagcatcatggacttaaatctattcctaaatcagtggctcatggttatactgcttcaggatatggatttattcaacacatgccttatgcttacattcatgaatttaccagaacttccatggctggaaaaatttga

SEQ ID NO: 36430 - DNA, 270 bp, Glycine max
  Peptide Sequence Number=SeqID_128115
atgtatagctctccatcaggggggaggggggcgggggcaaggggacactgtttaaaaataggaagacaccagcatgcaagagcacagacccctaatcgcacaagaatgattataaccagcagagatctgcacaactttcttctcctctccaaaaacacaaagtggctcctaaaagatcccaagataggaaaaggctgtcaagtaaatttacggttctttcttatgtccaggggaactgcattcctcaacaattggacaaagccaacataa

SEQ ID NO: 36431 - DNA, 1032 bp, Glycine max
  Peptide Sequence Number=SeqID_128116
atgccacgtccttgtgatccatccactttgccaaaacgaagagcagcaaataaaggatatgaacatgaatcagttgggagaaattttagagagtccaaagctgtgccagtacctgatgctaatgctgagtttcaggcaactatgaggagacaaggacagtgtaattctaagtgcactattgagaagtacaatcctcaagaggatggccattacggcttccaccatgaacctgcaaagtcaagagcactcaattggccagaagatcaatttggcatgagatatagccatcaggctgatggtgagtccaacaaattattagatggactcaaatcttctcagaagaaggactttcatcctgttgataaggattgtactaagggctatgctaacaaaaatgctcgcatgcaccattctggaccgttgctggctccagaggataatcgtgaagaaatgcttaaggaacatgaaaggcaaatccaacaggctgtccgcaaagttcgtttgggtaaggacaagacaaaaaatgctgacagtgagaatggcctaactgaatcgctatttcagcatgtgaaatccatacctttcagtggaactggaaagcacaaatacagttttcagaatattaaagttcctcctctccctgtgcatttttgtgattgtgaggagcattgtaagccttttgtccctgaaagagaaaagctatctattgatagggcagctgaaagtggtggaataaatgatgaagagattagcataatgaatgctgtggtgaacaagctatttggaaaagaacaggtttccaatgccaagaaccttggagaggagaaggattcttttgaatcacctgatgctttacattctgatgaatgcgaagatagtgcaacagatgaagatgatctcattattaacgtggagacaaagaaaaataaaacagctttaacagagaacaaggaacttcaaaggatcttggaaaaccaggtatttattttctatttctgggctgcggtgggggcaaaaataaaccagctttaa

SEQ ID NO: 36432 - DNA, 618 bp, Glycine max
  Peptide Sequence Number=SeqID_128117
atgaagctggaaccggctaacgacaggctcgaggctccggcgttcaccgccgtcagaacccggcgatcgtgcgccgtcaaagcgccggcgactgcgacggaggtcgccattacacggaaaaagctcgctccgaacggcactagagatattagtggtggttgtaatgacaatgtgagtgacatgggtggtgatgatagcaatctcgatgatgtcagtggccatggtggtggtggtagcataaatggtggtgatagttactatgacattgatcatagttgtaatggtagtgacagaggtgacattgttggcagtggtggtggtggtgacaatgacaatgcagtggcaataacattaatgatggtggtggtggtgataacaattgaggatgagggtgggtggatggtggtggtgatgacagcagtaattgtggtggcaccaagtggtggtggtgatggttgtggtggcgataatgacggtgatggtggtagcaataccgatgacgatggtagtgttagtgatgatggtggtagtggtaacgatgttggtggtgacagagcggatcgcttggcacaggttatagagttttgggttgacgccactttcaaagaggaaagataa

SEQ ID NO: 36433 - DNA, 582 bp, Glycine max
  Peptide Sequence Number=SeqID_128118
atgatgcacatgacattttactggggcaagaaggtgacgatcttgatcgattcatggaagacagattcctggacgagttactttctgagtctactcgcctgcctcgtcgctgccgcgttataccagtacctcgagaatcgtcggattcgcctgaagctcctcgccggcggccggaggccctcgccggcgccggagatccgcgctcctcttctccggtggggcgtcgccggcgacaaggagaagttgggggtcaagtttgcggaagcggttctgttcggggttaactcggcgatcgggtacttgttgatgttggcggtcatgtccttcaatggaggggtatttttggcaattgcggtgggtctcaccattggttatttcttcttcaggaatgaaggagagaatgacgcgcttgttgttgataataattcttgtgcatggagagatattaagccttttgtgaaaaagataaaagcactctttgcagtcacaagtagtcctcaattagctgaagcagatttcacacgaaatggtccatcctctgatctgcttgagaaggatcatcagcagtataaaattcactga

SEQ ID NO: 36434 - DNA, 1893 bp, Glycine max
  Peptide Sequence Number=SeqID_128119
atgttgactagaagaaccttggatcatccgcgacctattgtcaccgttaatgctgcaactgggcgaggatcaggcccccataaagagaaattccacagttatttaggtgttgtagctagagaaaaagttccaattgtacataacagttggaaggatgtaccggacacactaaaggagctagtatggaatgagattttggccaagtttgatatcccagaagccctagatgcaaagaaaaagatatgggaggaatttgcggcaacccgcaaaacccctagttggcaggactcgctggaagaacaagtggcacagggtgagtttgtcccccagggtcgtcatgatatacttagcacggccataggaagaccagatcatggaggtcgtgtttgtgcagctgggcctagggtcacaattagtcaatactatgggaggatatcacgtgcctcaagtagctcatccatagcattcaccaaagaacagttggctgaaatagtagtaaccgttagggaacaagtcatgaaagagcttgaagaagaaaagaagcaaagcctacaggcttggaaaaaggagctgaaggatgccatcattactgacatatttaacggagacaatgacttagcaccggctaattttgatttaaatgtgttaggtgcacgcgtgagcactaaggagagcaatactgaaattgctgtgaacccatctggggaaatgcatgttggtcgtgtaacaccgcctatggggttgtacgtccaaagtcaaaattgtacgaagctggtggcgttggcaaaaattcatgatggaccatccaccatacattgcgtagcgtatgcagatgatgtcgtaagggttagcgtcaaacaagtaattgatggtgaagctgaagttccattaccaacatcagaaattaagtatgtgagagatgtcgttaacacattcattgcatggccattgcctttgcattcaggcatcactccagaaaaagttgtcaatgctgccgaattaaacaatgatgttcctaagcaagaccccttgcgtgagttgattaagacccttgttgacatttacgacaagcctgttgagtttgtgtgggatcttattgaatttgggattccaaatgtaaattcatcgttgttcttaacgtatactgatgtcagcaaaataacatcaggcgaaaaatgcttgaacatagccatacttcaattgtggaccatcgcccattggcaaatggttgtgttgtgccctaaagacaatgtcgtggtctgtgcatacaagaaattaaacacgactgctgatggcaaaactcacgttcaacgcggaggctatgagtgtgggtattatgtgatgcattggatgtggaacataattggcgcggagttgaagagtgattggactgtgtggttcggtgatggctcggcactagactcggaggcgatcacagcattacgtaaaaaatgggcagcttactttttgaaacttagaaccatccaatgtacaaagttcgttgctcctttaatggaattactattagctggagctgatcctcatgcagtggatgatgaaggtgaatctgtcctgcatagagcatttgccaagaattccattgattgtgcccttgtcatactggaaaatgggggcagtagatcaatggccatcttgaattcaaagaatatgattaattctttgagggtggtttgtcttgctgcgagttcaatggctggtgttggttcttcttcttacaaaggcaatgacaacattctcttttgctttcactgcaagtccaagacaataaccttcattaacggatggcagcttcgaagtggcggtttagctctgctctgtcaaaactgcggatgtgttttctttgtcctctcttctcttcttttttcttcataa

SEQ ID NO: 36435 - DNA, 444 bp, Glycine max
  Peptide Sequence Number=SeqID_128120
atgaaccaccttatttcaagagtacttttatgtgatgatgacgataatgatgatgatgatattagcaacgacaatagaaataccaacagtggtcatagtgacagcggtggtggagatgacattgaaggtagtggtagtgacgatgtggtggtgataacggttggtgagggtgatggtagtgacactggtgagattgtggtggtagtagcaagtgattgtgtggtggtggtggtggtggttgtggcgacgttggtggcgattgtggtgacaatgatagaggtaatattgttggtaatggtggtggtggggacaatgaaggtgacggtgaaattgacggtgatagcgatcgtgacaataacagatgtggtattcgtagtggtgataaatggtggtagtagtaaagaatgtcattgtcaagggtggagcaagatcgttttattgtaa

SEQ ID NO: 36436 - DNA, 993 bp, Glycine max
  Peptide Sequence Number=SeqID_128121
atgccacgtacaagaggtggtgaccacaccagacctactgcatttgtacgtaggtgtgcagttgtagatgaggagcaaaagatttacgaagctcccgaacatgttgtcgctgatgatgttgcacctaaagatattgtgtttggtgttgtagatgaggagcaagagatttacaaagctctcaaacatattgtcgctgatgatgttgcacctgaagatgttgtgtttggtggtggacctaaggacaaatcagtccttactaaatatgttgatcacatggcttgtaaattgtgggatagcttggactgtggagagttaaagctagtagcacatggaaggaagttgagggatttgccccccctcccccataaggagatcatgcaattggtgcaagttttagggttactttcattgactaaatgtagttatgaaaccattgacaagggacttttatttgcttttactgagaggtggcatcgtgagaccaacacatttcatttgccaataggagagatgacaatcacacttaatgatgtgtcatcattgctacatattcctattgttggtgcactagacgagttgaccatagatagagtgctttggatgccatataaggagcactgcaatgtttgtccatttgggatgttatcactattttctggatatattcagcttgggtcaaacatgcatctacattttcctaagagagtcttgcaacaatttgactatacacaaaactattcctcaacacccatctatgtttacaacggttgtgttataggttacatggagtggtattttaggatctcgcatccgtttgtgctctcagttaataaagaatgcattcctattgtccaaccagtgataccagacatgagagatgagatgatcaacttaaggatggtgactgaaggcaccacaacatgggagaaggttcaaacgacacttttgttgttgtctgaagatactcatggtggaaatattagtagaggatga

SEQ ID NO: 36437 - DNA, 798 bp, Glycine max
  Peptide Sequence Number=SeqID_128122
atgaatatctataataacattctttgctggcttctactcccatacttcatgttagcttcttcttcttcttcctctttctgcaaccaccatgacacctctgccttactacttttcaaaaactcactcaacactcctttcaaactagaaaccttgaaaaagcacacagattgttctgagtgggatggggtcacgtgcgacaccatctcaggccatgtcatcggtcttgaccttagcttctgtaatcttcaaggtcagctccatcccaactgcaccatattcagcctaagccaccttcaacgactcaacctagccaaaaatgaattttttggtgacattccctccataatctcttgcttgtccaaattactattccttgatcttagtagcaactacgactccaggagaatgagagttgatccatacacatggaacaaactcattcaaaacgcaactaatttaagagagctttatttagatgacgtggacatgtcttcaatcggagtcagctctttgtcattgctaaccaatctatcttcctctctcatctctcttagtcttgtatccaccgaattgcaagggaatctatggagtcacatcctctctttacccaatcttcaaatgctagatttgagttttaataaagaccttggaggtgaacttccaaagtccaactggagtactccactaagcaacttggctctctctcatactgctttctcgggaaacattccagattccattggccatttgaaatctcttaacacactatatctatggggttgcaattttgatggactg

SEQ ID NO: 36438 - DNA, 252 bp, Glycine max
  Peptide Sequence Number=SeqID_128123
atggctcaacagaaactgaatgggcttgagaagcagaaagaggaaatgatgaagttgaattccccacaataccttctccaatggattcaagaggctatgaataagacagaagtggaatatgaaaatctgcatcagcaagtccttcagagagacattgacattggagcttttctgcagaaatacaaacagctgcgtactgcttaccacaggaaaagtctcgtacatcttgcagctagaacatcaaatatatag

SEQ ID NO: 36439 - DNA, 255 bp, Glycine max
  Peptide Sequence Number=SeqID_128124
atgtcaggttgtgtagttgtcaaatatagaaggtttccaattagacttcggtatttgctggatgcatcagcttctggtgctccatcattcttctgtagtttctcatttgttatgagtggagtagcaacagatgatgacaaaggtgatgacaaaatgctcaaagatcaatcaaagaacaactcaagtgaatcaagaacaattcaagagttcaagataagaataaagaagaattcaagactcaagaagaaagtttag

SEQ ID NO: 36440 - DNA, 990 bp, Glycine max
  Peptide Sequence Number=SeqID_128125
atggagcaagaagttgcaattgctatatttatagaactacgtatttatccccatttaaattttatatacctcttactgaaattcattttggagttgtccgcgtattctacgttcaacctttccaacccagaaacggaacaacaacacactttcgaggaacctcaaacgaaacctgaattagggtttctaacagaaaaaattgcttcactcaccgaactagaaaaggttgaggaagttgaaacagaaacaaagtctgtgtcacgtcctagtgtactcactaggtgcaaatcggaactggcgagaatcggacacagacttgaccctccggtggaagatctcatgaaggcaggagaaaatttaagagcaaaacttggattgcacaaacgtagaataaattggccagctcccaaagttggtatcgagttatatagtgtggagagtcaagaaatagaaagtagtatagttgatgcttcagctgcttcaagaaaacgtagaagagatgaagaggaggaagaagaacttgaacaagcatttttcattattgttagtgttgccactatgcttttgggtgcaatgacttggtatcataacaagtactttgttaaggaacctgctcaaaatttggaattagaaaggcatagcttcctcaatcgtctatatagaggaacaaaaactgattgcattgaacaattaagggtcaacctatgtgcaaaggataaagctactggatttagagcaaaaaatgcattagatgcagatgctatcatgagtaaagaagcaaatgaagaggaagcaattcacagcgtgagtattgacttagagggatcaagttctgccacaaggaaaaacattcacccaagtaagagtggagagaaagaagggatgatttcctcaatgaaagaagtagtcgagtcattgaaagaatttgttgaagtgattaagaagaagatggagaaccaaaaaaagatggagataaaagaagctcaagaa

SEQ ID NO: 36441 - DNA, 291 bp, Glycine max
  Peptide Sequence Number=SeqID_128126
atgttggataagcagaaagttgtaggactgtcgaaacctgcagataggccggatcatgatgtcgatgatcccctatatctgatgacattgaccatcccacatctttttctaaagccgttgcatatgaatgagacaagtatgcgagcggggaatgctgatgtgtatggattcctcaagccacagttcatacaaagatctgggcaatcacaatttgaatcaaaaagttatattaagaactggatgcaaaattcaaggagggatgtgtacctaggaacctacttgaatgggtaa

SEQ ID NO: 36442 - DNA, 570 bp, Glycine max
  Peptide Sequence Number=SeqID_128127
aaaaattctggtggcttaacatggttcataccaggtgaagatccatctctcatctctaagaaccaactacttgctagaatagttggaggcttaggggaaagagcagaagaggaagtcatatttagtgaaactgagataaccactggagttgcaatggacttgcaacagattacacaaatagcaagacagatggtaacaaagtttggtatgtcaaagattggaccatgggcattgactgatcctgcagtgcaaggtcatcatgtggatttaaagctagttgctcactcacttgctcccccaggaattagaactattcctccaagtcccaaatggctatcaacttctcatggatgtattgaagcgcatttaacagacaacagtgaaccagtaggattcatcatcacaaaaatagatgaattctggcaacttaagcaggtatatcgtggtaatgctttggcagctttaatttcaagtattaagcagctgcccaacaacttaaatccattgaagctacaaatgaaggcattgagcttgttgagaagtattttgccattatattggaagagatag

SEQ ID NO: 36443 - DNA, 354 bp, Glycine max
  Peptide Sequence Number=SeqID_128128
atgacttctccacctgcctcacctcctcctcctcctccttcagacgcatcaactttgccgtttgccgtgaagcggacacgcaaagcctcacgtctacgatccttggctaccagaccacctagtgctgccagaccagtggtccatgttgatcctactaccggcaaggccgacgatccccacaggaagaaattaagaacatatttggggattgtggcgcgtgataaggtagatgtcacgtacgagaactggaaggaggtccctactgctcaaaaggacttgatttgggaggatattcagttggaatttgaaatcccagaggcttctcacagtaagacgaaaaagaagttgctttag

SEQ ID NO: 36444 - DNA, 1059 bp, Glycine max
  Peptide Sequence Number=SeqID_128129
atggctcgatgtgtgactgagagataccattgctcagaaggaatccatttaaagcggctcgttggactgagatccgaccttgccagcgctggaggaaccgaagaaaggccgaatgaatcattgccgacattcgaatcagcgctaaccgcctccttgaagcgctcttcgtcgcagtggagcagcctcaccaaggcatcaagcctctacaagtcttccttaaagaagatgcttgcatgcgttagtatcttcaagacctttgatcgcttggaactagaagagtctggagttctgagtgaattggttcgattgcggaaagatttttggggcttgcataagccactagtttgtccagatggcgctgtggtcgcttatgcgtggacaacttccaggacaagctggcggactttttttccagctactggtcttaagataggagaatataagcctacagcctctggatattgccaatttggacttgtggtatatgctactgagaatgaaagcatgtcctcatcatacgaagggtaccaaacaaccctcaagcttgaagatgtgccttcagttcctattgatttcagagcagagaaaatgtcggagcttttccatagcagttggccaaagccagaggaaaacagcaagcaccccgttggactaatcttgttcagatgcttctggaagcacatagccttcactggtttccttgcaattataaggcttggagttatgccttgttctgatactgatcctgtatttggcaaaaccaaccgaagtcctctctgtgcaccaattcaatttccactctcagaagctcggcatgctcattcactgttaacatcttttaccagttttgaagttggatgttattcatttcaccgaaatgctgggcctgaagatttggttgctagggaatctatgcttgctaaaatcacaaagaatcctggagaatatagtgaaccgttcttgaaggaattcaagatatttcatcaagaactcaaagacttcttcaatgctagcaggtttgacatgactatcacaaacatgactcagtatcccttgtaa

SEQ ID NO: 36445 - DNA, 879 bp, Glycine max
  Peptide Sequence Number=SeqID_128130
atgggaacacccccaaggtcccctccgcattcagatggtcattcggaagctacacctaagaagactagacaatccacacggcttagaaggttgaatttaagaaccttagatcagcccagaccaatggttgtagctcaagaaaagatttctattgtacacaagaattggaaagatgtgccggaatccctaaaggacctagtatgggataaaattttggactcgctacaagaacaaacaacaccgggtagttttgttccccatggtcgtgacgacatactcaatattgccattgggcgaccagagtatccaggtcgtgttcgtgtagtggagtctggcgagtatgagagtaatgttgaaactgttgtgaacccattaggcgaagaacatgatggtcatgtcataccgactatgggggtcagtgttgaaaaagttttagacggtgacgcccaagtcccattcccaacatcaaaaatacactatgtcagggagacccttcacacattcattgcatgggcgaaaaatcttgtgaaacttgtggcacaggagctggttgttatgtgtcctaggaacgatgttgttgcctggttctgttcattacgtaagaagcttgatgttcatatcaaagttacattaaagaccactgtggatggcaaaaatgatcaaggaactcctaagtggattgaagtaaaggatcttcttcatcaatggattcctttgcttcttggaagacgaatggcagtggaatcgagaaggaagagagagaggagacgccacttcaaggagaagatgagtctagaagaagctcaccaccataggaggcaatggataagagcttggaggaagaaggaaatgaatgatgggaaaggaagaaggagatga

SEQ ID NO: 36446 - DNA, 216 bp, Glycine max
  Peptide Sequence Number=SeqID_128131
atggatatccaacatgctcaaagttcaagaacacttcatgataacaaagatgatgatctcaaagaatcaaagaatgagttcaagatgttcaagattgaatcaagaacatttcaaggttcaagaggaaatttgatttcagaatcaagattcaaggttcaagcttccaagaatcaagatcaagattcaagactcaagattcaagaatcaagagaataa

SEQ ID NO: 36447 - DNA, 129 bp, Glycine max
  Peptide Sequence Number=SeqID_128132
atgttatattactcaaatactcaaattatagctgatgctctccaagccttagctcaggctatagggaattcgaataggggagaagctactggagctactaagtaccaagggttggaccgtttccaatga

SEQ ID NO: 36448 - DNA, 321 bp, Glycine max
  Peptide Sequence Number=SeqID_128133
atggagaaaaagatagaaaacttacgaaagaagagtgagcttcaacttcaaccaatgttacctgtgaaagttcaaaagttgaaaggaagatcgagaaagcaggagcagagcaggggatcaaaattcggagaaaagaacaaaaagatgaaaagaaaggatttaaaagtaaaaggtgaaatcttaacctttcatgacctctcctttcgtaacctcgtcgtcgtcgcgttgtcagtcagagagagagcgagagtgagactgctgagagtgagaagtggaagagcatcacaaaaagttgtgagtgaaagtgagagtgctgagtga

SEQ ID NO: 36449 - DNA, 69 bp, Glycine max
  Peptide Sequence Number=SeqID_128134
atggcgtccaaccgaaagaagcagcaggtgggctcgcggtggaggagaaggctcgcggaagaggggtaa

SEQ ID NO: 36450 - DNA, 243 bp, Glycine max
  Peptide Sequence Number=SeqID_128135
atgcctttggtgcaagctgaggagtgggatgtttggatcgggatgtttattactggacttggcattgttcctagcatcgcaggcctgattgacctcgattgtgataacaaaggagtaatcccgcaggctaaggaacctagggatgcaactgcgagatctaatggtagaggtgaaggggcgaaaggaggaatggtggtcatgcactatggagattatcataatttacctaatgtttatagctaa

SEQ ID NO: 36451 - DNA, 417 bp, Glycine max
  Peptide Sequence Number=SeqID_128136
atggctgcgagatgctttggcataggtgtttttgagatggatccagagatcatgcgaggtcttggtttgagacaccagggaggccacttcattagagagagtggtgaggagagcaccatatataaggcggtcctgtcgacgccaggtttggtaagcaggattctgagttgttaccggaagaaaagatccatttggatattggaggagatcatagccatcaaggagagcttcaacttgttgtttccaattaggataattgttgggaagaagtttggtgacattggtgaaagtgatgcaagcaaggggtttggatggctcatgggggttgggaatgaaggagttgttgtcggccatgggagacaagggtgggaaacgacgtccttaattgaagaaatagggaatgggtggatcgtttag

SEQ ID NO: 36452 - DNA, 2652 bp, Glycine max
  Peptide Sequence Number=SeqID_128137
atgtctgccattgtaagggatctttcaatcagaaaaggactgactctgatacttttcttccaggacaaagagttgcgctatcgctttatctacaatcattttccgagtttacaagaggaggacatcataggaaaaacagatgttgaaattttcacaggatccggtgttaaggaatctcaggatttcaagagggaagtaatggaaaaagggttgcctgcaaaaaaggaaattacttttgagacagaattatttgggtcaaagacattcttgatatatgtagaacctgtctttagcaaagcaggagagacaattggagtaaactacatgggaatggaaataacagatcaggtaagaaaaagagaaagaatggcaaagctcagggaagagattgcagtccagaaagcaaaggaaacagaacttaataaaaccattcacattacagaggagactatgagagcaaaacaaatgctggcaacaatgtctcatgagataagatctcctctgtctggagttgttagcatggctgaaattctttccaccacgaaacttgatcgggagcaaaggcagctcttgaatgtcatgatatcttcaggagatttggttcttcagcttataaatgacattcttgatctttccaaggttgagtcaggagttatgaaattggaagctacaaaattccggccaagagaggtagtaaagcatgtactccagacagctgcagcttcattgcagaaaatgttaaccttagaaggaaatgtggcagatgatatgcctattgaggtcattggagatgttttaaggattcggcagattctcacaaatttagtcagcaatgcggtaaagtttacacatgaaggcaaagttggaataaacctttatgtcgttccagaaccaccttttgccaaagcagaaggccatcaaaagatgatcacagaacagtcaacaaattcagcaaatggggtgaaggaagagaaacgtgcatcaacgccgcgaagcagcagcgatcaaaattgtcttgatggtcagaaacacaatgaccatcctagccaaaatcatgcattcaatgatgaatgtagatcttcagttaaaagtgaatgctcaatgaatggagatactgaggagcaaacgcattcaactgaaactgtgtggatacgttgtgatgtatatgacacaggaatcggaatacctgaaaaggctatacctactttatttagaaggtacatgcaagtaagtgctgatcatgctcgaaagtatggtggcacagggctgggactagcaatatgcaaacagctggttgagttaatggggggtcgcctaacagtgactagcaaagaacatgttggttctaccttcacattcatacttccttacaaggtttcaacagcttgtgatgattctgatgacccagatgagctctcagatgtggatgataatgatgatgacacaacagaggggttcttccaattccaaccacgcactttgggctctctcttcacttctaatggacctaccaggccccaaaatatactaccaggtttcagaagctcacacaagttcaatggcatttcagaaaattcttactcattcctcactaccaacacaagatcaaaagggattagttcaactgaggatgcatcttcagtcattgttgatgctccagagatgtctgaatcaacaagttcatcaagtcacagcccagaaacaaagcaagaaagtgtaattaacacaaacaatgagaatcaagataaggcacatgctcggttacagaatggtagtgtagactcttctcaacataaggaggtaatggtaatgactcttggaacaatgtcaaatgaacctcaacaaacatgtcaactagtgaacacagacataacctcccaacgtgttattagtagtaataataacacattatcagaagtaaccaaatcctcattagggcctaagattcttcttgttgaagataacaaaatcaatgtcatggtgacacagtcaatgatgaagaggttaggctatagcatggatgttgtgaataatggagtggaagccgtacgtgcagttcagcaccatacttatgatatcatattgatggatgtttacatgccagttatgaatggtcttcaaacaacaaaactgattcggtcttatgaggacacgggcaattgggaagctgcaagaaaagctgggatagaacaatgtttaccagcttcaaatgaatgttctgtaccacctaaaaaccggatccacatcattgcgatgacagcaaacacaatgtcagagagtgctgaggaatgttatgcaaatggtatggactcgtttgtgtcaaaacctgtgacattccaaaaattgaaagattgtctagaacagtacctgagtgtctaccttaaaaactgtatagatctactcatctacaatattctttttcatctctccgaatgcataatagctattagaaagctagtaggactagctggagcgtgcaaagtagagggagaccagtcagggtcacaatgttttgcgagaatgctccaaccatatgggatcaacataggcttaaaggagcactcaaaccgtgtgacccccaaggcctacactccgaagagtccgtcagggtctctccctcctgattcaggttcaacccagaaaacattttag

SEQ ID NO: 36453 - DNA, 204 bp, Glycine max
  Peptide Sequence Number=SeqID_128138
atgaccattgagggctttacaactgagggtgacggaaataaaggggctactgaagtgagctttgggccttcgaaagcgcgcttagcgcgacacctcgcgcttaacgcgttcagatccatgtggctcgcgcttagcgcgcgtaacggattctgcatcttcgagcttaacatctcgcttagcgcctatgctgctttgctcgcttag

SEQ ID NO: 36454 - DNA, 177 bp, Glycine max
  Peptide Sequence Number=SeqID_128139
atgtggtaccatggagaccagtcagggtcacagtgttttgcgataatgctccaaccatatgagatcaacataggcttaaaggagcactcaaaccgtgtgacccccaaggcctacacttcaaagagtccgtcagggcctcttcttcctgattcaggtccaacccataaaacattttag

SEQ ID NO: 36455 - DNA, 960 bp, Glycine max
  Peptide Sequence Number=SeqID_128140
atggggtacctcaattcagttttgtcctcttcaagccaggttcatgctgcagaagattcacctgtcagtggagggggcctcagtcagaatggaaaattcagctatgggtatgctagctcccctggcaagagatcttcaatggaagatttttatgagacaaaaattgatggtgttgatggtgaaattgttggcctttttggagtttttgatggccatggtggtgctcgtgctgctgagtatgtcaagcaaaacctatttagcaatttgatcagtcatccaaaattcatttctgacaccaaatctgcaatagctgatgcatataaccataccgactctgaatttctgaaatctgaaaataatcaaaacagagatgctggatcaactgcttccactgccattcttgttggcgaccgtttgcttgttgcaaatgttggggactccagagctgttatatgcaggggtggaaatgccattgctgtttctcgggatcacaagccagatcaaactgatgagaggcgaaggattgaagatgcaggtggctttgttatgtgggctggaacttggagagttggtggagttcttgctgtttcacgtgcatttggtgatagactcctgaagcagtatgttgttgctgatccagaaatccagatatttggaaattccctaaactttattaaggaagaaaaggttgatagctctcttgagtttcttatattggctagtgatgggctatgggatgttgtctcaaatgaggttggcaatgatgttcatttcttcccgtttcctgttgataactacagtgaagctgttgctatgattaaaccaattgaggatgccgaggaggcagcaaagaggctaatgcaagaagcatatcagcgaggtagttctgacaacattacgtgcgttgtcgttcgttttttgtcaaaccaaggtgcatcttctcatagtaactctggctaa

SEQ ID NO: 36456 - DNA, 210 bp, Glycine max
  Peptide Sequence Number=SeqID_128141
atgtattgtactccttcacttgttcatcaaaattttggccagactgaacaaggacaaagttcttcagctgcagcaacccacactgaatatactgacatagaacaacaacattgtcatgatgagggagaaccagtcatacaggaaagaagaaatccgcgatgtaatcgacatctaccgccctgtgggactggtcatcgtcttgatcattga

SEQ ID NO: 36457 - DNA, 198 bp, Glycine max
  Peptide Sequence Number=SeqID_128142
atggatattgaggttccacaagcggtacttcttgatactgtatttgaagcagttgttcgaattccttatgatatgcaagtgaaacaagttcttgctaatgtggatgcattggatggacgtgaattgattgatattatacctccgggacaacttcttgttttagaaggtgaatctatcaaaattgatcggccattataa

SEQ ID NO: 36458 - DNA, 681 bp, Glycine max
  Peptide Sequence Number=SeqID_128143
atggctttggccgacccatttctttccaccactgccatccaaacacaattctccaatagtcttactttgcactctctctttcttcccaaccattcaaacataaacagttgtcattttcatgcaggaggagccagcaccacaggtgtgaggccttcaaagatgcacatttgctttgatctcaaagatggagaggatcacaatgtttttgttgacccttctactgaggaagagctgaaagatgaggaggaggctggagactatgattggattgggcacaagagtgcaaagttatcagaaggccagttgattgatggaaagctcaagtgcttatatcatgtatggcaattcgaaggtgaaggcaaatgtgtgaagataccttcgggaagaagaagacaaacacaagagttttatactggttcggcaacaacccgtgcctacatccagtccccaagcggcttgcggtccttgagatttcttttcaaccttgtaaaaacctttacaagcaaagatccacaagggatgtaccctcccttgttctctttgaacaaccaagtggatgtagatgtaccctctacttgtaccacaaaggatgtaccctccaatgtgttaagacaaagttctcaggcgattagtcctttgaaactttgtgaaggagaaacaaaagatatctcaagcgattag

SEQ ID NO: 36459 - DNA, 405 bp, Glycine max
  Peptide Sequence Number=SeqID_128144
atggggaaccaataccaccaagcaacagatgggcttctgagccttttcacaaaggccaatcacgatctctctatggttcaccatcgtctcgaaaaggagtttcagcaggtttaccccgacaacgctaaccctatgaagctggtttctagaatcaagaaggttcaggaagatatatcaatcttgaaggggcagtgccatgagcttctggctgctaagcaggatttgattgataaggctcagagagttctggtggagaacagaaatttggtgcagcgtatgcagccgtccttgggcatctccccctctggtgaagatgatgctgcattcactaacttcaaacagttggtagaatgtggtagcgtagaagatgaaggatggagcaaaaagtttcaactgaagttatga

SEQ ID NO: 36460 - DNA, 419 bp, Glycine max
  Peptide Sequence Number=SeqID_128145
tgcgcgtcttccggaattcttccggatgaaccacttcttccggaaagttcccggaagaggttttccggaagtcttccggaagaagtgttcttccggaagacgtttggttacttccggaagaacacttcttccggaaactttccggaaaatgttcttccggaacttccggaagaacccctaacgggtcttccgggagacttctccgtcagccttttccgccattttttccggcgtactctcgtcttctcccctctcgtcttctaccctaagctaagggtaaggggaaggggaactaacctgttcgcggagaagaagaagaaagccttggcgcgcctcgcggagaagaagcttcacggagaagagaagaagaagcaggttccgggagaagaagaagctgttccgggagagaagaagaagct

SEQ ID NO: 36461 - DNA, 551 bp, Glycine max
  Peptide Sequence Number=SeqID_128146
atggatgcactagagaaaaatggaacttgggagttggtggaacttcctaaagaaaagacacttgttggttgtaaatgggtattcacgtcaaatataaggcaaatgggacactcgaaaggtataaggcaagagtttgagattaaagagcaagatagattaaaatactttcttggtgttgaggtggcacattctcgtcacggatccattaatgatagaaaacctatgatcatgactttccctaacaaagaagaccttcttgaaatttggaggattgaaggaaatcctataattcttgttgaacaccggttcaacatcaacatgctagaagcaatgagggttccgttcagggacaacctacatctgtgcaatatcatcaacttctttaccaaagatgaagttgttgttgcagagatggttagggaattctggagaaatgtgtttgaaaaagaccgcattaccagaataatgcttggtattcaggacattgaccccaaacttatcaaggcctttctctacaagcctagtgcttcagaaaaattggagttgaccaa

SEQ ID NO: 36462 - DNA, 123 bp, Glycine max
  Peptide Sequence Number=SeqID_128147
gcagtagcaaagaaaccaggaggaacagagggagctgaaagggaattggagaaaggtatctgggaaagtgaaggtgtagaggctgaaataggaggagataggtcaggattgaggctgaaatag

SEQ ID NO: 36463 - DNA, 936 bp, Glycine max
  Peptide Sequence Number=SeqID_128148
atggaagcaccttccattggagatgctcttagtaatccaacgcttcacttggaacagcaattgcgggttttcaaacggccccagctctcgccagccatagcttcttttgcggcttcacttcgaatgacacttgatgatgagatttcttttgaggatgatgggtttggtcagcaagatgtagaacatgtgttgttggatgaggatgggctagatgataatgaatgtttagagaataatgtttcaggtgataatgagttagaagatgaagaagatttcgacaatgaggtttcagatgatgaacattatcacaaaattgttttggaagatgatcctccaaacccctccctctttaacccactcgtcgtcgccaccacaaaaccctttgtcgcagccttaaagacagtcatcaccgtcactgtacaagaaccactcgctcccaaaattcctggtgtcgaaattgcactgcctatgtcaaatggaggtcgtctccgacgacgacaaatgaaggtcgatggtgattgtcatgaagaagccaagttcatgaatgaagaagaaagtaattgtaacactcactttgttcagcaatttgaccgccaaagatttgagtttgaagttgaggcaaaagcaattccagagaggcgtcgcacgggaaaattgactgtgaggcttgatcaaaaaacatgtcattatgggaagcctcaaaaggtgcacatgcaatgtgcatatgtcattgctgcatccaaagaagagaaggttcaagcagctgatgactcgcttagcgaggtagatccgcttagcgagacatctagctcgcttagcggatgggaaactctagaagaggataagccagagatctgcacgcccagcacgcagccagcccacccaacgaggttgttgtctcttcttgcgctcagcgagcctactcttcttaagtga

SEQ ID NO: 36464 - DNA, 162 bp, Glycine max
  Peptide Sequence Number=SeqID_128149
atgaaggaagctttagagatggaacaaggtatcatcgcccctgttaaggctctatctgttgaagagcacaagaagaagctagttaaggatgcaagacttgttgccttagcaggaatccctaaagactttgtctaccgaggaggtgtagatgaaggctactga

SEQ ID NO: 36465 - DNA, 369 bp, Glycine max
  Peptide Sequence Number=SeqID_128150
atggagtgcctagagggagtttgggagaccctcgaaggcaatgagaggtgccgatttccgtggcacgattcgactcactgctacttcattggtacatccaaaggaacccgcacacacgctttagtagcctatggagtagatactacctacacctactccatatcgactagtggagcaaaagatcctgaggagaacccagaggagctacctcctgaacctgttgtggatgaccttggcttacctgaggatgatgaagacccactccctgatgttgattctccagaggatatcatgtcagcatctgaggcagactctacagaagagagcggccctggagggacagcgagtagtgaagactcttcatcatag

SEQ ID NO: 36466 - DNA, 321 bp, Glycine max
  Peptide Sequence Number=SeqID_128151
atgaaaggaaaaactccttgttcaataataattgatggcaatctggctatgaggaatgttataacaagagcgatacctagtgtttttcataaactgtgtgcatggcacttattgcgtaatgcattaagccatgttcgagacaaacaagttttgaaatggttgaagaagctaattgatgaggacatgaccaagagcaagggcaaggatccacttgaaggacttagaggacttatgacaagggctagagcaaggaaagccaaggaagctcttcaacaagtgttgtccatactatttgaatacaagcccaagtttcaaggataa

SEQ ID NO: 36467 - DNA, 2011 bp, Glycine max
  Peptide Sequence Number=SeqID_128152
ggcaccgccgaaggccatgccttccgtcgcgacgagctggacgcgctgctgggcctggccgaaaagggcgtgaccgaactgctggccgcacagcaggcggcgctgtcggcatgaaccgccggatcgcgctgaccacccttgtggtggccgactatgacgaagccatcgcctggtacaccggcaagctcggcttcacgctgctggaagacatcgaccagggccacaagcgctgggtggtggtcgggccgaccgacggcagtgccgctgccctgctgctggcccgtgccagcaatgaggagcagcgcagccgcatcggcaaccagaccggtggccgggtcgccttcttcctcaacaccgatgacttccaccgcgaccacgcggcgatgctggccgccggcgtcgagttcctggaagcgccgcgcgaagaaccctatgcaacggttgcggagatcctcgccgacctgccgctgcagatcacctcggccgctgagctgggcctgggtgacgtggaagagaccggcctgaccttcgtcgagaacgcgctgctgaaggcgcgcgccgcctgcgaagcaaccggcctgccggcgctggccgatgattcgggcctgatcgtcgatgccctcggcggtgcgccgggcctgtacagcgcgcgctatgccggtcacccgaccaacgccgcggccaacaacgccaagctgctggacgcgatggccgatgttcccgacggccagcgcagcgcccgcttctatgcggccgttgggagggccagatcatccgcgagctgcgcggcacgaatgtttcggctacaacccggtgttcctggacaccacccacggcctgaccgccgcggaaatggagccggcgctgaagaacgccatcagccaccgcgccattgccctgcagcagctcaagcaacagctggcgacgctgtactgacgccacccgatcgaaccagggaagccggccagcggccggcactaccgaagaagcccatgccgcacgcccacgaccactgcaaccacctgcccggcgaagcctgctccgctgaccacgacagcccgccgcggctggtgccgccaccgctatcgctgtacgtgcacctgccgtggtgcgtgcgcaagtgcccgtactgcgatttcaattcgcaccaggccaagggcgaactgccgttcgatgcctacatcgacgcgctgctgcgtgacctggaccaggacttgccactggtctggggccgggtggtgcacagcgtgttcttcggtggtggtacgcccagcctgttcccgccggaagcgatcgaccgtttccttcagcaggccagcgcgcgcctgcgtttcgcgcccaatgccgagatcaccctggagaccaacccgggcaccgccgagcatggtcgtttcgaccgctaccgcgcggccggcgtgaaccgcctcagcttcggcatccagagttttgacgacgcgatgctcaagcgcctgggccgtatccacgacagtggcgaagccgagcgcgcggtgaaaatggcgcaggacgcgggctacgacaacttcaacatcgacctgatgtacgcgctgccggaacagaccctggccggcgccgaggccgatctggaacgcgcgttcgcgctgcagccggcgcacatctcgcactaccagctgaccctggaaccgaacacggtgttcttcgcgcggccgccgcagggcattcccgatgaagacaacgcctgggacatgcaggaacactgccaggcactgctcgcgcaggccggtttcggccagtacgaagtcagcgcctatgcgcgccccggccggcagagcgcacacaacctgaactactggcgcttcggcgattacctgggcatcggtgccggtgcgcacggcaagatcagttcaggcgccgaagaacacgtgctgcgccgctggaagctgaagcatccgcaggcctacctggacagcgcgggtaccccggcctcgttcggtggtgacgatatgatcgcgcccgagcgcctgccgttcga

SEQ ID NO: 36468 - DNA, 534 bp, Glycine max
  Peptide Sequence Number=SeqID_128153
atgtcggctttgaaagagcaaatgacttccatgatggatgccatgttaggaatgagacaacttatggagaataacgtggccaccgctaccgctgttagttcggctaccgaagcagacccaactctcccagctaccgcgcatcatcctctcccaaacgcggtaggacgagaaaggagcacactggggcacatcagcaacccccatttgggatacaaccaggtggcttacccttatggattaccacctaattacacgccactagtcatgcatgatgacgtgggtcatgtcccttcccccgtccttcaaggggagcctcctcgacagtcggatgaggttcatgaggatcatagagagtatgcccaaggggatgtcgatttctacccccccggtccctgtcgaggggccggcacccaacatactgcctcaacacaacctcccagcacaaccaatattcttgtccatagaaggaccacccctggtagtggaagaaagaaggaaactcgatctcatcgaagagagattaagagttgttga

SEQ ID NO: 36469 - DNA, 396 bp, Glycine max
  Peptide Sequence Number=SeqID_128154
atgatggaggccatgatgagcatgaagaagataatggaagccaatgcggttgcaattgccgctaccagtgctgttgctaaggtgaacccgatgcccccatctggcctcaaccaaatgaatcatccaacctcaaatatggtaggcaaagatttgggaagtacaggtggcccccattatgcgcaaattcaaaacgagcgcaccttcccgccatatggattgcctcccaactatacaccacccaatgtggcgtacactcctaaaataggaaagttggatcatctagaggaaaggctcagggccattgaaggaggcatagattatgcctttactgacgtcgaagagttgttcctagtacccaaacatggtcattcccaagttcaaggtgtcggactttga

SEQ ID NO: 36470 - DNA, 210 bp, Glycine max
  Peptide Sequence Number=SeqID_128155
atgtctggtgaggttgtccatattggcaaaagggtaggtaacatccatatgttaaacattgaacatgcatcatttcatgagcttagttgtttgcgcggcttcagcgcgcttagcgtgaagaaggaatttggcagagcacctgaattgaagcagtgtgctaagcgtgagatcagctcgctaagcgagtcgtccgtctcttgccaggcttag

SEQ ID NO: 36471 - DNA, 144 bp, Glycine max
  Peptide Sequence Number=SeqID_128156
gaattgggcttagcgagccttctcgctaagccatttatgtccagtagtgttgtcgcgctaagcgtgtctggccgcactaagcgcaatttggtttctgttgtggaatttggcttagcaagcctactcgctaagccaattctatag

SEQ ID NO: 36472 - DNA, 297 bp, Glycine max
  Peptide Sequence Number=SeqID_128157
gaaggactcttccctccacaaaatgcaagggttgtggttgtgggcgatactgagggccccccaaagtgtttggcagggaaggctgttgcttctggaggaagcaaccctgctcgcctgggcgagctgggcggcaagcatctcccctattttgctataaataggggaggaagtgagaaggaaaaggccgaggcgcttccaaaacgtttccgtaacgttttccgtgacgaatttcgcaaaggtttcgaccgttcttcgacgttcttcattcgttcttcatcgttcttcgatcttcaacgg

SEQ ID NO: 36473 - DNA, 834 bp, Glycine max
  Peptide Sequence Number=SeqID_128158
atggcgctggtgaacttcgagcacctcaacaccctgatggaaagccacaacgcctcctggatggtcggcgtcgggctggtcatcgtgttcggcctgctcaacgcgttcggcatcgaggccttcggcaaggcggagatcgtgctgaccttcgccatgtggagcacgctggtgattttcggcatcgtcgggctgctgtcgccgcatgcggtgccgctcgagggctggttcggcagcacgctgagcctgaacgatcccttcgcggtgttcagcctgatcggcatggcgatgttcatgttcgtcggctgtgagctggtgacgccgatggcgccggagatcaaacgttgcgatcgggtgatcccgcgcgcgatggcgctggggttgtgcggcgtggcggtatgcatggcgctgtatggcgcggcgctcagccaccaggtggaaaacgtggtgatcgacgccgccagcggcacgcgtctgctggaaacgccgatggccatcccggcgttcgccggccaggtaatgggccagttcggcaaatactggctcggcgtcggcctgttgttggccggcgccgcgaccatcaacacgctgatggcggcggtgccgcgcattctgtacggcatggcgctggacggcgcgctgccgcgcatgttcgcctatctgcacccgcgctttaaaacgccggtggtcggcattctggtggcggtattgatcccctgcgtacacgccttcgccattcagggcaacctcgacaggatcattccgctggtgctggcggcggtgtgcgcctggggcgtggcctacctgctggtgacctgctcggtggtgatcctgcgc

SEQ ID NO: 36474 - DNA, 562 bp, Glycine max
  Peptide Sequence Number=SeqID_128159
tgaagaacttcgtgactattatgaaggaaggcataggtcacatcttagacctcactcccatagaagagaaaaggaaagaaatgcctcaagaggctaacattaaactctcatacttccatgggaaggacaatgtagaggctaacttagattgggaaataagggtagagcaacaacttaaaaagaagtctacttcaaaatcttatggctctcactcttatccaaagaaagaccaaggtcaaggcatcttaggggtgacaccttctaagcccaaagatgataaagggaagacaatagaaaagcaagaccctaaggctagtatgcaagagaaaactagctctataaagtgctttaaatgtcttggaagaggacacattacttctcaatgccccatcacaaaaaccatgattatgaggggccaagacatttatagtagccaagatgaggctacttcaccttcctctaagaagtgtaaggaggaacttgctagcattgccacacctcttgggcttgagtttattcctcaagtaaagaagttgttggatgagggtttggttcgcaagag

SEQ ID NO: 36475 - DNA, 201 bp, Glycine max
  Peptide Sequence Number=SeqID_128160
atgttggatcaatttcatccgtgcatccaggattctattgaaaacattattgatgttaaagcggatggtaattgtggttattggacaatggctgcgttattgggtatgggtgaagaattatggtcattggtgcacaaccatctgcttaaagaactgacaagctggtccaaagagtatattaacctggttggtggcatatag

SEQ ID NO: 36476 - DNA, 398 bp, Glycine max
  Peptide Sequence Number=SeqID_128161
gcgaaaaacaaagatgtttgtcgacccaaacaatgctaagacagctacattggctgaagttgcggagacattacagtatatggtgtcaccgcaagggaggaacacatggacagtggatgatctcgtgccttatgtggagaagatcacgattttatcagaagagcaagagagaatcactgagccggcggcacatggtccaacatcagagcgtcgattcccaccgcagcagtttcacatgcttcagtcaagtgttgaaactcgcggttttgacagacgaagggaggctgtggaagcgcaagaatatgagaaacaaattgaggagcgtggccatggaatgtattacacgccaccaacatttgcggagtatccttcacagatgtaccagtatccgttccaag

SEQ ID NO: 36477 - DNA, 429 bp, Glycine max
  Peptide Sequence Number=SeqID_128162
tcctttggtacttgtacctattggctcgccctcagaggactgaacgtcctcaccttcagagggctgcacgccctcaccttcagaggactacacgtcctcgccttgagagggaaacacgccctcactaccctcaccagtgagaggactacacgtcctcgccatcagagggctgcacgccctcaccttcagaggactacacgtcctcgccttgagagggctacacgccctcaccttgggactacacgtcctcaccatcagagggctgcacgccctcacctccagaggactacatgtcctcgccttgagagggctacacgccctcaccttgggactacacgtcctcaccaccagagggctgcacgccctcacctccagaggactataagtcctcgccttgagagggctacacgccctcaccttgggtactag

SEQ ID NO: 36478 - DNA, 273 bp, Glycine max
  Peptide Sequence Number=SeqID_128163
atggtcattctatgccctttgtcatttaggagcaacaagttgagtgataaacgtgcagagacaaattatggtcattctgcgccctttgtcattcagggacggttccgctggcagggagattcactgtccgaatggtgtttcgctcgaacgaaattagtgtcttatctttacttcccttttatctccaataaaagacaagtaaaagaggggcaactgtcataccctaatttcatttcggggaccatccgttgttgggatgcgaccctcatttga

SEQ ID NO: 36479 - DNA, 1167 bp, Glycine max
  Peptide Sequence Number=SeqID_128164
atgaccggcgtcgatccgatcctgcgcgactatgtgcatggcgcgctgctgcgccgcgatgggcgcctggccgaggccatcgcgctttaccgccggttgatcgcgcaacatcccgacctgggctacgtgcggctggaactggccgccatgctgatggaggaccgccaattcgcgcagtccgacgccgaactggcggacctgcgcctgggatcgctggagccggcggcgcagcgcagcgtgatgcagtaccggcaggcgctggcccagcagcgccgctggaatttccgcctgggcgcgggcgccgtccacagcaacaacgtcaattcggccaatcgcgacccgatgctgtacctgccgatcgcaacgcggcgggggccggtgtgggcgccgttcgccaagagccgcgatgcgctgcccaaatcggattggggtttgaagtacagcggcagcgccaatgtcgaacgcaatctcggcgggcatcactactacacgctgggcgcggatatcgacggcaccgcctaccgcgtgcagcgggactacagcgaccgtaccatgaccctgcgcggcggctacaagtggcaggatgccacgctctggttcgccgcgacgccgcaggcgggccgaagctggatgggtggccggcggtacagccacaaccacggcatgagcctggaatacggttggcggccagcgcccgactggcaattgatgggcgcctggttatggctcaagcgcggctatgacgaccgcgcctatgccgcctacgacggccacctggaggtgctgtcgctgacggctatccgcgtgttctcgccggcgctgctggcctacggcagcatcggcctgcagcgcgaagcggtggcggcgggcgagtacacctatcgcttcccgtgggcgcaattgggcgtggtcaagacctttggccggatgctcggcgcgcgcctgagcgcgcgctacggccggcaggcgtatgagtcgccctacgccctgttcctgaaccagcggcgccgcgatcgcgaattgcgcgtggacgcctcggtatggacgccggacttcaagatcgccgggctggaaccgaagctgaacctcagttacctcacgatcgccagcaatttgcccatgtatgcgcgggaccgggaccgaattcagcctgatgttggagaagcg

SEQ ID NO: 36480 - DNA, 348 bp, Glycine max
  Peptide Sequence Number=SeqID_128165
atgtcacgaaatttcacggattgtgctgcaatgttttctcttgacttccggcatgtcacggaacttcacgaatcgcctaacgatgggtgcaagtacctcgaagtggtcaaacgagggtcgcatcccaacaacggatggtccccggacaaaattaggaatgaccataatttgtctctgtgttttgttggacacgatcgagcctgggcggcgagacacagaatgaccataatttgtctctgtgtgccaccggacacgatcgcctctgggtggcgaaaaggtgtgcggaatgacaaagggcgcagaatttgtctctgcgcgtttatcacccaacttgcgaaatctgaatga

SEQ ID NO: 36481 - DNA, 266 bp, Glycine max
  Peptide Sequence Number=SeqID_128166
atgtcattgcctaacgctgttcatgtgttctcccttatcaagtgcgaagcttctggttactgggaagcacgttattctgttgttttccagatcggttccttcgccaagtataagaaaaaaaaagaagaagaagtagagatgagagtcgtcattgcgaaaagggcagaacggacgaaatcagtgtcctatctttgctttcctcttatctccgatgagaggcttgcgcgttccgtgaaattccgtaatgtggcggaagtcgaaaagag

SEQ ID NO: 36482 - DNA, 474 bp, Glycine max
  Peptide Sequence Number=SeqID_128167
atgagtcatcattcatctagtgttaatggtgaggatattagtcataacgaccctctatctagaatcttagatgagttgagttccctcaagttatggaaagaaaaactagaaagaaaagaaaaaggaaaagagagggtagaaataaatcaagatgagagggaaaaaattagggaagatgaaagaaggaaaataaaagagttaagaaaagaaaaatatgcctcctatagtagttgtcgcaacgtgcccttcgcgggcgagcgagggcgaggctcacgggtgcgctttccaaaggaggaaagatgcgcggagtcgccaccaacatttatttgtggaaaacgtcggaaaaaccgaaggaaactggtcaaaatgaaaattctaagttcgggagttgtatttacgcttgaggaaggtcgacaaaagcggggcttttgctcctacgtaccctcctttggagaggaaatcagacctacgtag

SEQ ID NO: 36483 - DNA, 612 bp, Glycine max
  Peptide Sequence Number=SeqID_128168
ggaggattgcatcacaactcccagcattttagcgccagaaatgatgccatagtcattagaggagtgcatgaggtagctacaaactcagctgcatcatctgagactaagaagcttgaaggaaaactggatgcattggttaacttggtaacccagctggccttgaatcagaaatctgtacctgtcgcaaggcaacctggagcaattgagcagcccgaagcttatgctgcaaacatttacaatagacctcctcaacctcagcagcaaaatcaaccacagcagaacaattatgacctctccagcaacaaatacaaccctggatggaggaatcaccctaatctcagatggtctagccctcaacagcaacaacagcagcctgctccttccttccaaaatgctgctggcccaagcagaccatacattcctccaccaatccaacaacaacaacagccccagaaacagccaacagttgagagccctccacaaccttccctcgaagaacttgtgaggcaaatgactatgcagaacatgcagtttcagcaagagaccagagtctccattcagagcttaaccaatcatatgggacaattggctacccaattgaatcaacaatag

SEQ ID NO: 36484 - DNA, 216 bp, Glycine max
  Peptide Sequence Number=SeqID_128169
atgtcactctcactaagtaagatcatagggagaccagtcagggtcacgatgttttgtgtgagaatgctccaaccatatgggatcagcatagacttaaaggaacactcaaacccggtgacccccaaggcctacactccaaagagtccgtcagggcctctccctcctgattcaggtccaacccctaaaattattttagcacacaaactctatctatga

SEQ ID NO: 36485 - DNA, 240 bp, Glycine max
  Peptide Sequence Number=SeqID_128170
atggaaaaagttccccgacaacggcgccaaaatacttgtttcaccctccaggatactacttgtttgtgtggatgcgaaatctaccaacaagtgcaccgggtcgtcaaatatctaaaggcattgggtcctcttattgagaaaattgatgcaattaaggatgtttctctaattaaagatgtttttgtgttctatgctgaagactcaagtactaaacaccgatgtctcatgagtttagcctaa

SEQ ID NO: 36486 - DNA, 298 bp, Glycine max
  Peptide Sequence Number=SeqID_128171
gaaagaaagcctcaagaggttaacattaaactctcatacttccatgggaaggacaatgtagaggctaacttagattgggaaataagggtagagcaacaacttaaaaagaagtctacttcaaaatctgatggctctcactcttatccaaagaaagaccaaggtcaaggcatcttagggacacttgctagcattgccacacctcttgggcttgagtttattcctcaagtaaagaagttgttggatgaggatttggttcgcaagagcttaaatccttgtgctttattggtgcccaaaatag

SEQ ID NO: 36487 - DNA, 567 bp, Glycine max
  Peptide Sequence Number=SeqID_128172
ctggccggtgacgactacgtggtgctggtggccgatgtctacggcaagggtgtgcggccgaagaccgatgccgaggccgggccggtggcgaccaagctgcgcaacgaccggccgttgctgcgtgcccgcgcgctggaggcggtgaacgtgctcaaggcgcaggccggcaaggtgccgctggatgccagccggatcggcgcggtgggcttctgttttggcggcaccacggtgctggagctggcccgggccggtgcgccgctggccggtgtggtgagcctgcacggtggattgggctcgccgttgccggcgcaggccggtggcagccatccgtcggtgctggtgctcaatggcgccgacgacaagagcgtgaccgccgaggacatcgccggtttccagaaggaaatgaacgcggccaaggtcgattgggagttcaccaactacagtggtgcggtgcactgctttgccgagcgcgatgccaacagtccgccgggctgccagtacaacgaacgggcggccaagcgcgcgtggaaggcgctggatgaattcttcgaggagcggttccggtaa

SEQ ID NO: 36488 - DNA, 435 bp, Glycine max
  Peptide Sequence Number=SeqID_128173
atgtcctcaccttcagagggctacacgcccttgccatcagaggatgcatgtcctcaccttcgtagggctacacgccctcaccttcagaggacacacgtcctcacctttagaggactacacgccttcgccatcagaggactgcatgtcctcattttcaaaggggggctacacgccctcgccttcagaggattgcatgtcctctccttcgtagggctacacgccctcaccttcgaaaggacgacacgtcctcgaacttcagagggctacacgccctcgcctttagaggactacgcgtcctcactttcactacccgcagggccaccccctgatattggaggagggccaactgtgcgagcacaaccagagagggaggctatcacacagctactatgcatactggggcaagatttcacccgtgccgctgcaaagagaaga

SEQ ID NO: 36489 - DNA, 291 bp, Glycine max
  Peptide Sequence Number=SeqID_128174
atgccattccgtttgatgagaaataaaaagggatatcgaaaattcgaagtggctgaagctgaagcagctactttcgaagtaacagaaagaaaagcaacgactggagtgggagagtcagagtcgaaaagaggattcctcacttctttctctcattcaaaaccgtgcatgagactttcatctcgcacggctcctaagaatccttcatcagtggttgtgaatgatctatttttctcaatctctatgacttgttcctacggaaccgagatcgaaaacattaagaataagaaatag

SEQ ID NO: 36490 - DNA, 276 bp, Glycine max
  Peptide Sequence Number=SeqID_128175
atggcctgcaccaagaaaactggccaaatgacgtctgaggtagcaaaggaaattgctgacaagcttgattcgttggaggagcaagcctcacagggttcctttgtctcccatggatgtcaggatgtacaaactgcaaccattgcgcaaccaaaacacccttgtcgtgtgcgtgttgttggagccgatgtcatgatcaaacaatactttggaccggctccaaggacctcctgcacatcttcctccatggctttggaagacctggagcagctgacgtaa

SEQ ID NO: 36491 - DNA, 144 bp, Glycine max
  Peptide Sequence Number=SeqID_128176
atggcaggggaaaatgggagaacagccaggaaaccacattacaagcgaaacctcaaagagagttgggcttcgtccttaaaaggaaacaacaccagaaaatctagccttccatggattcaaacagaaaacgcaattgaaacatga

SEQ ID NO: 36492 - DNA, 352 bp, Glycine max
  misc_feature (253)..(253): n is a, c, g, or t
  Peptide Sequence Number=SeqID_128177
atggaggccgacatggaggccatgaaagagcaaatggccgcaatgatggaggccacgatgagcgtgaagaagatgatggaagccaatgaggttgcaattgccgctaccagtgttcttgctaaggtgaacctgatgtccccatccggcatcaaccaaatgaatcatccaacctcagatatggtaggcaaagatttgggaattggtggtataccccttgaaaacacttcggaaggccctcagtatcacccacaantacacctcttgcattccacaacaagtaaaaaccctcatgctatggcagaaatgggaaagttggatcatttagaggaaaggctcagggccattgaaggag

SEQ ID NO: 36493 - DNA, 198 bp, Glycine max
  Peptide Sequence Number=SeqID_128178
atggcatcatcggagagtgtgccgagttacgagaagaaaatgcagctaccgcaagagcccttgaacgagaaaccaagaaggctcacaaggaagagcatggccgagacaaattccgtggagctttgtagggcagcaccaatgagctcaagcttcgaaggggagagagagaccaatcacgagcacatagcatggtcttaa

SEQ ID NO: 36494 - DNA, 135 bp, Glycine max
  Peptide Sequence Number=SeqID_128179
atgcatcaccatgagaggaaaactctagatgagacttcactgttatcaagcgagtcggagatccagcatgacaacagatctacctccactccctatggctcacacagacccgggtatcgggcccaacatctaaag

SEQ ID NO: 36495 - DNA, 177 bp, Glycine max
  Peptide Sequence Number=SeqID_128180
atgatgaaggccattattgtatatacaagccacttgaccaaaagagataagaatgccagcggaatggagaaggaagagagagaggagataccacttcaaggagaagatgagtctagaagaagctcaccaccatatgaggccatggataagagcttggaggaaaaaggagatgaatga

SEQ ID NO: 36496 - DNA, 231 bp, Glycine max
  Peptide Sequence Number=SeqID_128181
atggttgtggttgtgggaaacattgatggccctccaaagtgtttggtcggggtataccaccaactgcttgcccttcagtggcatatccaaggcgaggctcggagtcggctagattgcagtggggtattcatgcgtctcccccatgggttgagagatgcgtgcatgaatagattgaggttatcgactttcaatgggtatgggagcagagttattgatatcctcaccgggatt

SEQ ID NO: 36497 - DNA, 625 bp, Glycine max
  Peptide Sequence Number=SeqID_128182
ttagccccaaccatagaggagttcgaggagatcttaggatgctcaataggaggaaggaagccatgccttttttctgggtactaccattctatggtgagagtagcgggagtagtcaaaatctcggaacgagagttagatcaaggttcaacaaagctaatacgaagatacttcagaagatccgtaaggcatggaataaagtgggaagaaaagataaagagcttacaggaagaagcaatggtgtcataggcggctatcacaaatggctgaaatctagaaagcaagggatagtttggctcaaaaagctaaagggtctgaatggggaagaggcagaagtgcctgaggagagtgaagaggtgcaagccttgaaggctgagctcgaaaagacaaaagtagcgaaggagaagctgaaggtggtagtcactagagttaggaaagaatgtgataggctgaaggatatcaacatgtccacggctgaagcactagagcatgaaacaaagaaaactagaaaggaaaagtggagtagtaacaagtttcgaggggatttgttaggtagcagtaatgagttcaaacttagaaaggccgagagagataaatcaaggatggataacatgattttagaggataa

SEQ ID NO: 36498 - DNA, 226 bp, Glycine max
  Peptide Sequence Number=SeqID_128183
taagggtgacttatctgtcaacttttccactattacacccaaaaaaccaaactctgctttacgtaaagttgccagagtacgcttaacctctggatttgaaattactgcttatatacccggggggagggttaaagatttacccggtgtgagatatcacattgttcgaggaaccctagatgctgtcggagtaaaggatcgtcaacaagggcgttctagtgcgttgtag

SEQ ID NO: 36499 - DNA, 383 bp, Glycine max
  Peptide Sequence Number=SeqID_128184
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgatccccctagactacctccttagtttcgaactcaagcatgacattaaagtcaagggtcatggtgctggtgtgattgaggagatagcatttgcacctaatgagtctcacacctggaaagtggagatgaactccatagatatgtcatggaaggattgctcttag

SEQ ID NO: 36500 - DNA, 252 bp, Glycine max
  Peptide Sequence Number=SeqID_128185
atgtggataggtgatgttgtgtgcttagacttccggtcatgcaatgcttgtgaaaaattgcggcacggtagagctggagtagtcctcaagagtaaccctttgtggttgctcatccaccatgatgtgagcttcagatgcacaaactttggattatctcaagtatgttcttcaatcttcaaatctagtggagctaaatcccctgctgaagaattacctcgcatacaagaagcgactaaacagagcagcaattaa

SEQ ID NO: 36501 - DNA, 201 bp, Glycine max
  Peptide Sequence Number=SeqID_128186
atggagcactgtacccccaaatgcgcaatattggcgatcaaaattgccattccttgggttatggggttgaaccaagctcatgcttttatgaaaaaggttcatcaagtcaagttgaagtatggaagtaaccaccatgcaaaaattggggcaaaagatggatcgggttacatcactacttcgtctactgccaaacacatttag

SEQ ID NO: 36502 - DNA, 282 bp, Glycine max
  Peptide Sequence Number=SeqID_128187
atgatattgcacgagattagaaggcctaactctctaaaaacagtccccagtggagtcgcaacctacccttcggcgggagggcgatgcaaggttcacgagtgcgtcttccaagaaaggaaaatgcacggagtcaccaccaatgtttatttgaggaaaatgtcagaaaaatcggaaaagagagaaacgttaaggcattggaccattaacgatctcttggggtggtcgacaaaagcggggcttttgctcctacgtatcctcaatgaggaactcagacctacgtag

SEQ ID NO: 36503 - DNA, 342 bp, Glycine max
  Peptide Sequence Number=SeqID_128188
atgcagatggcagacagaggtagaggtggtggtcgtagaacatttaatcgtggtagaagacatggtcttactttgggagcttcaattaccaccaacccttccacctcattcattcacatatcaacctcaaagtcgatgattcatgtcgttgcaccgactccaaacacacttcctacaactcaagaccaaccaaatcctacctttgtaaagaagtcgattcccactacccctgttagagatgcttcatcttcaacacaagatgattctcttacacttgagtacccaccagatctaaattgtgaacatattttttatcagaggcctttcattcgtgcatattaa

SEQ ID NO: 36504 - DNA, 297 bp, Glycine max
  Peptide Sequence Number=SeqID_128189
atgctaaagttgtcagataaaatcataaggttccatagaagagtcgttcttggtatgctagaagtggtatctagtccttggaggtttacagtagggaactggttatgtaactcagatctggttagtcctactgggattgagcgggttctaaccgaaaaagaccttctggctgactcatattcagacctagaggcttctatccttgatgagaaggagtttctcctattgaaggttatttctacctttccggagtttgttagacaagtggcctcagatatcttaagaagggggggttga

SEQ ID NO: 36505 - DNA, 348 bp, Glycine max
  Peptide Sequence Number=SeqID_128190
gaaggcaaaacattgggaagtacgggcagcccccattttatgcaagtccaaagcaagcgccccttcccaccatatggcttgcctcccaactatgcaccacccaatgttgcacatgtgtccgatgagaatgtcgataactctgctcccatacccattgagagccaacaactccagtctggtcatgcacacgtctctcaacccatgggagagacgccaaaagtacctcgagaccacgttctagctgacttcgagcctcacctcagatatgctactgagggagggcctcctgccatgatggaaagagaaaaattcgatcatatagaagtgaggctgagggccattgaatga

SEQ ID NO: 36506 - DNA, 876 bp, Glycine max
  Peptide Sequence Number=SeqID_128191
atggtgctgttcctgacggccgggctggggagtgcgtccaccttccagatgatctccgtgatcttccgtaagctgaccatggatcgcgtgaaggcgcaggggggaagcgaagagcaggccatgcgtgaagcggcgaccgatacggcggcggcactgggctttatctctgcgattggcgcgattggcggcttctttatcccgaaagcgtttggtatttcgctggagctgaccggctctccggcgggcgcaatgaaagttttccttgtcttctatatcgcctgcgtcgtgatcacgtggctgggcgttaccttcgctgcaaatcagcaatgtcgatttagagagccacaggctccacacaggagatacccgatgagcaaatttttggaccggtttcgctacttcaaacagaagggcgaaacttttgccgatgggcacggccaggttctggataccaaccgggactgggaagacggttaccgccagcgctggcagcatgacaaagtcgtccgttcaactcacggcgtgaactgcactggctcatgtagctggaagattttcgttaaaaacggtctggtgacctgggaaatgcagcagaccgactatccgcgcacccgtccggatatgccaaaccacgaaccgcgcggctgcccgcgtggcgccagctactcctggtatctctacagcgcgaaccgcctcaaatacccgctgatgcgcaagcgcctgatgaaaatgtggcgtgaagcgaaggtacagcacagcgatccggttgatgcctgggcctccattattgaagatgcggacaaagcgaaaagctttaagcaggcccgcggccgcgcggctttgtgcgttcttcctggaaagaggtcaacgagctga

SEQ ID NO: 36507 - DNA, 201 bp, Glycine max
  Peptide Sequence Number=SeqID_128192
atggccagaaaaccagcgtcaaattgcttcttcacttcttcttttatcttcaaggatgtttcgggcttcatccttctcagtttctgctttaccggggaacactcgggatttagaggccccatttcttggtcctcatgggcgaccatcctttctaattctgggggaagtcccacatcctcgttcccttcatcttccgtttga

SEQ ID NO: 36508 - DNA, 1344 bp, Glycine max
  Peptide Sequence Number=SeqID_128193
atggcgaacaccatcacggctgatgagattcgggaaacgtttcacaggctatgtcggcaaatgtaccagcaggaagttccgcaatatggaaccctcctggagttggtgccggatgtgaatctggcggtcctggaacataacccgaaattacatgaacaattggctaatgccgacgagctggcacggctgaacgttgagcgccacggcgcgatccgcgtgggaacggcggaagaactggcgaccctgcgtcgcatgtttgccattatggggatgtatcccgttagctattacgatctgtcgcaggctggggtaccggttcactccaccgcatttcgcccggtcgatgacgcggcgctggcgcgtaacccgtttcgcgttttcacctcattgctgcgccttgaactgatcggcaacgaggcgctgcgccagcgagcggcggatattctcgcccgtcgcgatatctttacgcctcgctgccgtgaactcattgcgttacacgaagatcgaggagaattcacggctgcagaagcgcgtgaattcgtcaccgaagcgttggaaactttccgttggcaccgtcatgccaccgttgacgagcaaacctatcacgcgctgcataatgagcaccggttgattgccgatgtggtctgtttccccggttgccacattaaccatctgacgccgcgcactcttgatatcgatcgggttcaggcgctgatgccgcaatgtggtatcgaaccgaaagcgctcattgaggggccgccgcgccgcgaggtgccgattttactgcggcaaaccagttttaaagcgctggaagaaccggtgatgtttgctggtgaacataaaggcacacacagcgcgcgctttggcgaaattgagcaacgcggcgtcgcgttgacgccgaaaggacgagcgctgtatgaccgcttactgaatgaggccggggtcggtaaagacaaccttaatcatcagcgccatttgcaggaggtctttagcgaatttcctgacagcgaatttctgctgcgtcagcaggggctggcgtggtttcgctatcgcctgacgcctgcgggggaagcgcatcgccatgcttttggccccggcgacgatccgcaaccgctgatcgaacgtggttgggtagtcgcgcagccgattgtttatgaagattttttaccggtgagcgcggcggggatcttccaatcgaatctgggcaacgaaacgcaggcccgcagtcacggtaacgccagccgtgaagcttttgaagcggcgttaggctgcgaggtcctcgatgagttcgagttataccaacaggcggaggagcggagtaaacgccgttgcggtctgctctaa

SEQ ID NO: 36509 - DNA, 129 bp, Glycine max
  Peptide Sequence Number=SeqID_128194
atggataagagcttgaaggtaggagaagatgagtggagggagaaggagagaaggagcacgaaattttatgtctcaaatgagcccaccaatccaagatcaagcccaagattcttcactaggtgtgcttag

SEQ ID NO: 36510 - DNA, 468 bp, Glycine max
  Peptide Sequence Number=SeqID_128195
atgcagggcaaagaggaaaatgatgaaaatgaaaagaaagatggagaagatggagatgaggatgaaaatgcacaagaggaggatgaagaagatattaatgatgatgattataatcaggactcaagatggttctctctcatctctatgatgtataataatacattttatcctcaaaaaggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 36511 - DNA, 135 bp, Glycine max
  Peptide Sequence Number=SeqID_128196
atgccgatctccccctgcggaagtatcagttgggatcacgcccataagacacccagtggacccggaggagcccaacagggccctggggtttccggctctggttactgttggatcaagtggcctctgaataattaa

SEQ ID NO: 36512 - DNA, 207 bp, Glycine max
  Peptide Sequence Number=SeqID_128197
atgtttaaaaaagaaacatcaccggattacgcggatcgaacattttctaatagatatcatgcaaatattattcagctattgaatacaaagttcaatggacgacatcagtcgttgctaaaggcccaagtggagaagaacgaaggcccaagtggagaaggacaaagcccccgagtggagaaggatgaaggcccaagtggagaaggatga

SEQ ID NO: 36513 - DNA, 204 bp, Glycine max
  Peptide Sequence Number=SeqID_128198
atggctggaagaaaatttgggggcgagggttttcgagagagagaagagttgcagggacgcgttgtaatcgattacacaaaaatggtaatcaattaccagagagcaacattgccagaaataactgcttgtaatcgattacactattacggtaatcgattaccagtggttattttagccagaaaacaaaaacaaaaagctttctag

SEQ ID NO: 36514 - DNA, 711 bp, Glycine max
  Peptide Sequence Number=SeqID_128199
atgtcagctgcactaggcgttggtcgcgaactggaaaacacgggggtgctggataccgccaccctgacacaactggtgaatgatctttacgccgagggctttccggcgacggcgccgtttgccgcagcagactttgtgcagtcgctggccagcagccatacaccacagccctctgtgcctgccacagattcgttgaccacgaaactagggcatgcaggcggcaactcgttaggtgctgcctcgccaagctatgtgcaggcgcaaggccagcctgtcacgcaagaagcacaggcgcaacagctcactcatgcatcaggcatcgaagccctcggtagcgatccattgcataaccatccggcacacctgaatgtgttgcagcctgacgccgcttacctggtaccgacagcatttgctgggttgggcattgatatcccctatcagcaggaactggatcgctggttgggcacaggtgcgagccagtctccatcatcagcagcattcacgcaaccggccaacaagccatctgcgggcagcgcgcaatcgttttattttttgcaaacggagccaaccgtcatcggtagtctgcccgcctctgcgcatcctgcgtttgatgtgcatgccgtgcgccgcgacttcccaattctgaacgagcgcgccaacggtcgtcagttagtctggtttgataatgccgcgaccacgcacaaaccacag

SEQ ID NO: 36515 - DNA, 267 bp, Glycine max
  Peptide Sequence Number=SeqID_128200
atggcctcaggctcaaagctcgctaaatcgattgaattacttgtagtcatagtaatggtcaactccgacatcttccagtacggcaatcgcatcttcggtcagtaccgccagagagcaatacagcgagaccaggtttggttgatacaagccaatcacgccttgtttgctttcgcctacgcgcagcaacaggattttggatttaccgttgacgataggcaacttgtcgctaggaatcagcggaatgccgcgccaggtcaggaactgtga

SEQ ID NO: 36516 - DNA, 201 bp, Glycine max
  Peptide Sequence Number=SeqID_128201
atgtccgccagggtccagcctatagccttcttatgcttcttgagaactgacaacaacttctcctctttctcatcagcaagggaggcagatataatcactggaaaactcttgctatcatccaatggtagaaggagatggtttctcagccttgtacctcataaagaaagtcagaggtatgtgtacttcctgaaacatggttag

SEQ ID NO: 36517 - DNA, 552 bp, Glycine max
  Peptide Sequence Number=SeqID_128202
atgacaccttcgaccgaagatgtgaagaaagcaatgcaaggattgtttgccgtactccagctctctatgtggggctggtttcacacctttttctccaagaaggtaggcccgtctatccgctacaaggaaggaagaatcaggattctatcttcatgcgaaggatgtccaaatgttcccttgatgggaacaaggggttgtattaattataatcccgttctcaccataagacagcttggctaccctgtgagaggagcgccattagacaaaagcatcacgcctttcattacacggggtttcagtgaccccaatgcaaaggacagagagcttaggggaagcagtaatgggatcatcggcggctatcataagtggctgagagtccgaacacaaggactggattggctcccaaatctaaagactatgagagatgatgaggttaaagcttcggaagaagtgatgagggcagcaatagtgagctcaaactctgaagaggtgaaaggaatcatcacgggtcaaaggcatgatctggaaggacgagctaaaggcttgccttag

SEQ ID NO: 36518 - DNA, 791 bp, Glycine max
  Peptide Sequence Number=SeqID_128203
actaaagggaacaaaagctggtaccgggccccccctcgaggtcgacggtatcgataagcttgatccacgcaatccatctgttttgataggatttgctgatcatgtggcacatagcatatggagtggacatgagcgacccgatctcaagttggtctcccatggtatgaaagtagataaatttgggagaccgactgctgagatcgaaggtatgattgcggccaccagattggatccactgatcaggtgttctgtaatcaccactgatcctggactcatatctgcctttgttgagaggtggcatagggagacgagcagcttccacctcccagtaggggaggtgacgatcactctagacgacgcttcatcactcctgcacattccaattactggcgccctgcattcattcgagccgctggttacatctgacgtagtggccctgttgatggagctacttgaggtcaccgcagacgaggcaatagctgagacacatcatacaggtgggcctcatgttcgattgtcctggcttcgagacattgcaacccatgtccatgttgtgcacttgcaggcattgagagacctgggccaggcaggggcattctcttggggagcggcgactttggtccacttgtacgatcagcttaacgaggcatcacaggcccttacatggcagatggccagttacatttcactacttcagtgctggatttacgagtactttccatcagtccataagtgtgttgtagacgatggttatgtcgaggctagcccacgtgcctgtaggtggcttacga

SEQ ID NO: 36519 - DNA, 795 bp, Glycine max
  Peptide Sequence Number=SeqID_128204
ggcgtaggacattgtcgcccgtccaacgtctcgtcttgtctcgccaccgcgcaagccacggagtttcccttttcagagtttccgtgccctacaacttgtcttcaagtgaaggtgagcttggttgctgcactaaggaaagctgagcaatttctttgggctggttctgagatggattctgttcgagacatggtaaagaatttgattgaagctcagaagtgggcagaagttttggctcatgttctgaactgcctcaattcttgtgctttagctgttgtgctgaacggcctcgctgatttcagcccatccctctctccctcgggtctctggaccgctgttgcttcctacggcacccccaatggttgggccggagaagttgaagatttccccactcacatctatgttttcctcacccgcgacagaactcaccatgtcaaggttgccgaattcggtggctggccctcctgggccgtagtgtttacagagcaattctcccctccaacgctcccatttcgcttgactcgatcatcgtccaacgagtcaccccaccgggtctccacgcgttcaacccccgccacctccccaggcaacaacaacttcaacgacggtgcttacgtaagcaccgtctttgaagttatatattgctacgtcgttgcatttaaagcccgtcctaagaaccaaatgtttccacgtcgttgttgccgtcgcaacgtcttcgaaggcgctgacgtctacaacgacgtcgcatttaaagatgggcgttcaccgtcgttgaacgccgatgacgaccgtcgttga

SEQ ID NO: 36520 - DNA, 219 bp, Glycine max
  Peptide Sequence Number=SeqID_128205
atggggggattaagagccattctaaccgatcaaaataagttggttgtagcagtttgtggagtgactgctctggcagcagggaggggtctacactgcaagggaatagaagagaagactgccaagttgaaaggaagtgagaaggctctagttgcacggcatgaagctaggtatgctgtagtaggtactgcagtagcataccttcttgctggacagccacat

SEQ ID NO: 36521 - DNA, 492 bp, Glycine max
  Peptide Sequence Number=SeqID_128206
atgaacactaatgagaagatccaaagcatgcagaaaagattcacacacatagtcaatcaccttgcctccttaggaaaaatctttcctaatgaagatttaattaataaagttttgagatgcttaagtagggaatggcagcccaaggaacatgatatggaacttcaatgtctcaaccaaaatgaagagatcgacaaaaggaaaagaagcatatcactcaaagcctcctcctcaatgcaagaagaagaagaaaaagaagaatctgatgatgaagaggacttctcactctttgtgaagaagtttcataaattagttaaaaatagaagaatggagagacgccatagcttcgacaatgggaagagatctcaagaagaaaagaatgagaagaaaagcgatgaagaaagaagatccaagaaggcgtatattgcttgggatgacaatgactcatccgatggttcacagaaggagatcaaccttctatcggggatcctctag

SEQ ID NO: 36522 - DNA, 327 bp, Glycine max
  Peptide Sequence Number=SeqID_128207
atggggaaccagccaagaccgaactgtaatgcaagtggatattttggatttcaacatggccagcaatataatcagcaacagggacagtggagaactcaccctgagttaggcatcaagaatctagaagtccaggtgggacaattggcaaaacaactggcagaccgaccgtcaagcagctttggtgccaacacagagaagaatcctaaggaggcgtgcaaggctattatgactagaagcaaaatggtgagcatgaatgaagaaattgacccagtggtggaacctttaagtgagattgaggaagaactggaaacagaagatgatcagtag

SEQ ID NO: 36523 - DNA, 671 bp, Glycine max
  Peptide Sequence Number=SeqID_128208
agaaaggtggggcaaattgggaccaactcttagcaaacaaagaaggagcgtctatcaactggttctctcgatggaaagaaggaagaaccggagttctttttttgtgcggaggatttccgaatgttcccttgatggggacaaggggttgcatcagttacaatcccgttcttgctataagacaacttggctaccctatgagaagggcggcactagaggatgagctcgcgcctgtcatttcacgaggcttcaataagaccaacgtggagacacttcagaaggtccgcaaggcatgggaggtgttgcaaaagaaggacaaggaactcaagggcaataataatgggcccatcggtggctatcgtaagtggttaaaatcccacgtgcaaggtttggattggcttccaagtttgagaactgaggaagttgaggcaccggaggaagatgaagaagtgcaggcccttagggcggaactcgagcaagcccaaacagttaaagaaaggttcaaatcaacagctctgaaaaacagtaaagagaatactgaactgagagatgtaaatgtggctaccaccaaagccttggaacgagaaaccaagagggcttgtagggaagaacatggccgaaacaagttccgaggggctctgtggggtagcaacagcgagcttaaactccgatga

SEQ ID NO: 36524 - DNA, 129 bp, Glycine max
  Peptide Sequence Number=SeqID_128209
atgaccggccctctcgatgagtcgatctcttgctttctcataagggtggacccttgggtactgtcataccctaatttcgtccggggacctttgcttgatgacatgcgacctttctttggtccttgtgag

SEQ ID NO: 36525 - DNA, 533 bp, Glycine max
  Peptide Sequence Number=SeqID_128210
cactttccgtcagttgcggagtatatggctgattcggactatgatgaggtgtcaccacgtgcatgtcggtggaatgctacgaaggcgactttgaagtccatatctatagcgacgtacaggcaacgtctagatcgactcaggattcctgatgtctgctggatgccttatggggagcatcgacctttcggatacgtccagagtattcctatagaggctgtagattcatgggtgtcatttgaagaaatagatgacaggtggatgcactactcagaccatcttgcaccagcaggtgagatatgtcatgtgctaggtcagtgtgcgctcgagtacatggactaccacatatccctcaggtcccaaagccaccagcagcaacaccgacacatgcccgatgcttgccatgcgatcgctgaaaggttggagtgtttgctcaaccttaggatagtcatggcaggcatagagacacacaaggtcatggaagaatgcatcaagattgccaggggtgtcatagaagacgacaatgtgtatgtgag

SEQ ID NO: 36526 - DNA, 381 bp, Glycine max
  misc_feature (286)..(286): n is a, c, g, or t
  Peptide Sequence Number=SeqID_128211
atggaggccataaaagagcaaatggacacaatgatgaaggccatgatgagcatgaagaagataatggaagtcaatgcggttatagttgccgctattagcgctgtcgctaaggtgaacccgatgctcccatctcgcctcaagcaaatgaatcatccaacctcaaatatggtaggcaaagatttgggaaccgacttcgagccttgcctcggatatgccacggaagggcaagcagttggtggtatacccctgcaaaacactttggagggccctcaatatcttccacaancacaaccctcacgttccacagcggttaaaaaccctcatgactatggcaggaatgggaaagtcggatcatctagaggaaaggctcagggccattga

SEQ ID NO: 36527 - DNA, 231 bp, Glycine max
  Peptide Sequence Number=SeqID_128212
atggatggcgaggagctgccctcgcccgtgaactctgatgggcagttccttcttaggtcacggctagaagtcaagacaagtcaatggcagaaatcgaccaaggtacttaggaagggaggcgaatggaggataggattgcgaccgaccaatcgtcacccattctcggcgttgggtcagcagagaacgtcgctgcaaggcagcccagtatcctttgaattcacagtattttaa

SEQ ID NO: 36528 - DNA, 665 bp, Glycine max
  Peptide Sequence Number=SeqID_128213
atgatcggcgaatggccggaacccctcgacagctacagtacctgcccctgcaaggcgaagtttattccgtcgatgatggatgatacgtacgagaagagcagtggagcttccgctggagaatcggcagcaggctttacagcggctccgacgcaaacttctcctgaattgcctggttatctgaccggtgagcagaagccgacagggtttgtgcctgattatcctgtattaaggaatacacatgatctacctgacggcaatttgagggcaatgttgaatgcgaataacaataacgtcatgttacttacgttgggggaagtgtttgagtatttgacatctatgggattctataagtcagggtggtcatttatttcccaaagcaaacccggtgaatttgttgttaactatggcacaagaaagtgggctgttgatgtggttaaagttggtatttcgtcagcgattacttggggggctggggcgtatgctataggggtgttctcaacaattgcagcgccaatagttgttgtactggttgctggtgcgttatccgcatgggcactcaataaattagatgatgagtataaaattacagacaaagtgatttctctcattgaatcggcgcagcaggaatttgttgagaaagcaaaagaaatggagaaaggcatatg

SEQ ID NO: 36529 - DNA, 1284 bp, Glycine max
  Peptide Sequence Number=SeqID_128214
atggcatccaggaagaggaagagcactacttctaggcctatagctcaatacactgacaacattctcggctggaatatcctttcagagagaaatgtgaagctttatcatactgagtttgacgagtttaaggtggagttggagaggcgtaatctgcacaaatgcctcgccaatctccgggatggaagcatagacatggctctagttaaggaattttatgctaatttatacaccatggaggaacaagctccaaagcaagccagagtaagaggacacctgatcaaaatagatgcaggcatgctgaatgaattccttcagactccagtggtgttagaggagggggaatctttacccacctactctagattttacaagttaaggactaaccaccaggagattaaagccaggctttgtattccccgtaaggggtttgttttgaatgctgagggccaaccatggaaaattctcagaaaagatctgacgacactggcccagacatggagtgtcttttcttactccaacctagctcccacttcccagacctcagatttgaatatagacagagctaggttggtctatggcttggtaaccaacatggacatgaacattggagcccttatctcaggtcagatttcttctattgctcagagtaactcctctaggctcggatttccagccttgatcactgcccatgcagagctagagaagttacctctgacattaactttagaggggcaaggaaggcaagggttcgatcagctggtgtttccttcttcttctactcaaccaactccttccacttctactactcctacaccagctcctcgaggcccatatgctcaggactctcagcgctttgaatccatgcttcagagtcttcataaaggacaaattttgttaatgcagagcttgcaggttatagctcctccaggatccattctgatagtggagcagtttttagagaaggtacaggatgcatcatctgaggccaccatccctgagccattcattcttgaagtaggtgagacacaggtaaggcaggaggctgcggctctagagagatcaccacagacttcaccagatccaccttctctagtggtggatcaatcttctcttcagcagccagcagacccgtctacaccattacttgatcttctagaggatccttctacaccagtcttgggattgactaccactcctccggccactcctgtgctacgtcttacagataaggagggcactcaggatgaggatactcagtcacaagacctgtcacaggaattttaa

SEQ ID NO: 36530 - DNA, 474 bp, Glycine max
  Peptide Sequence Number=SeqID_128215
acggaatttgaaatcttagaggcttctaacagtaggacgaaaaagaagttacttcagactgtcagcgagagatggagacaatttaaatcagacctcacgaggaaatgggcccttgcagccgatcaggacggtgtggacgacactatctgtgagaaatacggcataagcaaggaaaaatgggcccagtttttccagactcacagagacccttcttgggagaaaaaggcacaagccatccagaaacaaaacactgccccccatgttttgtctcgtggaggttatgaatatttggagcagaagctcctggctgagaagaccaagaagaagatggaggaagttgcacagttaggaagcattgatggcgtcatcgaccctccatcccccgtcagacaccacatgaagtggaagatggcccacactaagaaaacatgggagatgaccactgaggccgcaaaggaattcgctgcgaagatc

SEQ ID NO: 36531 - DNA, 66 bp, Glycine max
  Peptide Sequence Number=SeqID_128216
atgcttccttttgagttccggcatgtcacgaattgcctaacgatgggtggcaagtacctcaaaatg

SEQ ID NO: 36532 - DNA, 453 bp, Glycine max
  Peptide Sequence Number=SeqID_128217
atggaaaagatgaatagcacacttttgttttctgtgaaagaacaagactcttcatgtctggtcaagaaaaccattggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 36533 - DNA, 300 bp, Glycine max
  Peptide Sequence Number=SeqID_128218
atgcatggcagtgtgaaaatagcacgtagcgtgcttgctccgtgcccctattttagggacccatatgggagggagctaaaagggcttttagtgataattcccaaggtggtcatatctctcttgatggtctctagagtccctagtggagtcgccaactgtcgcaacctacccttcggcgggagggcgacgcgaggcttacgggtgcgtcttccatgggaggaagatgctcggagtcgtcgccaacgtttattcgaggaaaacatcggaaaaaccggaaaaaacgtggtctacgaactttaa

SEQ ID NO: 36534 - DNA, 618 bp, Glycine max
  Peptide Sequence Number=SeqID_128219
atgacccctgctgaagctaggaatttgattgagaagatggcttccaactcccaacaattcagtgcaagaaatgatgctattgttcttagaggagtccatgaggtggccatggattcatccttatctactgaaaataaaaagcttgaaggaaaacttgatgccttggtcaacctagtaacccagctcgccatgaatcagaaatctgcacctgttgcaagagtctgtggtctatgttcttctgctgatcaccatacagatctctatccttctttgcagcaatctggagtcaatgagcaacctgaagcttatgctgcaaagatttacaatagacctcctcagcagcaaaaccaacaacagcagaataattatgacctttcaagcaatagatacaatccaggttggaggaatcatccaaatatgagattgccaagtcctccacaacaacaacaacaacctttccctccttttcagaatactgttggtccaagcaagccatatgttcctcctccaatgcagtctgacaaccaaattcaagtgcctccacttgtagcaggacttgcacctgaacctgtcaagcttcattctacacttgaaaaagaggatgagatagttgcataa

SEQ ID NO: 36535 - DNA, 495 bp, Glycine max
  Peptide Sequence Number=SeqID_128220
atgcagagacaaacaaggtcatctgctcattttcatttcaaagacgacaatgtcttcagccattacatgccttcaaaggcaacaatgaccattgtttgcatttcaaagacgacaatgtcttcagtcattgcatgccttcaaagacgacaatgtcttcagtcattgcatgccttcaaaggtgacaatgactatcatttgcattttgaagatgacaatgtcttcaatcattgcatgccttcaaaggtgacaatgaccatcatttgcatttcgaagacgacaatggcttcagtcattgcatgcttcaaaggcgacaatgaccttcatttacattttgaaggcgacaatgtttttagtcattgcatgcctttaaagggaaataatgccatcatttacgctttcgaagacgtcaaagtcttcaactcaaaaacttcaatatttgttgtccttgtgcttcataggactcgacgtcctttgtttctaatcttttttaaataa

SEQ ID NO: 36536 - DNA, 360 bp, Glycine max
  Peptide Sequence Number=SeqID_128221
atggggacaaagggttgcatcagttacaatctcgttcttgctataaggcaacttggctaccctatgagaggggcaccactagaggaagagctcacacctattattgcccgaggtttcaataagaccaacgtggaggcacttcagaaagtccgcaaggcatgggaaataatgcaaaggaaagacaaagaactcagaggcaataacaacgggcccatcagtggctaccgtaagttgttgaaagcccacacgcaaggtttgaattggctcccgagtttgagaaccgttaaaggggaggaagttgaggcactggaggaagacgaagaggtgcagtcccttagggcagaactcgagcaagcctaa

SEQ ID NO: 36537 - DNA, 189 bp, Glycine max
  Peptide Sequence Number=SeqID_128222
atgtatgtaaatcttgcaaaggaggtgcatgagatggccccgaggaagcttgcctcaaagagatccaggaaggataaagcggccgaaggaaccagttccgctcccgagtatgacagccaccgctttaggagcgctgaacaccagcagggcttcgaggccatcaagggatggtcatttctccgggagtga

SEQ ID NO: 36538 - DNA, 486 bp, Glycine max
  Peptide Sequence Number=SeqID_128223
atggttcatggtccatgtggaattttaaggcctgcatctccatgcatgaaggaaggcaaatgcagtcgattttatccaaaaaagtttcagcgcgcaactcttatagatggagctggttatcctgtgtatcatagaagaaacactggtcggacaataaccaagaatgtgattataattgataatagatgtattgtaccctacaatccaaaattactgaaaaaataccaagcacatataaatattgaatggtgtaaccaaagcacttctattaaatattcattcaagtacatcaataaaggatatgatagagttaccgctgtcatggttcatgatgacactggaacacttccccatgcaaacactccgaatgatgaaatcaaggaatatctggattgcaggatctttggttttccaatatacggtagaaacacttatgtagagaggctacagtttcatcttccagaacaacatagcgttgtctactaa

SEQ ID NO: 36539 - DNA, 187 bp, Glycine max
  Peptide Sequence Number=SeqID_128224
atgtccctctactacgaatttcaatttttggtggagtgtagagggaacgactcccaccaagtggatccacgggcgccccaaaaggcagctgtaagcggggttaatgtccattatttgaaaggtaacctgacaggtatgggggcctatcagtacagggaggtcgatctctcccctaacctctcggcag

SEQ ID NO: 36540 - DNA, 159 bp, Glycine max
  Peptide Sequence Number=SeqID_128225
atggaaactgatgctctccaagccttagctcatgctgtggggaatcaaaataggggagaagctgctggagatgctgagtaccaagggttggaccgcttccaacgaaacaatccccctgctttcaatggaggatacaaccgtgatggtgctcagaattag

SEQ ID NO: 36541 - DNA, 522 bp, Glycine max
  Peptide Sequence Number=SeqID_128226
atggagcttattgagaatatggttgttagtgatcatgctattttacgtgatcggactcatattcctacaaagagaagcctattagagctttcctcacaagatgcactattggcacagtacaagtttctagctaagaagcttgagacattgacaggaacacttagttgcagcatatctggaggagcttatgaatctggttgctatatacctcttgatgaagttgcacaagaagtgaattatatggggaatcaacacagaccaggatttaatgcaggtggatttgcaggttttcagcaaggttccaattttaatcaaaatcaagggcagtggaggtctcatcctggaaaccagttcaataaagaccaaggaggatcatccaacaagcctcaaaatcaagggcctggtctttatgagagaacaaccaagctggaagagactttggctcagttcatgcaagttactatgtctaatcacaagagcacagagtccgccataaagaacctcgagattcaagtgggatag

SEQ ID NO: 36542 - DNA, 285 bp, Glycine max
  Peptide Sequence Number=SeqID_128227
atggtaattaaatacttgacgacccggtgcacttttcgaagagctgttgtagctgctttgattcctatagacttggaaattaatgctacttgtaggaaaagaaaagcagaaagaaagcaggacattgaggtagcaaaaactctagaagaacctctatcttctgaggcatcttctagttttccaactcaagggcaatctcatacaattttagctgaagcaaatatcatggctgaggagccaagaagagttactctagaagactactcaagctcaagtgtgtcgtaa

SEQ ID NO: 36543 - DNA, 54 bp, Glycine max
  Peptide Sequence Number=SeqID_128228
atggggctaaaggcccaagtggagaagggcgaaggcccaagtggagaaggataa

SEQ ID NO: 36544 - DNA, 237 bp, Glycine max
  Peptide Sequence Number=SeqID_128229
atgacgaagctgccaagaccggaagtggtagctttcgacgccggcacggcggcgtgtgagctacacgcgccggaagtcgcgagaagaagaagcggcgcgtggaggcgcgtgcgacagcggaaggcggcgcgagttgcagggttgggtcgcacttctcgaggcgatctgaaccctggtctcaccggagaaaatcgccggagatggcggccggcggcggacggtggcaacccgctctga

SEQ ID NO: 36545 - DNA, 327 bp, Glycine max
  Peptide Sequence Number=SeqID_128230
atggactgtgaaacctttctcaaaaagattggatcgttcgtcccccatggacgtcaggatgttctagccgctgctattggacgtctagagcaccctggacgtgtccgtgctgctggagccggtgtcaccatcaagcaatactttggatcggctccacggacgtcccgcagcgcttcctccctgcctcctgacgaattacatcagctgacccagcagatcaggcaccagctagaggagtccatcacagagaaagtgaaggcaggtcatggcatccttcagccagcttcagtcacagatgcaatctcagggacttgcagtgcctcctga

SEQ ID NO: 36546 - DNA, 270 bp, Glycine max
  Peptide Sequence Number=SeqID_128231
atgcacgtgctcaccttcagaggactgcacgtcctcacctttagagggctagacgccctcgccttcagaggactactcgtcctcgccatcagaggactacatgtcctcgccttttgtggattgcacgtcctttccttcaaaggactacacgtcctcgtctttagaggactgcatgtccttgtcttcacaaggctgcacgccctctcctttagaggactagatgtcctcgccttcagagggctacacgtcctcacctttcctgggctacac

SEQ ID NO: 36547 - DNA, 144 bp, Glycine max
  Peptide Sequence Number=SeqID_128232
gttgtcatgacggcgatttcctatgctgaatctcctgttatcagcttagtccgcccggaggggaaagtcatatcggcgccgcttcccggccgcgtgtcgcaacaaatggccgccgccctttgttgtggctgcacttcggggtaa

SEQ ID NO: 36548 - DNA, 297 bp, Glycine max
  Peptide Sequence Number=SeqID_128233
atgaggatcaaaaggccttttaaggttgtaatggggccaaggacaaggcttgtagtgagcttcaaaacaaggaaagggaaacaaggctcaaaagggctatcaaaggaattaattcaaagtaagtccatttggctagaagcttataagaacaaaattgcatcaatcatttccaaatatgcatgtgaattaggaagcatcaacaagaatcaagccaaggctattatgccaagcaatcaattggggcaaaacacaccaaatgattatggtgatggatggctcaaattctcacaaaggtaa

SEQ ID NO: 36549 - DNA, 766 bp, Glycine max
  Peptide Sequence Number=SeqID_128234
ggcgcattgcccgcttcgtgtatatctccctgtaccgtatgcaccagattgcgctgcacggctacttcaaaaccggactgatgatgctgggattggtgttgcggctgcgttaggtgtggctgccgttgccagtctcaacgtattagatcgcggcccgcagtatgctcaggtggtttctgctacgccgattaaagaaaccgtgaaaacccctcgtcaggagtgccgtaacgtctcggtaactcaccgtcgtccgggtggcgtgattggtcaccagtttggcggtggtcggggcagggatgtggcgaccgtggtcggcgcgctggggggtggctatgccggtaaccaggtgcagggcgcgatgcaggataacgatacctacaccaccactcagcagcgctgcaaaaccgtctatgacaagtcggagaaaatgctgggttatgacgtgacgtataaaattggcgatcagcagggcaaaatccgcatggataaagatcccggcacgcaaatcccactggatggaaatggccagctggctgaggagcttttttttgcatcagagtttgaggagctcaggccacagtcgcagcgtggtgtcgctgatagtctgcagtttttccagcgaggccccttcacgggcgctgatcgacatcccctgcaaaatacagctcaggtattgcgccagcacctgagggttacagtgcgccgggatttcaccgcgctgctgacgctgagccagaaacgcgctgagcgtctcctcctgcatggc

SEQ ID NO: 36550 - DNA, 149 bp, Glycine max
  Peptide Sequence Number=SeqID_128235
atggaggagttgattaagaaaacacaactctctccccaaaatattcccaacgtcatcacatcggcttggcggttcctcgacagaatctcatccctgcaccttattgttgtcattctgctccacacaaacaaggttcgcgatcatcacag

SEQ ID NO: 36551 - DNA, 306 bp, Glycine max
  Peptide Sequence Number=SeqID_128236
tcattattttggggacgccacaatgcgtcttctgaggctaccatccctggagcatttgatttttcaggtgcaggagtagagatgagacctgatgaggatgttttccttaagccaattgtgccagttatatatgagactgttgaagcagcaaatcctcctacaccagtacatgagagacaagcagatcctcctacacccatcatggagatgtcaaaagaccctaccacaccagtcctgagacggccatccactcctctagtgaccccagttttacatccgacagatgaggaggatatgcaggactag

SEQ ID NO: 36552 - DNA, 624 bp, Glycine max
  Peptide Sequence Number=SeqID_128237
atggtcgctgggagaaatgttgctaagcagcaacgtcatctagatctacgtgagggtggtgatgctggtgcgcatgattcgcacccgtctccttgctacgctccgggcaaagtcctacctcggaacgcacagcaactggctgatagcctcctcgtcgaagccagaggcctcactcctccgctgggaaaactcacaacgctggccttcttccaagatcaatggatgccccagaaactggttgatggcatcctcatcgaaaggaacccattggcccctcacccaggagcacttgtctctgactccctcttctgtaggccaagtgttcgcatagaactccatgactatctcaggatcgaacttagccatgggtgctacaagctgagcccattgcctccgggcaatttcctcttgaaactcagcatacttttcgtccctcagatggactcgcctctccctgaggaacgaccaacctttaatggcctcaaatcgttattggtgttcctcactctagaacctatgtccatcaaaatccacatctgcctgtggggccgcactagaaccctctccagcggcatctttcctggacctcttggccgaaagcttcttcggagccatttcttgtaa

SEQ ID NO: 36553 - DNA, 494 bp, Glycine max
  Peptide Sequence Number=SeqID_128238
gtgaatgtgacttacaggaaagtctctgagcgggatattctgataagcggggatgggacagtgaatagccgttatgtgttcggtcagcaggatggctatgaaatgtggaatgccggtatccgtttgaaggtgaacgaacagctgacattcaggcttattggggaaaacctgaaaaatgaagagtaccgccttgatggcagcatggggggcttaggtatgtacggccccggtagaaatgctctggcgttcgttcaagcgtttttgtgcggcacttgggaagtcagtaaaactgatcaggctacggtcaatcaggatgctgatcaagtcttccagtacacgtgccagttgaatgtcactttcacggaaggccataaggtgtcattcctcgtcacttggaggcagacattgctttcatacaccaccacgctttgccctggcgtgatcgcccactggtgctggccaaaacggatagtagcttcctcggcattcacagc

SEQ ID NO: 36554 - DNA, 222 bp, Glycine max
  Peptide Sequence Number=SeqID_128239
atggatggccccgccaacctgcgccattttgatcgtcaactggaagacattaccgggcgtgatgtgattgtcctgccggagatgttcaccactggcttcgccatggaagcggcaaaacagtcaatgccgcaggaggaggtggtcgcctggatgcataccaaagcgcagcagactcacgcgctgattgccggcagcgccgccctgcaaaccgaacgcgggccg

SEQ ID NO: 36555 - DNA, 435 bp, Glycine max
  Peptide Sequence Number=SeqID_128240
atggcagattattcctcaacatacgggaatgaagttttgcaaacaaatcttcgatctcttgagcggtctggtgatcatttgcttactaaggagatgtttagactttttcagtcatatctatgtaggactattaagctaagagtcgttgattgcaaagagatggccacgttctcaatttacacggttctcaagtactgtagtggaagtgtttggcttgtgtcatattgcccatcgacggttgactttagttgtagttgtatgagaatgcaatccattggtcttccatgtgatcacatattggttgtgttggtttctttaaattttatggagttgccaaagtatgccactttggttgaagttggtagacaagtttgtgaagatgcataccgtgatgaagatgagtatgaaaaaatgttgcatttcctgccaaatgag

SEQ ID NO: 36556 - DNA, 393 bp, Glycine max
  misc_feature (361)..(361): n is a, c, g, or t
  Peptide Sequence Number=SeqID_128241
atgaagcatagcactaaagcgtcctcatcaatgcaagatgaaaatgaagatgaagaatcagaagatgaagaagacttctcaatctttgtgaagaagtttcacaaatttgtcaagaagagaagaatcgagaaacatcaaaatttcaaccatggaaaaagattccaagaagactctccaactcttagatgctacaagtgcaaccaatttggtcacatcaaagcaaattgcccctcaaacgagcaatggcctgagaagaatgagaagaaaagtcatgaagaaagaagatccaagaaggcgtatattgtatgggatgacaatgactcatctgatggttcggagaaggagatcaaccatctatccnaggactatgagagcgatgagaacatctcttaa

SEQ ID NO: 36557 - DNA, 393 bp, Glycine max
  Peptide Sequence Number=SeqID_128242
atgattattgatgagtctcttttcttttctctgacacaactacccagtcagggtgcaccttttgagggcaccattgttgatgactggaagtttgattactccaatcatgatgcccgccgcatggtctgcattgaccagggggatatgaccgatagactgcttgtcgggtcattgacatttgattgtcgcatcatgcactatatcattgttagaattttgatgcctcgttcttctaatctagctcaagcctttgaggaggacttgattctgatgtgggctttcttgaccggtcgtccaatcgactgggcccatttgattcattaccatatgcataaggcattgcggtctagtgcacctctaccttaccctcagcttgtgactttatttctttga

SEQ ID NO: 36558 - DNA, 249 bp, Glycine max
  Peptide Sequence Number=SeqID_128243
atggaacggtatctacaacacttggttcaccagcaggtgcccaaccaccgggggcagggccagggtttcgctccttttacgtgccctactccagatcagtttagggctgaggtcgcatggcccggagattggctcgaggcccaggtaggggaggcgcctgcagtagctcccggcgatgcagaggaggcccgcatggatgaggagatgacagacttgctcggtttcttgggaggaagcggagccacgtga

SEQ ID NO: 36559 - DNA, 204 bp, Glycine max
  Peptide Sequence Number=SeqID_128244
atgtttaacacccatcgttctggaatccgtaaagatccaagatgtttcgggaagaaaccggtcaaaaagcacgaaaacgggagtgtatttagcaaagtggagccctcccaacacattttggaagttgggttgcttaaggaggaagcaactgggcgacaagctcctccaagttttgttgaaaaatggtttccggggcttccgtaa

SEQ ID NO: 36560 - DNA, 222 bp, Glycine max
  Peptide Sequence Number=SeqID_128245
atggattccattcctgccactgcaattgaaactggagatgtagcacctacacagactgttggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 36561 - DNA, 433 bp, Glycine max
  Peptide Sequence Number=SeqID_128246
ttatccagaactacgtaggtctgagtttctcattggaggatacgtaggagcaagagcctcgcttttgtcgaccgcaccaccttttgttaccatgacccaagagctggtagcctgcggagacaccttacggttatccgcacctcgtcattcagtgaccccaagtgtgattgacgagcagaggccaatgtggtcatctgcgccctttccggaggtgtcagcatcttccggtggagactttttcaagtctcacaagttatccagaactacgagtcacgtgacatgcggagatacccaagtggttgtccgcactttcaaaactttttgctgtctaggcggcgggctcgatgacatgcagagacaaattatggtcattccgcacaccttctgccattcagacacagtcgtgcccgatggcacgcagagacaaattatg

SEQ ID NO: 36562 - DNA, 327 bp, Glycine max
  Peptide Sequence Number=SeqID_128247
atggctgctagtgatattgctatcttaagagacagagcccacatcctaaccaagaaaagcttattggagcttacatcacaggatgcgttgttggttgcaggatgtacaatctgtcgtggagctcatgactgtggatgttgtatccctagtgaagaaccaattgttcatgaagtcaactacatagggaatcagcctagaaatacttttaatgcaggaggatttaccggattcgaaaatggccaacaatatcaacaacaaagacaatggcagaaccaccctggcaatcaattcaacagagaccagggtggaccgcccaataggccttaa

SEQ ID NO: 36563 - DNA, 129 bp, Glycine max
  Peptide Sequence Number=SeqID_128248
atggggttgaaccaagctcatgcttttacgaaaagaggaggtgcaagagcagatggaagccatgatgagcatgaagaagataatgaagccaatgcggttgtagttgccgctaccaacgttgttgctaag

SEQ ID NO: 36564 - DNA, 165 bp, Glycine max
  Peptide Sequence Number=SeqID_128249
caatgccttcaaaggttattttaatgatgccaaagaattcaagaatcaagagaagtttcaagtttcaagttttcaagaatcaagaatcaagaataatcaagaacaagattcaagactcaagattcaagaatcaagagaagacttaatcaagataagtatgaaaag

SEQ ID NO: 36565 - DNA, 174 bp, Glycine max
  Peptide Sequence Number=SeqID_128250
atgtgctgtgccggtgttgttggtgcccaaaaaggatggcgagaaaatgacttaaaccgaagaacgacgaagaacgtcgaagaacggttgaaaatcttcgcgaaatcacccacggaaacgttacggaagcgcctcggcttggattttcttcacggaaacaatttttctcactaa

SEQ ID NO: 36566 - DNA, 441 bp, Glycine max
  Peptide Sequence Number=SeqID_128251
atggaccaattgagtcaaagcaatggtctaggatcggtgtatggattccttgagccgcaggctatactgaatgcaaacgataaacgtggacaatgtcaagaatacattgaaaaatggcttaaggaatcgaaccgagatgtctatctaggcgcttatttgaatcatgcatttaagactttggaaaccaagagtgaggggaaatttggtcacagtacaccgcggtggattgaagtgaagagtcacgttcaaagcggaacctatgagtgtggctattttgtcatgcattggatgtggaacataatcgtcgggcagttgaagactaattggacgctgtggttcaatgatggcacgccgctagacatcaacatcatgacaacattacgaaaaaaatgggcagaatattttgtaaaacttagaagcatccaatgtacaaagctgtag

SEQ ID NO: 36567 - DNA, 442 bp, Glycine max
  Peptide Sequence Number=SeqID_128252
caccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggctccctctccggaatcgaaccctaattctccgtcacccgtcaccaccatggtaggccactatcctaccatcgaaagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 36568 - DNA, 498 bp, Glycine max
  Peptide Sequence Number=SeqID_128253
atgtccaaatcttgtggatttgggatgaccggccctctcgatgagtcgatctctttctttctcataagggtggacccttgggtactagttaccctcaccttcagaggactacatgtcctcactttcagagggctccacgccctcgccatcagaggactgcatgtcctcaccttcgtagggctacacgccctcacctttagaggactacacgtcctcgccaacagagggctgcacgccctcaccttgagaggactacacgtcctcgccttgagaggactacacgtcctcaccatcagagggctgcacgccctcacctccagaggactacacgtcctcgccttgagagggctacacgccctcgccatcagaggactgcatgtcctcaccttcgtagggctacacgccctcaccttgagagggctacacgccctcgccatcagaggactgcatgtcctcactttcagagggctgcacgccctcaccttgagaggactacac

SEQ ID NO: 36569 - DNA, 480 bp, Glycine max
  Peptide Sequence Number=SeqID_128254
atgtcgattggcttttgctttatgccaggacaaggggaattcttaataaaagatctccgagctcctgataccttagtgggtttaagaaagttaaaagatagcctaggcttatcgttaacaaaaggtagtcttaacagcaatccattacttaagttaaagggtatatctgactctgtttctaatagtatggagtcgctggcatctcgtgtcttggttgaagtaattacatttaatgaggggtattatggtcgattcttaatcctggtccaaatgggtattggttgtactgtatggtatggcttcgtacctggcttcgtaccgctgtcacaggcatttgctcaagataggcccttcatggatatggatattgaaataccggattctaataaatctattattatcggtgttagcttaggactagcagttgccatcttatttacatttgggattaacccatgccgcggagaagttatagtatga

SEQ ID NO: 36570 - DNA, 251 bp, Glycine max
  Peptide Sequence Number=SeqID_128255
atgggtgaccaagaggaagtacaggaacagatgaaagccgacatgtcggctttgaaaaagcaaatggcttccatgatggatgccatgctaggaatgaaaaaactaatggagaataacgcggccaccgccgccactattagttcggctgtcgaagcagacccaactctcccaactaccgcgcaccaacctatcccaaacgtggtaggacgagaaagaagcacactggggtacattagcaacccccatccggg

SEQ ID NO: 36571 - DNA, 624 bp, Glycine max
  Peptide Sequence Number=SeqID_128256
atgaagagaattacaggagcgccgtaccaggcacgttgggatgctttgacgatcacagacgtgtgctggttgccttacagtgaccatcgaggggttaaggggtttgagctgatttcatcattccagggtaagttgagatggggtcctacggtggttacagttcgaccggagagggtgctatgccggttttggtacattcagagcattcctccgccgtttgttagcgcttcgttgtcatatgatgatatagatgacagatggatgcatttctcggaccatgcaacagctgtgggtgacctttatgtagtgcctgggcaggcaggtgaccagcccagacatgcacctgccccagaccatgaggactacatgcagccggatatcccacaggttccagtggcatttgacccccctcgacatgcagtggatgattacgaaggctatgaggcgatcgcagaaaggttggagcgtgtgctcaaccttaggatggtcactgcagggacagagttacatgatatcatgcaagattgcctgaggatagccaggggggtgccagcacagatggaagtgttagggctcgacaaaggcggcgcacagagcattgatgatgttttttatgttttgtag

SEQ ID NO: 36572 - DNA, 234 bp, Glycine max
  Peptide Sequence Number=SeqID_128257
atggttaaagaaaatagtatggaagctaagtgcttaagaaaaaagggcaagtatggggaaggaatgaatgaaaaagtgaaggttattctatggatgaatgctctcctagaacctaagcttttgaatcctagaaaaaccatgaattgttggcagcctaaccccattacaagcctagaaagtctttcggattcatttttgtgtgtccattgttgtatgatagaagatgaaatgtaa

SEQ ID NO: 36573 - DNA, 304 bp, Glycine max
  Peptide Sequence Number=SeqID_128258
agatggttatgagcctggaatgggttggggccagaacagtgattgcttgacaaacttggtggagtttgctgaaaactgtgggaggtttggtctgggttacaagtctatgaatgctgacaaaaggaggatttctttggaaaggaaagaaagaagcctagcccgtttacaagggtggggaccacaggttgagaggatccctatctgtcgcatcaacgagagctttgtcaatgcggggtggatgcatgaggatcaagttgttgtactggatgaagaaaccaatcaagatcaatcaaattgggtgtag

SEQ ID NO: 36574 - DNA, 231 bp, Glycine max
  Peptide Sequence Number=SeqID_128259
atgggggagatgcttgccacccagctcgcccaggcgagcaagtaccgacacatcatcccgatactgtcgaatttgttcctctcggttgatacaagacgcaaaatgaccataatttgtctctgcgttttgttggacacaatcgcctctgggtggcgaaaaggtgtgcggaatgacaaagggcgcataatttgtctctgcgtgcttaccacccaacttgcgaaatctgaatga

SEQ ID NO: 36575 - DNA, 901 bp, Glycine max
  Peptide Sequence Number=SeqID_128260
atgggtggtcgctggacgcagggattcaaatcaaggatcggacaagcgatacgccgccggctgtatcgcgtcagggaccgcatcatgggtccggacccggcagtggcggcggcagtgcaaagcgaggtccatactctggaagagcgcctcgcggaacgactcacctatctccagaacgagataagcgaagcgagacagtatcttcgattcctattgggtgaatccgagcggtatcaccaatggatgagccagacccgggccagtttcaatacgcaatgggatatcctgcctgagggagcccatctggtcaccgatgaagcttttgtgaccaatgccagccagttgatcgaaacctacacgcagctgccggctgcatggttcaagggtaaatcgatcctggatgcgggttgcggcaatggccgatgggcttatgcattttccagactgggggccaacgtcatggccgtagaccagtcggaacatgggctgcagaacgtgcggcgcctgtgcgaagaattcccaggttttcgccatcaggcggtgaatctgctggaaccccttccgttcgatgaccagttcgatctggtgtggtcatacggcgttttgcaccacaccggagacaccaaccgggccttcgacaatatcgttcccgccgtgaagtccgacggctcgatgttccttatgctctacggcgagccatttcggcccggagaatacggcgagatcaacacgtacgtgcaacatcgtcgcgctacggttgcgatgaccttttccgaaaaggtggattacctgaaaggtatctacccagcggagttggtacacggatacttcgacgcgatcagtcccgccatcaacgatttatatcggtatgacgaaatcctcgactggttgaacctgtgcg

SEQ ID NO: 36576 - DNA, 798 bp, Glycine max
  Peptide Sequence Number=SeqID_128261
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccgctgcgtcggaacgttcgtccaaggaagcaccggggagaagaatggcgacctgttcccagatgaggcagagaatgggctcgttggcggcgatgggagggaggcccaggtactcgtcgtagcgctcgtcggcggaggcacgtgggacgctcgtagaggtcgttgctgttcctggcggcctggcggaggaggcccgccaacttctcagttttggatttcagctccagacattcctgtcggaaattctgggcctcttccgcaagcttcgggtaccgagctcgaattcgtaatcatggtcatagctgtttcctgtgtgaaattgttatccgctcacaattccacacaacatacgagccggaagcataaagtgtaa

SEQ ID NO: 36577 - DNA, 366 bp, Glycine max
  Peptide Sequence Number=SeqID_128262
atgagggttcactattatcaagcaagtcagagacctagcatgaccacagattcacctccactccttatgttcccatggacccggtccccagtggagtcaccaactgtcgcaacctacccttcggcgggagggcgacgcggggctcacgggtgggtcttccaagaaaggaaaatgcgtggagtcgccaccaacgtttattcagggaaaacgtcgaaaaaaccggaaaggtgtggtctacgaactttaagtgtgaaaggttcgggagttgtatttacgcacagggaaggctttcgaaagtccacgtttaaccaagaaaagcaaagaggaccatttaaggcattggaccttaaaatggtttttaggtga

SEQ ID NO: 36578 - DNA, 1041 bp, Glycine max
  Peptide Sequence Number=SeqID_128263
atggcattgaataagctctccacaaagatgtctaggagggacgcccatggggaaagctccagtgcctccatggagctctccacacgcaggcattggacacctctagtgactcccatggccaagtttgaccctgagatagtcctagagttctacactaatgcctggcccacggaggagggagttcgagatatacgctcgtgggtaaggggtcagtggattccttttggcacagatgccctcagccagttcctgggccacccactaatcttggaggaggaccagcggtgcaaattctaccagaggagggaccaggcctccggctttgacgaggaggccatcgcccagctgttgtgcataccggggcaagactttgcccagaccgctgcggggaggcgggagtggattatgtgcaccagtatgactactctgactcagatatggatgacgctgctactcagcaacatcctgctcagcgaccataattttgacctccctctgcctaagtgtcagatggtgtacaccatcctgacatggatgactgttcacgtggaccagataattgctgacgccatttatttgtttgcaggggcggcgcccactaggcaccctttggacccgaagaggtccaacagggccctgggatttttggccttgatcatgggcctctgccagttctacggggtacttgtcatccccagcaaggtaatccggccgccgatcactcaagctttcatcgagaaatattgcacccctaggcaagcgaagggtgacgcacagcaggctgcggatgcaccaccacctcagcagcccgatccagttataccactgagtgtggagcagtatctacggcatatggttcgccagcagatggccaaccaccgcgggcaggggcagggctcccctccttttgtatgccctagagattggcccactgaggagggaaccggacccgcaggatcctcgagcgaagcggaggaagcccacatggatgaggatatgaccgacctactcggttacttgggaaagggcggagctacatga

SEQ ID NO: 36579 - DNA, 202 bp, Glycine max
  Peptide Sequence Number=SeqID_128264
atgtgttcagcttcctctggtgaatcctttaatgcagaattgcgtggtactaagcgtagaattgataatacaaactcagaagcattatggcataagcgcttaggtcacatttctaagaacagaattgaacgacttgtgtcaagtggaatcttggattccattgatttcacaagctttgatgtttgtgctgaatgcattaaag

SEQ ID NO: 36580 - DNA, 180 bp, Glycine max
  Peptide Sequence Number=SeqID_128265
atggataagatcttgaaggtaggaaaagatgagtggagggagagggagagacggggacacggaatttatgcctcaaatgaggaggtgagcttagctattagagagcttctcaaggaagttttctcaaagaagcttctcaaggaagttttctcaagaaagcttctcaaggaagctacctag

SEQ ID NO: 36581 - DNA, 210 bp, Glycine max
  Peptide Sequence Number=SeqID_128266
atggctgagagagttgattcaaaatttagactagattgtaaggaaagatgtttttggagttccttttttttagtagataacaaaccggatgcaatcctccctaggaagggaccagtcactagagccatgagtaagaggctccaagaggattgggctagagctgctgaagaaggccctaggattctcatgaacctcggggtagatttctga

SEQ ID NO: 36582 - DNA, 240 bp, Glycine max
  Peptide Sequence Number=SeqID_128267
atgctccagaccaagtcaaggactggtttcagagcaaccctgagtttctctaggcctgctaatctagagacatctctgtttctgaatcaaaagtctcaacttgcagcattcttagcaagctcaaaatctaaagagagtcttgctcagaatcttaaggaagttctccaactacttcaacaggaagaagaagaagaaccccccaagaaggaggccgaatcatctgagaataatgatgactag

SEQ ID NO: 36583 - DNA, 315 bp, Glycine max
  Peptide Sequence Number=SeqID_128268
aacagcccccttcagcctatttataggaaaaagggggaggaggttgccgccctcgctcgcctgcgaagggcacgttgcgacagttggcgactccactggggagcgagggcgaggctcacgggtgtgctttctaaaggaggaaaggaaaaccgaaggaaaccggtcaaaatgaaaattctaagttcgggagttgtatttaagtttgaggaaggtattagcacctctcacgttgacaaaagcggggcttttgctcctacgtaccctcctttggagaagaaatcagacctacgtagttcttacttaggcacgaatcaa

SEQ ID NO: 36584 - DNA, 639 bp, Glycine max
  Peptide Sequence Number=SeqID_128269
atgaacgccaacgaagaggatgggccatcgcgagcaaagagtttaggagaggtagctacttccagacgcttcatctaccaatcgctgcaagcggtgtgtatggtctcccgtggcggaggcaaaaaggacgagtatttgtttcacctcggggagtcgcacgacatggaaacctgtcctgcggtagaagaattgcttcagcggttcatggattgcgggcagcttgaagtgtccataggagggagggaagaaccacaaatttgcatgcagtcggaagagaagaaggttcctctaacccccaaggccctagtgatatgttttactaggaaagggaccggctccacacccattgaaagagttgcgaccgaagttgactccctatcagctaaggtgaccaacatcaccggcctcagtggcataacccgcagtggttgggtgttcgcttcccctcacccggcggagtttccctccaagggaaaagcgcccatggtccaagagcccacagacgtagccaccccctcgaaagaagtagatcctccagtggtaagaggggctaaaaagaaagaaggtcttcaaggtaagacggtgactttggaagaggcccatgagttctttcacctcatccaacaaagcgagtttaag

SEQ ID NO: 36585 - DNA, 1164 bp, Glycine max
  Peptide Sequence Number=SeqID_128270
atgggaacaaatcaaaccggcaagaggttttaccaagtcaaggttaaaagcctagataccaccagcatcaaggaattagggtggttgatggaacctctccaaatgcaagctttccgcaagatttacggaaagatcttagagttgaccatagcagaggtatccatagaagccatcgcatcactcacccaatactacgaccagcctttgagatgcttcacgatcggagacttcaaattagtaccaaccattgaagaatttgaggaaattctaggatgtcctctcgggggaagaaaaccatatctttcctccggcaagaggtttggaccgcataaaacagactcggaacggcatagcgggcctaccacggaggtacctagaagacatggcaaggggtatggccaatcaaggagattgggtcccgtttatggatgtgttagctttgctaatttttggggtcgtcctctttccaaacgtagatggttggtggacctagcagcaatcgacgctttccttgcataccaccatagcaaggaaagtccggtggtggctgtcttggcagatttatttgacacatttaaccgaaggtgcaaaaagagtagcgcacggatcatctgttgcttgctcgccctctgtgtttggttggtttcacacttgttccagcaagacacaaggcatccatgtccgctccagagccatcgctcgtgtactgaaaagaggagaatagattgggaccagcttttggctgggataagaggtagaacaatcaattggtttccccgatggaaggaaggaaaggagggagtccttttctcatgtggagggtacccaaacatgccgctgataggaacgaggggttgtattaactacaatcccgtgctcgctataagacaactagggtaccccatgaggggagcaccgatggaagaaagcatgtctcctttccttgtgagggatttcggcgcacaaaatttcaaagctatacaaagaatccataaggcatgggaaaccctgttaaggaaagatcaagaacttaggggcattcgtaatggcatcattggtggttaccatgaatggctgaaagttcatatacgaggtttagattggctcgccaaattaaaagttgtcagcgaagagagttttgaagcaccggaagaggacgaagaa

SEQ ID NO: 36586 - DNA, 374 bp, Glycine max
  Peptide Sequence Number=SeqID_128271
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggggaactacaagcttccaaagcactgcgacaacaacgaggtcctgaaagctctctgcgccgaagctggctggatcgtggaagaagatggcacaacttatcgaaagggatgtaagagacccacgagtgagattggaggaacaccactgaacttaagcgcgtgttcttccattcgg

SEQ ID NO: 36587 - DNA, 444 bp, Glycine max
  Peptide Sequence Number=SeqID_128272
atggtagccataacccctactaggtttcctcaacctccatttttccgaggatacgactcaaacgcaatgtgtgcttatcatggaggaaccccgaggcattccattgagcattgtatgaccctgaagcgtaaggtgcaaagtctaattgatgcaggctggctgaaatttaaggagtatcgcgatttccaagtttatgccattattgtaaaagttacaatgctaaataaaatggataaatttgatatctttgtccctcatcctctcacaagcgcatctttgcttattcaactttcaccagaatgtgggtgcaagccattggtctatttgttcaagcgaccagcgctcccaagtttggacttccaaaactgttcaatcagaaattactcgtgctacacatttggtgagggtgccgtaaaacgacaactgctggtaattgattactag

SEQ ID NO: 36588 - DNA, 228 bp, Glycine max
  Peptide Sequence Number=SeqID_128273
atgtatgttcgtaaggaaatgaaatggccccaaggaagcttgcctcaaagagatccaggaaagacaaagccgccgaaggaaccagttccactcccgaatatgacagccatcgttttaggagcgctgagcaccagtagcgcttcgaggccatcaaaggatggtcattcttccgagagagacgcgtccagcttagggacgatgagtatactgacttccatgaagagatag

SEQ ID NO: 36589 - DNA, 414 bp, Glycine max
  Peptide Sequence Number=SeqID_128274
atgagtcatcattcatctagtgttaatggcgaggatactagtcataaggatcctctatctagaatcttagatgagttgagttccctcaagttatggaaattacaacttgaaagaaaagaaaaaggaaaagagagggtaaaactcaatcaagatgagagggaacaaataagggaagaagaaagaaggaaaatactcagagttaagaaaaaaaaacatccctcctatagtagtcataactcttgcaagagcctaagcgaagaacttcgtgactattatgaaggaagacatatgtcacatcttagacctcactcctataggagagagaaggaaagaaatcctcaagaggctaacattaacctcctatacttccatgggaaggacaatgtagaagctaacttagattgggaaataagg

SEQ ID NO: 36590 - DNA, 556 bp, Glycine max
  Peptide Sequence Number=SeqID_128275
atggttgctgcggctaacgagagaaatggtcaggcggatgtcaccggtattttactttttaacggtacgcattttttccaactcattgaaggaccggaagaaaacgtacagcaaatctatcgacatatttgcgccgacccgcgtcattacaatctggtggagcttctgtgcgattacgcgccggctcgccgctttggtaaggtcggcatggagctgtttgatttaagggaacacgatcgcgacgcggtactacagaacgtgctggataaggggacgacaaaatatcagctgacttacgacgaccgggcgctgcattttttccgtacctttgtcgaagcgacggaaaaagagaactattatgaaattccgtcagctgatagctgggattttactgctgatgagagctcgttttatccggccgtaccctgtatcgacggcgctgaatcatgctgttttgcttttcagccggtggttgacccctttgcctgcgaaataatctcctgggaagcgctgctgcgtaccgttgacggagaaccgcccgcagcctattttgccg

SEQ ID NO: 36591 - DNA, 276 bp, Glycine max
  Peptide Sequence Number=SeqID_128276
atgtcacggaacttcacggattgcctaacaatgggtgttaagtacctcgacacggccaagcgaaggttgcatcccaccaaacagatggttcttttgactcatattttgtgtgaaaaataccaggaacacttgttttggccagatttgagagattcaaaagaatttgagaacttgtgtttatcaaaacttcttttgaaccttggcctatcaaaagaaatccccatcctttcccctgatgcaaaggatagcggaatctcctcaagggagggcgaatag

SEQ ID NO: 36592 - DNA, 1257 bp, Glycine max
  Peptide Sequence Number=SeqID_128277
atggctacctcaccaaaagaaacttccgcttctggttcacccgctgtaccatcatctccgcaccaggaacaaccagaattcaacatccaacccatacaagtaattcctggtcaagcttctgtccctgagaaactggttcccagaagacaacagggagtgaagattgctgaaaaccctagccttgcaacaagtcctagggaagtagacacggagatggacaagaaaatccgcagtatggtgagtagcattttgaaagaagcctctgtgcctgaagctgatgaagatgttccaacatcttccaccccgaatgtttctatgcctgatgttgagaaagatgttccaacatcttccggcccaaatgatgaagtactctcttcccccagcaaagagagatcaacagaggaagatgatcaagccgcagaggagacccctgcaccaagggcaccagaacctgctccaggtgacctcattgacttagaagaagtcgaatctgatgaagaacccattgccaacaggttggcacctggcattgcagaaaggttacaaagccgaaagggaaaaactcccatcaagaggtctggacgaatcaagactatggcccagaagaaaagcactccaatcactcctacctcatccagacgaagcaaagtcacaattccttccaagaagaggaaagaaatttcctcatctgattctgatgatgatgtcgaactagatgtctcgacatcaaagagggccaagaaatctgggaaaaaggtgcctgataatgtccctgatgcaccattggacaacatctcattccactccattggcaatgctgaaaggtggaaattcgtgtatcaacgcagacttgccttggaaagagaactgggaagagctgccttggattgcaaggagaccatggaactcatcaaggctgctggactactgaagacagtcaccaagttgggagactgttatgaaagcctagtcagggaatttattgtcaacattccctctgacataacaaacagaaagagtgatgagtatcaaaaggtgtttgtcagaggaaagtgtattagattctcccctgctgtgatcaacaagtacctgggcagacctactgaaggaatgatggacattgctgtttctgagcatcaaattgccaaggaaatcactgccaaacaggtccagcattggccaaagaaagggaagctgtctgcagggaagctaagtgtgaaatatgcaatcctgcacaggattggagctgcaaactgg

SEQ ID NO: 36593 - DNA, 459 bp, Glycine max
  Peptide Sequence Number=SeqID_128278
atgggggcatacttcctcactagactcttcaccccttacttcatcttcacttccactagaggaagggcaagaagtagtctcctcttgactactataaatgtcttgacccctcatgatcatggttttctttttggggcattgagaggcaatgtgacctctcccaagacatttgaagcatttagtattgctagccctttcttgggaactagtcttagggcctttggagcttgtccacaagctccctttcatagaggaaggaatgtgcctcttcctaagggcacttttaagatcattacaatactctactggaggatccccatgaatccttcgttccctaacaagggaagtccaccaatagagggcatacccttgaaagctaagggtagccaatggaacttttctctcttcgctaatatgatggcaagcaaagagttgttcaaccttcatttcccaatctaa

SEQ ID NO: 36594 - DNA, 744 bp, Glycine max
  Peptide Sequence Number=SeqID_128279
atggtgtggtataggcgcaaaacaaaaatgtttatcgacccaaacaatgcaaacacgactacattgggtgaagttaccgagacattgcagtatatggtgtcaccacaagggcgaaacacatggacaattgatgatctcgtgccatatgttgaaaagttagcgattttatcccaagagcaagagaggatcactaagcctgtggcacatggtccagcatcagagcgtcgatttcccccacaacagtttcacatgcttcagtcaagtgttgaaactcgaggttttgacagacgaagggagattgttcaagcggaagatttttcccaacatatggagcagcgtggccatggaatgtattacacgccaccaacatttgctcagtatccttcgcagatgtatcagtatcctttcgaaggccatgacactgatatgtctgcaagcgaacattcgtttggtggtgttgcggaaacacagcctcatttttcatggccgaccatgaccccttcgcagcaacatgatgccccaatggcaacacctaatgtcccattaggtcagcaatgggatgtacccggagcaatccctgctatgggtgacttattaggtgttgatttgcgtcacgagttttctgcagaggctgaggaacaagggcggagacagcgcgcaagaagaaatccggatcgtcaagcccgaaggtgggatcgaccatgtggcacatcctcgcgccatcacggacaccataatgactga

SEQ ID NO: 36595 - DNA, 177 bp, Glycine max
  Peptide Sequence Number=SeqID_128280
atgtggtaccatggagaccagtcagggtcacagtgttttgcgagaatgctccaatcatatgggatcaacataggcttaaaggagcactcaaaccatgtgacccccaagacttacactccgaagagtccgtcagggtctctccctcttgattcaggttcaacccagaaaacattttag

SEQ ID NO: 36596 - DNA, 426 bp, Glycine max
  Peptide Sequence Number=SeqID_128281
atgtcgctaagtagcaacgtcatctatatctatgtaagagtggtcatgttggtgcgcatgatccgcactcgtctctttgcagcggcacaggtgaaatcttgccccggtatgcatagtagctgtgtgatagcctccctctctggttgtgctcgcacagttggccctcctccaatattagggggtggcccaggaaccgtgtggatgtcgaccacactgaaaatgaggacacgtagccctctaatggtgagggcgtgcaaccctctcaaggcgcggaggtgtagtcctctggaggtgagggcgtgcagccctctgctggagaggacgtgtagtcctttcaaggtgagggcgtgcaaccctctgatggtgaggacgtgtagtcctctcaaggcgaggacgtgtagtcctctcaacggtgagggtaactag

SEQ ID NO: 36597 - DNA, 228 bp, Glycine max
  Peptide Sequence Number=SeqID_128282
atgggggtgcaaatagcaaccaggcccacttgggccttccagaatattcctccaaaaggcgaaaatccaagccgaggcgcttctgtaacgtttccgtgggtgatttcacgaagattttcaatcgttcttcgacgttcttcaacgttcttcgttcgttcttcgtcattcttcggtcttcaaccgccattcggtcatgccgtaaccacgttggaaaccaaaaagaggtaa

SEQ ID NO: 36598 - DNA, 821 bp, Glycine max
  Peptide Sequence Number=SeqID_128283
gccaaccaaaccaaggaattgcggccctccgtttaccatccccaaacccaccaacaagttctacttcttctacggccaccgcaacccctcccagaaccgccccaccgtccgcggcggcctcttctccaaccgacaaaccctaaaccctaacccttcccaacccaaacccaccaccaaacccttcaacatcaaaaactgggaccctcacttcctctccaacccaaactcaaacccctccccatcaaccctctcctccgcctccctacgcctctccccgatcgcgcgcttcatcgtcgatgccttccgcagaaacgacaacaagtggtgccccaacgtcgccgccgaactcagcaagctccgcaggataacccccaatctggtcgccgaggttctcaaagttcaaacaaatcacaccctcgcttccaaattcttccactgggccggcagccagagaggctaccatcacaatttcgcttcctacaatgccctcgcctactgcctgaaccgccaccaccagttccgcgtcgcggatcagctcccggagctcatggagtcccagggcaagccccccagcgagaagcagttcgagattttgattcgtatgcatagtgatgccaatagagggcttagagtttatcatgtgtatgagaagatgagaaacaagtttggggtgaagccgagggtgtttttgtataacagggttatggatgcgttggttaggacgggtcatttggacttggcgttgtcagtttatgatgatcttaaggaggatgggctggttgaggagagtgtgaccttcatggtgctggtgaaggggctgt

SEQ ID NO: 36599 - DNA, 133 bp, Glycine max
  Peptide Sequence Number=SeqID_128284
tcgagacaagttgactacggaaataaaccaaggtacatagggacggatgcaagtggggatggggtcacgaccgaccgatcgttgccccttcccggcgctaaacaagcagagaacgtcgctgcaaggcagccca

SEQ ID NO: 36600 - DNA, 483 bp, Glycine max
  Peptide Sequence Number=SeqID_128285
atggggggtctttgttcaaagtctgtgaaaggtgacaaggtgtttgctaaatcagatggacattctaataaccataaatctaatggtaagaagcacaactccaccaacatgcctagtgatttgacaagtgcaagggatcatggactagacaagaaaaaacaagaagttgttgctgctgcagggaatggttctgatgatttctatgatggacttgggtgttgtcatgttcaggttagttctgaaattgacatagcatttgtcagggataaaaccgttttagctccagaacctctagctgattatcctaccccatatgaaattcctcctgttgattcagctaaacaaccttcactagataatagcccttctgatggctcagctgaatacattgagttatattcaacgctattagaatatttcgatctaactcgttatggagcagtggctgatgggaggacaaattctagctctataagctcttga

SEQ ID NO: 36601 - DNA, 900 bp, Glycine max
  Peptide Sequence Number=SeqID_128286
atgaaagatcatagcgttccattaaaactggtcgccctgctggctgatggcgaattccactctggtgaacaactgggtgaagcgctcggtatgagccgcgctgcggtgaataaacatattcagacgctgaaaagctggggcctggatgtctacaccgtgacagggaaaggctacagcctgccagcgcccattcagctgctgaatgaagaggcgatactggcacatctgcatcagccggatctggcggtgattccggttattgactcaacgaatcagtatttacttgatcgcatggaccagctgaactccggctatgcgtgcatcgcggaatatcaacaggccgggcgcggccggcgcggacggaaatggttctcgccgtttggcgccaatctctacatgtccatgtactggcgactggagcaggggccagctgcggcaatgggcctgagtctggtgattggtatcgtgatggcagaggatcgtaaactggcgggtattctggttgagctcaccggtaaaaccggcgatgcggcgcaaattgtgatgggcgcggggatcaacctggtgatgcggggcgaaggcacggcggaaatcaatcagggttggatcaatctgcaggaagccggcatcgagatcaatcgtaacgaactcgccgccaggctgataaaccgtctgcgtgaagctttaccgctgtttgaacgggatgggctggcgccgtttgtcggccgctgggaagcgctggataactttatccatcgtccggtaaaactgctgattggcgatcgtgaagtgcatggcattgcgcgcggaattgataagcagggcggtttattgctggaacaggatggtgagattaaatcctgggtcggtggcgagatctcattacgtcccgctaattaa

SEQ ID NO: 36602 - DNA, 498 bp, Glycine max
  Peptide Sequence Number=SeqID_128287
atgggtcagctccagtggcaagctttttgcaaagcttacggtaaaatctgggacttagccatggtagaagtctccacagaggccattgcctcccttgcccagtattatgatcatccgttgaggaaaccatacctcttctcagggttctatccctcattagctagaatttccaagatagtccaaatctcgacgcaggaattagaccacaggaagcaagtcgaaaatgggtgggccccattcatagacattctcgcactgttgatcttcggaggagtcctttttccgaatgtggatgggttggtggacctggcagcgatcgacgcttttctcgcctatcataaccacaaggaaagcccggttgtcgctatgctagccgacctatatgacaccttcgaccgaagatgtgaaaagaacaatacaaggattaaaggatgggcaaattgggaccaactcttatcgagcaaagaaggagcatctgtcaactgggggatcctctag

SEQ ID NO: 36603 - DNA, 167 bp, Glycine max
  Peptide Sequence Number=SeqID_128288
caccactcattgagttggtgagggactatgttctctcatgggaagatggtcaggaaaggggtgttgaggaaacaatccctgagtttcaagaacctatggatttgaggtcaaatccttttcaagagggaggaaatgatgcaatcctaccccccaagggcattggatag

SEQ ID NO: 36604 - DNA, 345 bp, Glycine max
  Peptide Sequence Number=SeqID_128289
atggatgaagatgagtggatgtatgaaataatgtctgaacaagaggataatgattatgaaaatgaagaagcatgtggtgcgaatgaaccacatgttgattgttctgatgcattcaatacttctcaggtgtttgagtgccgagaggatgttttgtggtgggctcgatccgttgttcatgaaaacggatttgtggcagtgattttaatgtcgtacacaaacacaagagtggcgagtataggtgtaggaaaaaagaatttatcagaagagacactaggactaggaaatgtgggtgtcccttcaagcttcgttgcaagccaatggttggaggaaaaggttgaatggtga

SEQ ID NO: 36605 - DNA, 150 bp, Glycine max
  Peptide Sequence Number=SeqID_128290
gagttaagtccttacaatcaatatgaagaagaaagaactcctaatcttgaaagtgtgtttgaggaattcatggcataccatgtgtcataccctaatttcgtccggggacctttgcttgatgacatgcgacctttctttggtccttgtgag

SEQ ID NO: 36606 - DNA, 511 bp, Glycine max
  Peptide Sequence Number=SeqID_128291
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgactctagaggatccccgatacctgtggaactggaaagagtacttggataaggcagttcacattatcctgacaactgataatgatccactaggtcaagctttagcggaagagctggcacggcgccttgggcgaggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 36607 - DNA, 285 bp, Glycine max
  Peptide Sequence Number=SeqID_128292
atggctcttgggtcaaaaagggtgttccacccgctgatgatgaaggcaacctaccagttgaagataattcctctcttcttcgaaagcttttggaaaagttcgatgcttgtcttgatttcaggtattgtcatcatcaaaaagggggagattgtagaacaaaggatcaagctgaatgttttgatgatgccaaaggattacatgaatcatatgcttctcaaagatttactcaagacaaagcaattagagatattcaagatggatgatcaagacagtctagagtcttag

SEQ ID NO: 36608 - DNA, 906 bp, Glycine max
  Peptide Sequence Number=SeqID_128293
atggaggatacatttccctgggcatttatcgataaagtaaatgagctgggaaatggcgagattatagcagaacctgtccatattgataaacttgaacaaggggctgattatggttatgctgttattatagacaggatttcccatgatgttcccttctacagggcatacctcaaaaatgctgcactgaatgggacctatattatcaataatccgttctggtggagtgctgatgaaaaatttttcaataatgcactgatgacaaaactgggaattcctcttcccaaaacggtattattaccttctcacgaaaggccaaccaatactacggaaacatcattcagaaacttaaaatttcctcatgactgggaatatatattcgattatgtaggttttcctgcttatatgaaacctcacgacggaggaggctggagaaatgtgtatagaattgaaaatccggaagatttatggaataaactgggtgaaacagaacaactcgtgatgatggttcaggaagagattatttttgatgattactacagggtatattgcctgggtaggaaatacgttcatatcatgccttatgagcctcgaaatgagcctcatttaagatatgcaaccaatcatcagactgatggtgaagaactggaaaaactattgaagaccattcacgattataccataacaatgaatgaggccttaggatatgatttcaacaccgtggaatttgcagtacgggatggaattccttatgctattgatttttgtaatcctgcgcctgatgccgacagaaattctgtaggagaagaaaattttgcatggattgtggaacacgctgctctgtttgcgattgaaaaagccaaagaatatgttccaggaaagcctaatatttcctggggaaatttttaa

SEQ ID NO: 36609 - DNA, 273 bp, Glycine max
  Peptide Sequence Number=SeqID_128294
atggttggtttgaaggataatggtgagaaaaagaataaagatggagttgaaaaagaaaaagagaaaaatgatggattggtgactagtgaaacagtggaagagaaagtagtaagtgaagaagagaagcaaaaatcaaacaaacaagccactaataaaggtaaagttgtagtaaatcgtccaccaattgagtattttccttatctgcatgctccgtcaaagaaagacaaggaaaggcagtacaagcgtttcttagaaattttcaaacgactgtag

SEQ ID NO: 36610 - DNA, 249 bp, Glycine max
  Peptide Sequence Number=SeqID_128295
atgataaaaaaaagagaggtaagatcatctaattattctcatggagaagatgacgagtatgaagaggatgagggaggatggaggaatgagaggtatagggagagaagaagtcatagaagatatggaggtaggcaaagagaggaagggattgagggagtaaaggtgaagatccctacttttaaagggactcgtgatccgaaagtgtatcttgagtgggagatgaaggttgagcaagtctttgcttgctag

SEQ ID NO: 36611 - DNA, 372 bp, Glycine max
  Peptide Sequence Number=SeqID_128296
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtggggattatctcgtccatctcgttatgtccctgaaatcctggcagctttcttctggacagtcccagctctcttcaatcatgtaagggtccctttgggtaccgagctcgaattcgtaatcatggtcatagctgtttcctgtgtgaaattgttatccgctcacaattccacacaacatacgagccggaagcataaagtgtaa

SEQ ID NO: 36612 - DNA, 480 bp, Glycine max
  Peptide Sequence Number=SeqID_128297
atggattcctctaagagaaaaactcaaatgtcatgttaccgtctctggccggttcatgatagatcaagatttgtatcacaggaggcctgggattgttactcccagataataagagaattgatcagaagaaactggcataaacagctgactaacttgactgggggaagcattgatgtgacaattgtgaaggaattctatgcaaatctttatgtcccagatgacaagtttcccaagcaagttagggttcgagggaacctaataaaatttgatgttgattccctcaacaccttcttggagactccagtggtcgtggagcaaggggagagcttacctttttactccaggtttgctaaactgaggcctgatcctcaggagcttgcagcccggctgtgtatccctgggaggggatttgttcttaatgttgagggtctaccgtggaagctcttgaggaaatatcttaccactctggcccaaacctag

SEQ ID NO: 36613 - DNA, 474 bp, Glycine max
  Peptide Sequence Number=SeqID_128298
atggaaccaattgcctccctcgcccagtattatgatcagccgttgaggtgcttcatctttggggacttccagctatcaccaatggtggaagaatttgaagagatcctaggatgtcctctagggggaaggaaaccatacctcttctcagggttctacccctcattggccagaatttctaaaaaagtccaaatctcggcgcaggaattagaccgccaaaggcaagtcgaaaatggggtggtcggaataccgagaaaatatttggagccgacctatatgacaccttcgaccgacgatgtgaagaaagcaatgcaaggattgtttgttgtactccagctctctatgtggggctggtttcacacctttttctccaagaaggtaggcccgtctatccgctacaaggttaccgctcgtgcgtcgaaaaaggaaaggcgaattgggaccaactcttggctagcatgggggggcgtctgttaa

SEQ ID NO: 36614 - DNA, 441 bp, Glycine max
  Peptide Sequence Number=SeqID_128299
atgccaatctcccctgcagatgtatcagttggtctgtgccgtcatgacatagggatcgcgcccacaagacacccagtggacccgaagaagtccaacagggccctggggtttccagctctggttacgggcctctgtcagtcctacagggtgcccgttcccccagcgaggtcatgccatcgtgacataggaatcgcacccacaaagacacccagtggacccggagaagtccaacagggccctgggggattgtgcccgcaagacacccagtggacccaaataagtccaacagggtcttggagttgtcaagctctaattacgggtctatgtcagttctacggagtacctgtcacctccagcaagggcatcaagccccctactaatcgagcttttatcaagaagtactgcatccccaggcaggcgcagggcgaaacaccacagtag

SEQ ID NO: 36615 - DNA, 76 bp, Glycine max
  Peptide Sequence Number=SeqID_128300
atggtagctcgcccaggcgagctgatgcttactcctgaagtaacttgctcgcctaagcgagctgcagctcgcccag

SEQ ID NO: 36616 - DNA, 219 bp, Glycine max
  Peptide Sequence Number=SeqID_128301
atggagaattgcatgcctgcaaggtcgatctacgaggctcccacctgcaaactcgtgggtggaggacacatgaacgaaaacgcaattcatgggggctccgaaaaaaggtcacatgaacgaaaacgcaattcatggggctccgaaaaagggttgagaatggagaattgcaccaagcaatcactacgcatggctccaaactcgaaggtggaggacacatga

SEQ ID NO: 36617 - DNA, 807 bp, Glycine max
  Peptide Sequence Number=SeqID_128302
atgtcttctttccttgtgagggatttcggcgcacaaaattccaagactatacaaagaatccataaggcgggggaaaccccgttaaagaaagatcaagagcttagaggcattcgtaatggcatcattggggggtaccaggaatggctgaaagttcatatacgaggtttagattggctcgccaagttaaaagtcgtcagcaaagagagttttgaagcaccggaagaggacgaagaagagtgtgccgggttacgggaagagaatgcaattactgcaagagcccttgaacaagagaccaagagggctcgcaaggaagagtatggccggaacaaatttcgcggagctctatggggtagcaatagtgaactcaagttgcgaagggaagaaagagaccagtcgcgagcacatagcatggttctgaaagaggagttaattgcttgttcaaggtccaaaagaagcttgtctcagcatttatgcgagacggagaccaacatgctagctatcatcgccaagtaccaagaagagttaggtctagccatggcccacgagcatagaatcgcggatgagtatgctcaagtatatgcggaaaaagaggctagaggaagggtgatcgactctttacaccaagaggcaaccatgtggatggaccggtttgctcttaccttgaacgggagtcaagaacttccccgcttgttagccaaggccaaggcaatggcagacacctactccacccccgaagagattcatgggcttctcggctattgtcagcatatgatagacttaatggcccacataattagaaatcattag

SEQ ID NO: 36618 - DNA, 372 bp, Glycine max
  Peptide Sequence Number=SeqID_128303
atgtccttacctgtagaggactacacgtcctcaccttcagatgactacacctcctcgccttcaaagggctgcacgacctcaccttctgagggctacattcccgcacctttagaggactacacatcctcgccctcagaggactacacgtcctcgccttcagagggctgcatgccctcgccttcagagtactccatgtcctcgccttcaaaggactacacgtcctcaccatcagaggactacacgtcctcgccttcagagggctactcgccttcgccttctgaggactacacatcctcgtattcagagggctacaagccctcgcctttagaggactactcaagctgctatcaagtctctttctgtagagtctaa

SEQ ID NO: 36619 - DNA, 429 bp, Glycine max
  misc_feature (7)..(7): n is a, c, g, or t
  Peptide Sequence Number=SeqID_128304
atgcgancggagaattttgatatctatggattccttgagccacagtccattcagaggtctggacaatcacagtttgagactgaaagttacataaagagttggatgcagagttcaaaatgcgatgtctaccttggagcctacctgaatggcggacactggcagatggtggtcatcatgcccaaggaacacctagttgtctggttttgttcattgcataacaggtcagacaactaccttaaggggatcattaacagtgctttaaaaggtcttgatgatgctccacagcctaaatcaaaggctcctgctaggtggattgtcgtcaaggaagtttcaggaataactgggaagcgaccattggagccagagagattaaaggcactgcggatccagtgggcacagtattatctccgagttagagctaaaagctag

SEQ ID NO: 36620 - DNA, 564 bp, Glycine max
  Peptide Sequence Number=SeqID_128305
gctactacacgtctcgccttcaggggactacacgtcctcccctctaggggactacaggtcctgaccttcagaggactacacgtcctcgcctttagagggctacacgccctcacctttagaggactacacgtcctcgcctttaggggactatacgtcctcaccttcaaaggactacacgtcctcaccttcagaggactacagagggctacacgtcctcgccttcagaggtctacacgtccctcgcctttaggggactacacgtcctcaccttcagggactacacatcctcgccttcaaagggctacacaccctcaccttcaaagggctaacgtctcacgccttcagagggctacacgccctcgcatacactctttgccttcaggactacacgtcctcaccttcagaagactacacgacctcgccttcagaggactacacgtcctcgcctttagagggctacacgccgttaccttgagaggactacacgtcctcacctttagagggctaaacgtcctcgccttcagagggctacacacccacacctttagaggtgggatcctctag

SEQ ID NO: 36621 - DNA, 189 bp, Glycine max
  Peptide Sequence Number=SeqID_128306
atgcgtaaggagaaaataccgcatcaggcgccattcgccattcaggctgcgcaactgttgggaagggcgatcggttcgggcctcttcgctattacgccagctggcgaaagggggatgtgctgcaaggcgattaagttggttttaccattaagcgtttcccctatttcagtcttgggtgttttgctgtga

SEQ ID NO: 36622 - DNA, 468 bp, Glycine max
  Peptide Sequence Number=SeqID_128307
atggccccgaggaagcttgcctcaaagaggtccaggaaggataggggggccgaaggaactagttccgttcctgagtatgacagtcaccgctttaggagcgctgtacaccagcagcgcttcgaagccatcaagggatggtcgtcggcgatgggcatcactggttacccccatggccaagtcctgggtgaagggggtcagtggatcccgtttgatgcagatgctatcggccagctcctgggatatccgttagtgctggaagagggccaggagtgcgagtatggccagaggaggaaccggtctgatgggttcgatgaggaggccatcgcccagttgctatgcataccggggcaggattttgccccggactgctgcagggaggcgagtgcgaatcatgcgcaccaacatgaccaccctgactcagatatggatgactttgctgctcagcaacatcctgcccaccgatcataa

SEQ ID NO: 36623 - DNA, 867 bp, Glycine max
  Peptide Sequence Number=SeqID_128308
agaaaggaggggcgaattgggaccaactcttagcaagcaaagaaggagcatccatcagctggttccctcgatggaagaaaggaagaaccggagttcttattttgtgcggaggatttccaaatgttcccttgatggggacgaggggttgcatcagctacaatctcgttcttgctacaagacaacttggctaccctatgagaggggcgccactagaggatgagctcacgcctatcatttcacgaggtttcaataagaccaacatggagacacttcagaaggacaaagagctcagaggtaataacaatgggcccattggtggctaccatgagtggttgaaagcccacgtgcaaggttttgattggctcccaagtctaagaaccgctaagagggaggaagatgaggcaccggaggaagacgaagaggagaatgccaaactgagagatataaatatagctaccaccaaggctttggaacaagagaccaagagggctcgtagggaagagcacggccggaacaagttccgaggggctctatggggtagtaacaacgagcttaaaactccgaagggaggaaagggaccaatcgcggagaccaacatgttagccatcatcaacaagtaccaagaagaactaagtctagccacggcccacgagcatagggtggcggacgagtatgcccaagtgtacgcggaaaaggagactagaggaagggtgatcgactcgttacaccaagaggcaaccatgtggatggaccgatttgctcttaccttgaacgggagtcaagaacttccccgattgctagccaaggccaaagcaatggcggacacctactccgctcccgaggagatccacggacttctcagctatt

SEQ ID NO: 36624 - DNA, 273 bp, Glycine max
  Peptide Sequence Number=SeqID_128309
atgaagaacgtcgaagaacggtcgaaaaccttcgcgaaattcctctacggaaaacgttacggaaacgtttcggaagcgcctcggcttagattttcttcacggaaacaatttttccaagcaaattcgaaagagagagaacaaatagggaggtgcttgccgcccagctcgcccaggcgagcagggttgcttcctccagaagcaacaaccttctggaggaatattctggagggcccaagtgggtctggttgctatttgcacccccatttttactaa

SEQ ID NO: 36625 - DNA, 438 bp, Glycine max
  Peptide Sequence Number=SeqID_128310
atgccaatctccccctgcaaaagtatcagttggtctgtgtcgtcccgacatggggatcgcacccaagagacacccagtggacccggaaaagtccaacagggccctggggtttccagctctggttacaggcctctatcagtcctacagggtgctcgtacccccccgacaaggtcacatcatcatagggatcgcgcccaagacacccagtggacccgaagaagtccaataggggtcttggagttgccaagctctaattacgggtctctgtcagttctacggagtacctgtcacccccaagcaagggcatcaggccccctaattaatcgagcttttcatcaaagaagtactgcgtccccaggcaggcgcagggcgaaacacccacagcagcctggggatggccggcagcggggcaacaaacgcaccgccatcaccctttag

SEQ ID NO: 36626 - DNA, 291 bp, Glycine max
  Peptide Sequence Number=SeqID_128311
atggacactttctttctgccaaagtctcctcctttctcagcgaatctcctggccggaacatcctcatccagagtggggctcgcttcgttggtctcttccgcgaccaccttcacttttcctttggcatctgtgggtcacaccgccgggtcaggtgctgcgaagatgcaaccactacgggtcacaccacttaggccagtaatgttggtaactttggcagaaggagtcccctttgtgtctatcaaaggaaacaatgatcgcctcttgcaatgcttcaaagataaaccttcttga

SEQ ID NO: 36627 - DNA, 342 bp, Glycine max
  Peptide Sequence Number=SeqID_128312
atggcatccttcagccatatgcagtcccagcttcagtcacagatgcaatcacagggacttgcactgcctttggagcctaaggttggtcccttagctgctcgtgttagcacaaaggggagttatgttgatccctcaccgactgatccaaagacaggtgactcagacaaatgcaggcggcacatcgaagaaaattcttcccgcctggttgccctaggaagagtttatgagggatccacagttgttcataacatccctttgttgcatggccaagtgaaggttggtgttaaggaggttaaagatgcagaggctcccgttcctgtacccactacgaggttcaactag

SEQ ID NO: 36628 - DNA, 297 bp, Glycine max
  Peptide Sequence Number=SeqID_128313
atggtcgactcggattcaaactctgatgaggctacctcgtcttctattcttgctgagttgacgacgaaaatgactggcaccgattggcatcaagttagatggcagcaactatcccctttggtcccaggtggtcgagatactgacaacgcgattgttaaggggtggataatcaactcaatggactcttctctaatcagcaactttatccgattctccactgccaagctggtgtgggatgcaattgcgaccacgtattttgatggcagtgatacctcccaagtgtatgaccttcggtga

SEQ ID NO: 36629 - DNA, 357 bp, Glycine max
  Peptide Sequence Number=SeqID_128314
attttcaggaagaatgatagatctcctccagcacaagccgttgcagcccaggaacgcaaattgctatataatcatggaggctgcacgagttctgtaccaagtccgggattgaagagttattttgtgagtttttgggacttgagtgttttagttgatctcttttgttcagagttgatctctgtcaaacacaatctgcatgttctgaagtgtgatgtcgtgacatcctgtacgacatctgtccccagtatcagaatttcagatcaattagcagatatactcacaaaagctgtatgtagtagagacttctacaacgcacttgacaagttgggcattcgagatatctatgcaccaacttga

SEQ ID NO: 36630 - DNA, 609 bp, Glycine max
  Peptide Sequence Number=SeqID_128315
atgaagatgattcaaggcctacaagctccacatggagctacgtcaccttctaccttgaagtggacaagaaaagccacacgcctgagatcattggctactagaccagttggggcagagagacccgtggtccttgtgaatcctgtggccatgaaagccgacagtccccacaaaaagaagttaagaacatatttggggatcgtcgctcgtgataaggtggatgtcacatacgagaattggaaacaagtccttgctgcctataaggatttgatatggggggatattcagactacggaggagcgatggagacagtttaagtttgatttgacatcaaaatgggcacttgcagctgacaaggacagtgtcgatgacactgtatgcgaaaagtacaacattagcaaagagaagtggacccaattttgtcaaagtcgtagagaccattcgtgggaggccattcagaaacaaaatattgcccctcacctgttgtcacgtgggggttatgaatttctagaaaacaagttgatggaggagaagaaaaagaaacaactagaggaagctgctaaatctggaagcactgatatcgtcattgatccttcatctcccattagatga

SEQ ID NO: 36631 - DNA, 192 bp, Glycine max
  Peptide Sequence Number=SeqID_128316
atggagttgaaacgaaagataaaggagaagagaatattccaaggatatgccaaaggcattccaagaatatgccaaaggcattttaacatattccctttagatgtcacaagaatgactctagcacatgggaaaggaatatgccacaagaatattccaaaggaatattctaagaatatgccaaaggaatcttag

SEQ ID NO: 36632 - DNA, 48 bp, Glycine max
  Peptide Sequence Number=SeqID_128317
atggctcgttcttgcccaaatgcagtggtggtggaaatccagaagcca

SEQ ID NO: 36633 - DNA, 438 bp, Glycine max
  Peptide Sequence Number=SeqID_128318
atgcaatcacagggacttgcacttcctctagagcctgaggttggtccctcaactactcgtgttagcacaaaggggagttgtgttgatccctcaccgaccgatctagagatgagtgacttagacaaatgcaagttgtacatcaaagaaaatcctttctgcctggttgccctaggaagagtttatgagggatccacagttgttcacaacatccctttgttgcatggccaagtgagggttggtgttgaggaggttaaagatacagaggctcccattcttgtacccactgatgaggcagctgtgtctccagcaaagcctccagataggccgcatcctgaggtcgatgatcccctatatctgataacattgaccatcccacagcttttcttgaggcctctccaggttatgtgggatgctatcgtgtttggggtgtttaattaa

SEQ ID NO: 36634 - DNA, 291 bp, Glycine max
  Peptide Sequence Number=SeqID_128319
atggtgtctaaggagcgtcggtggtgtgcagaacaattaaacaaaagtgtgaaggccttcgatagcgctacggagagtgtcgtaacatggagaattgggtgcacaagccaaaatggtgtggtagggaaagtggttgcgagggagagagtgaagtgttgcagtgcgggaagtggatatgagggagagaaggaagtggtacgatggtggtgcaatgggggaagtggtgcttacaaaattgaaggaatattgatcttgatattgagggaatatagtggtgtgatgacaaaatga

SEQ ID NO: 36635 - DNA, 183 bp, Glycine max
  Peptide Sequence Number=SeqID_128320
atgggtgccaagcacctcacaaggaccaaagaaaggtcgcatgtcatcaagcaaagggagaaaaaggaatctcatgaagacaatacaagtggaggtttcaatctcttctccgtctctctgacgtttgagaattctatcggagcagttggaggaataactgaaggaatctcagggaaccgctag

SEQ ID NO: 36636 - DNA, 405 bp, Glycine max
  Peptide Sequence Number=SeqID_128321
atggttacaggtcagtcagcagagatgccacctatccaaataagcccagaagatcttacagggtcagagtggtggctcccattccctcaaagtgcttccaatatctacaaagaactaagcaaaatcggctttagcttttggctaatattattaaagaaactctatatcttcatcctagagaccatctatgaaagaatagatcaacaaatatatcatgagaaatattacatcaaaatacacaagaaaaaaatggaacaggggcttccaaatgcagtgtgcatggaggtgaatgaatctctctctagctcaactaatccgctctcaaacaactctatcttacaacaagaactgacaggtggagggaacgtggaaccaatcaacaagaaggacagcaggaccttgtaa

SEQ ID NO: 36637 - DNA, 385 bp, Glycine max
  Peptide Sequence Number=SeqID_128322
atggggaaacatttgattgctatcaagtgtttcaaaatactggtgcatggtatccctatgattattgatgagtctctcttcttttctctaacacaactacctagtcagggtgcaccttttgagggtacccttgttgacgactggaagtttgattactccagtcatgatgcccgccgcatggtctacattgaccaagcaaatatgaccggcagactgcttgtcgggtcattgacatttgattgtcgtatcatgcactatatcattgttagaattttgatgcctcgttcttctaatctcgctcaagcctctggacttctgaccctcatggatctcgctcaagagttcactggtgtctctcaacatacccaacttaatgcaactagag

SEQ ID NO: 36638 - DNA, 1434 bp, Glycine max
  Peptide Sequence Number=SeqID_128323
atggtgcaggcctttgagcttttgtgttctttcttcattgttcggcctagtgtgtcagtcttcttgtttttcttccaaataaaattttctggcaagattagatgggtctccttgaacagtgtgtccaagaagttgttcaagtttgactcaaacgtctttttccatttcaaggaccatttctttaaggtcctggctactgatttcgtggctgatggaatgccactgatgtttaatagggatggggagcctcgtttcccattctactggcaatctgatcacaccagagggttgacaaagcaattcttgagcaattgcaacctcactggaagtgcgtgccatcttgtctcttccttcggtgagcgatcctctcgctgccctggatggccactcctgaagcaggtcagacctgtaggtggggtcgtgccaccgcctgttgttgttccatctactggagaaaggaatcaacatgttggtgaggttggccctgttactgttgctgctgaggttgcccctagcactccttcctctattttggtaaaaaggaagagggatgatgccgctgggccattgggccacaagaagttgaaggcccctattagcctctacgccctgaggcaggctgtagggctggggcccactatatgtcgcctcacaactgtgcaagatgtgtctccggctccactggtcgtcgaggttcttgttgctgctgcgactcccgctcttttagaagccactaaggctgactcgattgtggtgtcgtcgtccaccgttacggcccttttgccaagtgtcagtgtggcgagcaccggtgctcctacgatgctgcctccttctttgtcgacttcggtggtcctccctgttattgttttggcggctatggtgtcgccttctttgtcctttcgccttcgtgtctcccttgatcatttgtacacctctagtgatgctaattcactgtgtggtgcaacttacaaaccagagcagaagaccccgataggctttgtgtcagcctttgacaggaaccttattaggttggctggggtacagaatgctactacctctagcaaagtgtttctccaaaggagtttgacaattctggagaagaatggactgcaacaccaagaggctatgcaaaagactctttggcgagtgaagcgccctaaggtggccaatgccatcgttgcttttgttgaggccgtaagggctaaccgccaattttttgctaaagttggtgctgcactggccaaattgctgggcacccagttagatggtgatgacttatttagacgctgcaagagtttgcaggctaagaagatggacctgggtggcaaagtggagagcatggcggatgagaaggatgggcttgccaagaggattgttgagttggaggcccgacttagggagtcggagtccagattggaggagtctgagctgtag

SEQ ID NO: 36639 - DNA, 231 bp, Glycine max
  Peptide Sequence Number=SeqID_128324
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggctgtctggccacgtgggaagtatggtggcgtgtggggagggttgtgatcctgtgcgtgcgggtgtcggccaagttggatga

SEQ ID NO: 36640 - DNA, 534 bp, Glycine max
  Peptide Sequence Number=SeqID_128325
atgcagactctacgcaaaaggggaagaaagacaacttccaaggttctcttccaagtgcctttttcttttcaacctcctgaattttgtttgaaggaaaacatcaacttggagatatactatattcattcagcatcgcagaagacattacggtctcatcatgaggtcattgagtttttgctcgacgtagaaattcctcgaaaaggtggtagcaagaaagcaaaggttgttggggctgtagataatcaggtctcaggttcggcatcccatgaatcaagcagaaggaaagaaatgtcattcacttcccaaatagtgaataagatgaagagtagtgatgaaaaagggactaatgaattggataataaggtgatgagtgatgaattgaagaataagatgaaagatttagagaaggagattatgccgtgggatgatgatgaaatggggctatataagatggttgacattaatgaaattgaaaatgaactgatgattcaagaactgttgaaccagccgggagaattgttgtttaatttgtga

SEQ ID NO: 36641 - DNA, 1161 bp, Glycine max
  Peptide Sequence Number=SeqID_128326
atgccacatgcttctttactccctgaggaactcattgtggaaattctgtcatgggttccggtgaaggctctcatgcaattcaggtgcatttctaagacttggaattcccttatcttacatcctacatttgtcaaattgcaccttcataggtcatccaaaaacacccacatcctagtaatgtataaggacattaacgcggaggatgataaactcgttacctgtgtcgcaccctgctcgatacgtcatttactcgagaacccatcatccacggttgacgatggttgccaccgattcaatgccaattaccttgtctctggtgtttgcaatgggttggtttgcttgcgtgattcttttgctggagatgaatttcaggaatattggtttcgatttttgaacccagccacaagggtcgtgtccatagattcagtacccttacgtctccattcgtccaattataaaacaaaatggtatcctgtgaagtgtgctcttgggtatgatgatttgagtgaaacttacaaggtggtcgtagtcctttctgatattaaactacagaaaatggaggtgagagttcactgtttgggtgacacttgttggagaaagattttaacttgccttgattttcactttctgcagcagtgcgatggacagtttgtgaatggcaccgttaactggttagcacttcgaaagttgagttcagattatatttggagatatgaattagtaattttttcgtacgatatgaagaatgagacatacagatatttgttgaagcctgatggtctgtctgaagtctcttttcctgagcctcgtcttggggttttgaagggttacctctgtctttcttgtgatcatgggagaacccattttgttgtttggctaatgagggaatttggaggtgaaaaatcttggactcaattgttgaacgtaagttatgagcatcttcaacttgatcaatttccatttccatctatttcaatgatacctttgtgcatgtctgaagatgaagatgtcatgttgctggcaagctatggacgtaaggaatttgttctggttaataagagagataacagaatggacgatattggaggtttcgatggtaaatattattggtcgtactcctatgattatgttccaagcttggttttgccatatcgaaattaa

SEQ ID NO: 36642 - DNA, 1152 bp, Glycine max
  Peptide Sequence Number=SeqID_128327
atgacgatggacagagagaaggagagagagatagagctggagagtgcaatgtacacgaattgcttgttgttgggtctggatccggcgatcatcggagtcggagcctccaacgcgactcctcgggtcgggcatttccgtcactcgaaccctaaattgggggaacagcttctctacttcatcctttcctctctcagaggcccaattcaatccgcaaaagatttcgataaggtctggccgattttcgattccgcgcagtcgcgtgattttcgtaaggttgttcaggggattattagcgagcttgagtcgcagggcgcacttccgaggagcaattcgagggtttcttcacttgctacgtgctgtggacctaggtttgttgagcttctatggcaactttctttgcatgctttacgagaggttcatcgacggacatttactgctgacatatcttctaacccattgcctgcgccattgactgatgtagccttctcacatgcggctactctacttccagttacaaaggcaagaatagcgcttgaaagaagaaagtttcttaaaaatgcagaaatggctgtacagcggcaggctatgtggtctaatttggctcatgaaatgactgctgaatttcgtggtttatgtgctgaagaggcttatttgcaacaagaattggaaaaactgcatgacttgaggaataaagtgaagttggaaggagagctctgggatgatcttgtatctagttcaagtcaaaattcccatttagtttcaaaggctactcggctatgggagtctttattagctcgtaaaagtcaacatgaagttcttgcatctggtcctattgaggacttgatagctcatcgagaacataggtatcgaatctctggatcatctttgcttgcagcaatggaccagagttcacaagctccttattcagatgtattatctgctcagtctggggatttgcctgcaatggataacaaagaagagaatgatggatcacatttcagcaatgagacattgacaagattggatgacagaactggaagagcccaccaaactgttgatgtagctgaggttatacggcgatggacccatgccttgcaacgtatccacaaacaatcacttcatttggtatgctctttgcaagcttttctttaa

SEQ ID NO: 36643 - DNA, 279 bp, Glycine max
  Peptide Sequence Number=SeqID_128328
atggactataaagcgaagatacacaacatgagggcgaccagagccaccaataatcgcaccattaataaggtgatggattctctttatagcttttccgtacatgtcacaactagagttgttgaatcttatcattgcccatcccaagaggagtatccaacctatgtggcatggccagcaggctctgggacaatgtcaatgttggccaggttggaagagaagaagctatggaggaggacgtcatgcatgatggcaatggagatgagggccattgagccctaa

SEQ ID NO: 36644 - DNA, 330 bp, Glycine max
  Peptide Sequence Number=SeqID_128329
atgaggcatctcaaggtgcctaaacaaagcaccagtgccctgatggctatcacaagaccttacattcatttgaatccctatgaagggtggggaaaaagaagccacattaaaggccttgtaagttgtccttgtgggggccttggtgaccgccaacctctatacaatgacagtgttggtgaatggaacctacctccttataaggcacacaatgccttaccacatcatccttacaaaccttgtaaagagcagctacaaccaacaagtgttattcagggaatctcttgtattgctcaatcatcaacaagttgtctaatagagggatcaaggtga

SEQ ID NO: 36645 - DNA, 174 bp, Glycine max
  Peptide Sequence Number=SeqID_128330
atggagaatattccagattcgggagttatctttacgtttgaggaagggctcttgctcctacgtaccctccatcgaagaagaaatcagacctacgtagctctttcaaaaggggcgaatcaagtgattcttttttacttggaatgtggtcatttaaggccttggaccttaaaatga

SEQ ID NO: 36646 - DNA, 156 bp, Glycine max
  Peptide Sequence Number=SeqID_128331
atggattcctatggtgaagcaaaggactccattgctgaagaagatccaaggcctacaagctccatatggagctacatcatgcggtatcaagagcatcttcttctaggtgatgttcttttgcttcctctaccattttgttcggtcaattcactttaa

SEQ ID NO: 36647 - DNA, 312 bp, Glycine max
  Peptide Sequence Number=SeqID_128332
atgctccaaccatatgggatcagcataggcttaaaggagcactcaaacccggtgacccccaaggcctacactccgaagagtccgtcagggcttctccctcctgattcagctctggatttctacgggaaagaaaaatgctacaatgcgaggggtatttctcttagctcagacgtgatatcggaattcccaacggtgagaatactcggaaatgggtttgatggcctacgggaaaaagagaggattttggtagaggaagagagaaaaaacgaaattggtaggcagaggaggctgagaagtcagtctgaaaactga

SEQ ID NO: 36648 - DNA, 483 bp, Glycine max
  Peptide Sequence Number=SeqID_128333
atgtgcgcctttcatgaaggtttacaaattgattgggcacaccttgttagatatcacatgcataaggcattgcgattgaatgccccattgccttatcctcatcttgttacctttttccttcaacacttcaacatccctcttgattctgaaccctatgttccaatcaagagatcatttcttataggcgcttcagtcatagcatcctttggttatattaaggagcatgatggctcttggataaagaagggtgctagaaatgttggtgaagaaggacatgagggagaagattcatctcttctttcgaagattttggaaaagtttgatggtcttcaaacctttgttggtgaaaggtttgacactttggaattgcaagtggatatgcgcttcaatgaaatggagtcaagaatgacaaaggttgaagaagatgtatcttacattcgttcaagcttcgatcttccaccaccaccgccaccatcatcttag

SEQ ID NO: 36649 - DNA, 771 bp, Glycine max
  Peptide Sequence Number=SeqID_128334
atgcctaaaactcctaagactttgagagggtttttggaacttacagccaagttgctggggtatgagtttgacattgtgtataaggtgggggcttcaaacaaggttgttgatgctctatctagaagagatgaagacaaagaattgcagggcatttctagacctttctggaaagacataacaaaaattaatgaagaagttcagaaggatcccgcgttggctaaaatccgagaagaattgaaggataatctagattcacaccctcagtacaccctggagtgtgacatattatacttcagagggagctaccagaatgttgcacactgcacaccttttgaggtagtatatggtaaaccaccaccctcccttgctaaatttgtacttaggaaaactctcgtagaagttgttgttcaagatttaatggatagagatgaaccgttgaaacaattaaagttccatatcagacctcacagacaaacctttatgcctaccaagctacatcctaagctctcagcaagatactatgggccttatttggttcttcaacaaaaatccctcaagttttggtgcattggcaaggcaaactttcgaaagaagctacctaggatgtttctatcatcagaaatcagtttcccaatttcaaccttgaggacaaggttgtttcggaatgaagagatattgttagaattgagtccgagcaacaatctgaagcaagaaagggtttgtaggaaaaggaaagggtcaaaaagttgtaacaaccacttagagggatag

SEQ ID NO: 36650 - DNA, 372 bp, Glycine max
  Peptide Sequence Number=SeqID_128335
atgaggttcttcatggccatccgtctattcatctgttcccccgatacaaagttcaagatcatcacaggatccaaacacaaacagcaaaccgggacaagcgtatgcaatagttatgctcagactcaagcctatatgcaatgtggtaccatgtcagtgaaaaacctcgtcgggcacctaggagtacatgacaagacaaaccacacaataggagaccagtcagggtcacagtgttttgcgagaatgttccaaccatatgggatcaacataggcttaaaggagcactcaaaccgtgtgacccccaaggcctacactccgaagagtccgtcaggggctctccctcctgattcaggtccaacccagaaaatattttag

SEQ ID NO: 36651 - DNA, 2061 bp, Glycine max
  Peptide Sequence Number=SeqID_128336
atgcctcctacatactttcctcttcgttgggagagcactggggaccagtggtggtatgcatcaccgatagattgggctgctgctaatggccactatgacttggttcgtgagctgctcagaatggatagtaatcatcttttcaagctcacttccttgcgccgaatccgtcgtctagaagtggtatgggatgatgaagaacagttcaatgatattgcgaagtttcgtagtgaggtggcacagaagctgcttcttgaatctgagtccaagagagggaagaactctctcatccgtgccggctacggtggatggctaatgtacactgctgcctcggcgggagacttgggttttgttcaagtccttcttgagaggaaccctttgctggtttttggtgagggagagtatggtgttactgacatactttatgctgctgcaaggagcaagaattgtgaggtttttaggctgctatttgattttgctgtttcaccaaggtttttgagtggcaaaggtgggataatggaggagaatgttggggacattccttctgtttacaggtgggaattgaccaatagggctgttcatgctgctgctagaggaggaaatctgaagattttggaggagcttcttgccaattgctctgatgttttggcttatagagatgctgatggatctactgttttacatgcagctgctggcagagggcaagttgaggtaattaaatatcttacatcatcctttgacatgatcaactccacagaccatcagggtaacactgctttgcatgtggcttcttccaggggccaattaccaacagctgaagctctagtctcagcatttccctcacttatgtctctgagaaacaactctggagaaacttttctccacagggctgtgtccggttttaaatctcatgcattcagaagattggacaagcaggttgaacttttgagaaacatgctgagtgggaagaactttcatgtggcagacattatcaatgtcaagaacaatgatagaagaactgctcttcacatggccatcataggcaacattcacactgatcttgtgcagctcctgatgactgccccatctataaatgtgaatatatgtgatgttgatggcatgaccccactagattaccttaggcaacaccccaaatctgcatcatcagatatactaatcaaaaagttgatctcagctgggggaatgtttggctgccaaggccatagttcaagaaaagcaatagcatcacacttgagaatgcaaagcattggaagcagtccagggacatcattcagagtctcagacactgagatgtttttgtacactggcattgagaatgtgtcagatgctagtggtgatcatggaagtggaggaatgagttcatcttcatctgaacacattccatacgatctgaatgccactgagaatcgcgtaccaatcgcagccaaaaggcctagtactgtgaaccatgcagcagcaagtttgaagagagttcttctgtggcctagggtgaaggacaagaaatctgaagggttcaaaaagtcttctacaacagatgagggttcagtggactcatgccggaagcggaataacagctttgatgaaactccaaccccacttagacaaagattttctaggccatcttcacttcccaacaacaaaagaactctttctgtcaggagtcagcaatcaagtccaaatgccaagaagaggtttgcttcaggaccagtgcatggagtcatacaatccatgccacatgcaaatgtttctggcagatcaaggtctagttccttttcaaagtcgtcaatttcttcacctagatcaatagacaagcaaaagggcattttcattgacaatgacattgccggaccatcttgctcaagtcaaccatcaccaccacctgatgatgatgaatcaccaaagttggtaaagagaacttctgttggaaggaagttgagggaccattatttctgttttggtgcacctggcattaatgtcaaaaactcagttcacaggcagcaagaaagccagagttacaaggctcatgttgttgcagtggcttaa

SEQ ID NO: 36652 - DNA, 357 bp, Glycine max
  Peptide Sequence Number=SeqID_128337
atggaagcacagacacgaactccacaaacgcgaactcgacaatgtggttgcagtcacggaagcgcagcccagtttgtgacaaacacgaactcaggtagaaggagaaacaacaataacgccctgggagtaccctttccgggactctttcctttcctacttttcttcgacctgcgaaacaaagacgatctccacaaacacgatctccacaatgtggttgcagtcatggaagcgcaggcgactttgacacaaagacgatctcaggcagaaggagaaagaagaagaacgatagggttcaagcgcgcgggttgtgcaatttcagaagttcaatatataatgataacaacatcggttttttaa

SEQ ID NO: 36653 - DNA, 207 bp, Glycine max
  Peptide Sequence Number=SeqID_128338
atgaggtattttttgaagaggccagtgagtttggccggggggttgagagagtggaagattgtatacaaggatgaattgggcatgttttatttggtggggttttgtgaaaaagaaaagagcaaagcgcgaaggaataaagtgagaacaatggaagatgagggagggagcggtgggaggggggatcaacggtttttatggggttggtga

SEQ ID NO: 36654 - DNA, 495 bp, Glycine max
  Peptide Sequence Number=SeqID_128339
atgggagaaaattccaaagccacaatcgaaaagtcacaatggaaaatggaaagcgtgaaacaatggaaaccgtggagagcaaatccaaaggggagagaaatcaaaagccacaatggaaaatggaaaaatgcaaagcgtgaaacaatggagaccgtggagacccaattggaagtcgaaaaacacaaacaaatcattttaaatccaagaggtagatcattggggagaaagaaacaagttggattcaacgtgaagaagagaaaaaagcttctcaaatttcttttgatgagaaagcattggttcaagcacatagttatgttcttttcaatagcaacaatgttgacccctttcaaaaaatcaaagaataagttcaagattgaatcaagaacatttcaaggttcaagaggaaatttgatttcaagaatcaagaatcaagattcaaggttcaagcttccaagaatcaagatcaagattcaagagtcaagattcaagaattaa

SEQ ID NO: 36655 - DNA, 279 bp, Glycine max
  Peptide Sequence Number=SeqID_128340
atggaagaggacgatgacaatttgtattttggcgatgatgatgacgactcattgtttttctccctcattgacaagcctaacaagaacatggccttgctcgatgattacgaggccaaggagcttcactttgattatgaccttgaccatcgaagcaatttgtgttttgcattgaaaggggagaagaaaaggggagggggtaactggagaagcgtagctaaggaaggcagcgaggagggcaatgtttgtattgatgtgaaagagatggagaaggaaggatga

SEQ ID NO: 36656 - DNA, 390 bp, Glycine max
  Peptide Sequence Number=SeqID_128341
atgttgatccgcttacggatcaagttgatccggaaccttccctgtcaacacccatggtggagacgaagacgaagacgaagaggaacttacctcaacaatgccgacgcgaggacacagcaacaccactgtcaacacccacgaagaagaagacgaacaaaggtcacgaagaagacgaagaacacgcgattggaaggtcacgaagaagacgagcgaaggtcacgaagaagacgaagaagaagatcgtgctcaagatttttcgagaggaagaagaaggaagaacgaaggtcacgaagaagcaggaatggcgaggaagaagcaggaatggcgaggaagaagcagaagaagcaaaaatggcgaagaacgcagaagaagcagaaatggcggaaatga

SEQ ID NO: 36657 - DNA, 246 bp, Glycine max
  Peptide Sequence Number=SeqID_128342
atggggttagacttcctcactagacttttcaccctttacttcatcttcacttccactagaagaataggaagaagtagtctcctcttgaccactataaatgtcttgacacctcatagtcatgagtgtggtgttcccgtgtcctctagcatgaggttcttcatagtcatccacctattcatctgctcccccgaacacaaagttcaagatcatcacaggatccaaacacaaacagcaagctgggagtga

SEQ ID NO: 36658 - DNA, 585 bp, Glycine max
  Peptide Sequence Number=SeqID_128343
atgacgtctgaggcagcaaaggaaattgtagatagaattgatattctgactgttgccattgggcgaccagaacaccctggttgtgtccgtattactagagccagcgtcacaatcaaacaatactttggagcagcttcaaggagctcccgcacgtctgtgtccatggctcctgaagacctggagcaactgacacaaaaaatcagggaccagctggaggagtggataacagaaaaaggactcgcactgcctcttgagcttgaggttggtccttctgctgctcgtgtcagcacaaagaaaagttgtgtcgatccctcaaggcaagacctagacacgggtgactcagagaaatgtgggttgtatgtcaatgacaatcgtccatgcctggttgcccttggaagagtttatgaggggtcgaccaccgtccacaacatccctttgggcaattatcaagtcaagatcggtgttgaggaagatgaacagggagctaagggactaacgaaacttgcagataggtcggatcctgatgtcaatcccctatacctgatgacattaaccatcctgcagcttttcctcaagcctttgtag

SEQ ID NO: 36659 - DNA, 708 bp, Glycine max
  Peptide Sequence Number=SeqID_128344
atgtcgaggaacctcaagggattaggtggtctggacaacatctattatacaactctcgtcaagaagctcatatgggatcaaggagtatatcatgtattcaacaagatggatgaggattccaagcacaccttgatagttaagggttcagtggttgctaaacaacaaaagtttagcaagactaacctaaaagctatgaaggatcattggattaaaagaaggcatgagtttgctacgtccactcttgcgcgtccactagcagtgaacctagtcatacaaaggttgaaaaacctaagggagattgatgatgctgatgaagggttggcacgagtggccctccaaaagagggaaattattgcacctgaagcacctgttgctaagaaagcaaagaaatctcaaccagtcgttgaaccaagggcatctgtcctccttctgccattccatgatgcatcaagacgaggaaacaaggaagatccaacctcttcctcaacagatagtgagtccattgatgacactcttatctcacccctctataattctataccattcattaaaccatgtccacctccttctactctacacctgggtgactccctctcaagcttggcgcaacatgcaaaagctaaaggacaagaagaactcccaagcttgcatctcctaggagttgttcagaaagcaaagaagggacccaagaccctttgcaagaagtag

SEQ ID NO: 36660 - DNA, 429 bp, Glycine max
  Peptide Sequence Number=SeqID_128345
atggccgatgggttcaacgaggaggccattgcccagctattatgcaccccggggcaggatttcgcccggaccgctgtagggaggcggatgcggatcatgcgcaccagcatgaccaccttgacccagatgtggatgacattgctgctcagcaatgtcttgcctagtgatcataactccgatctccctctgccgaagtgtcagctggtgtatgccacccaccaggcaccctctagactggataagtctaacagggccctggggtttccggcattgatcacgggcctctgccagtcattcggggttcccgtcactcctagtaaggtgatccgaccgccgatcacccgggccttcattgagaagtattacacgcttaggcaggtgcagggtgatgcacctcaggccgcagacgcaccaccaccacctcattag

SEQ ID NO: 36661 - DNA, 594 bp, Glycine max
  Peptide Sequence Number=SeqID_128346
atgcataaccaaacattgaggggtcgtattttggagacaattttgagtgcaaggttcttcttgtttcaatatggtgttgtgtataagttgcgtcatactggaaacaatacatcacttgcggtggagcttattattgtagacacaagcaagtttgatgatgcaacgactctagaatctaaacagactaataaggaagacgagtctgaactttacaagccaaaagtttctacctggggtgtctttcgtagacctggcaatctttcaaaaacatttagtggtggaagagttatatgtccaggggaggttctagaaagcaaagaagaaaagattgttaaagaagcacgcacaaagcagctacttgctgcctacaacaagaaaactggattaaatgttgatccaaagttgaaatttgagtacgaggaggctgaaaaggctcctacagtttatgtggttggagacttacttgttgatgttggcaacaacaactacttgagtctctccattgaaaaggaatttttacaacaacaacaacaacaacaacaacgccttatcccactaagtggggtcggctacatggatcaacttccgccataa

SEQ ID NO: 36662 - DNA, 138 bp, Glycine max
  Peptide Sequence Number=SeqID_128347
atggtgacagagtttcagtgtcgtgagaggttgcaaatgagagtgcgaaagctttcaagtgagagtgagaggtttcaaataacatcgatttttggtaaaacagctggtaacacgagtttgttaatattgattttttaa

SEQ ID NO: 36663 - DNA, 972 bp, Glycine max
  Peptide Sequence Number=SeqID_128348
atggtcattgaccaatccctcttctatgatttgacccaattgcctagtgacaatgtaccatttgaaggtgcactggacgatgattggaagtttgatttttctgtacatgatgcccgtcggttggtttgcaccaaccaagcggatatgaccggaaggctgcttgtcggttcattggctcttgaaagccatatccttcactatcttatagttcacatcttactccaaagatcttcaaaccttgcacaggtttctgaagaagatcttataggcatgtgggcctttcataccggccgacaaattgattgggcacatttagtccggtatcgcatgcataaggcattgcgattaaatgctcatttaccatatccatatttagttactcttttccttcaacattttaacatccctcttgattctgaaccttatgttccaattaagagatctttcttgatcggtgctgctgtggttgcatcctttggttaccgcaaagagcgtgatggctcttgggtaaaaaagggtactcaaccaaatgatgatgaagggcaattaccagttgaaggggactcttctctccttcaaagtattttggacaggtttgatggactccaaacctatgttggtgaaaggtttgatgctttggaacaacaagtggacatgcgatttgatgcaatggactcaaggatcacaaaggttgaagatgtcaccatcattcgcgactgccttgatttacctccaccaccaccatcagattgtcatcatcaaaaagggggagattgtggaagcaatgtcttccaaggttattttgatgatgccaaagaatcaagagttaagcaaattccaaagattcaagaatctagtttcaagaatcaagattcaagaacaatgaagatcaagattcaagactcaagattcaagaatcaagagaagatgatcaagataagtactaaaaaagctttccaaaacattgagtag

SEQ ID NO: 36664 - DNA, 204 bp, Glycine max
  Peptide Sequence Number=SeqID_128349
atggctagaagactccaggaagattgggccaaggatgcaggagaagaccctagggttctcatgagccttaagtgtctccaatcacctttcatccttctccattttgctgccattcatcttcaagaagcaaaggactccattgatgaagaagatccaaggcctacaagctctacatggagccacattaattctctcaggagatag

SEQ ID NO: 36665 - DNA, 315 bp, Glycine max
  Peptide Sequence Number=SeqID_128350
atgaatcaagttctttctgatttggaagcaaaaattaacacaacggttcctacgtccaatatagctcttgctgaagaaaagagtctctttgattggaattatgttaaaatctatacaatttcaggtaacacacgcgatcccacttccgtgtttcgaaagaaaagaaaagaagaagaagtgaaccgcctaggatcttcttcatcaatggattcctttgcttcttggaagatgaatggcagcagaatggagaaggaagagagagaggagacaccacttcaaggagaagatgagtctaaaagaagctcaccaccatag

SEQ ID NO: 36666 - DNA, 279 bp, Glycine max
  Peptide Sequence Number=SeqID_128351
atggctttctcaaacaacaagtggtggagatggtggttgttgcatgtcgagaaaaacatgttgaagcatattcatgatagggtcgaaggcaatttttatctgcatggtggatcttcagtcttaacgtccacaaaaatggtagttatggaagatattgatgcaatcctccctaggaagggaccagtcactagaaccatgagcaagaggctccaagaagattgggctagagttgctgaagaaggccctagggttctcatgaacctcagggtagatttctga

SEQ ID NO: 36667 - DNA, 807 bp, Glycine max
  Peptide Sequence Number=SeqID_128352
atgcctcatgcttctttactccctgaggaactcattgtggaaattctgtcatgggttccggtgaaggctctcatgcaattcaggacattaacgcggaggatgataaactcgttacctgtgtcgcatcctgctcgatacgtcatttactcgagaacccatcatccacggttgacgatggttgccactgattcaatgccaattaccttgtctctggtgtttgcaatgggttggtttgcttgcgtgattcttttgctggggatgaatttcaggaatattggtttcgattttggaacccagccacaaggtgaaacttacaaggtggtcgtagtcctttctgatattaaatcacagagaatggagcagtgcgatggacagtttgtgaatggcaccaatgagacatacagatatttgttgaagcctgatggtctgtctgaagtctcttttcctgagcctcgtcttggggttttgaagggttacctctgtctttcttgtgatcatgggagaacccattttgttgtttggctaatgagggaatttggagttgaaaaatcttggactcaattgttgaacgtaagttatgagcatcttcaacttgatcaattttcatttccatctactttaatgatacctttgttcatgtctgaagatgaagatgtcatgttgctggcaagctatgggcgtaaggaatttgttctggttaataagagagataacagaatggacgatattggaggtttcgatggtaaatattattggccgtactcctatgattatgttccaagcttggttttgccatatcgaaattaa

SEQ ID NO: 36668 - DNA, 552 bp, Glycine max
  Peptide Sequence Number=SeqID_128353
atgacttccatagagcaacaacttaatcttgtggtggtcgcacaaccaattaatgctattaaggatgctgatatcctcgaaagactttggaaagacttcgaagaccaactatggaaagccaagacgatagcatcagaacgtctccgacttggtggagattcatcagttgcgcctacattcccaatgatagagacaaacgcatcagataacactgatgaaacctctagaaaaactctacgcaaaaggggaagaaagacaacttccaaggttctcttccaagtgcctttttcttttcaacctcctgaattttgtttgaaggaaaacatcaacctggagatagtattattaaatcgattcaagaatgaatcaagttgggggaaccacgttcccaaattttctgtagaagaaagattaaaaaattgggtcatcgaaaaaagggaacgcatgcaaagcaaggacaaagaaaaacctgacgctaaaatgcaagattattactatattcattcagcatcgcagaagacatttagagaaggagattatgtcgtgggatga

SEQ ID NO: 36669 - DNA, 90 bp, Glycine max
  Peptide Sequence Number=SeqID_128354
atggagggtcgattgggaactgaggatctaatgaagaataaggagaaagtgaagccacgagaattgctctgggctcttgggccttactga

SEQ ID NO: 36670 - DNA, 549 bp, Glycine max
  Peptide Sequence Number=SeqID_128355
atggcttccaaatcggcatttagtatagactcacgggtgcttaacaaatatcgaactaggcttcttggtgataatgtgcaagcttttttggttgtggagagactgagagagatgagcttgacgaggaagccatcttgcgaagctttggatgagattttgagagattgtgaggagtttaatccttacaatcattatgaagaagaaagagctcctgatcttgaaagtgtgtttaaagaattcatggcatatcatgctagctctaaagctaatcaaaattcaatgcaaaatcatgagattcattttggcaagagctattctttagaagatcatcaaagggaaccagagttacaaacctaccatcaaaaggaggcagaaagaggtttcaatatggacaatttgttaatgcaattcaaggatacaattgaatcaattcaacgagcatttaaaagtacagaaattcaggttggtaagctggtagaagaagtgactcaagctgtgggcagaagagaagaagaatttgtagaggttgaagctcaagaggaaagccct

SEQ ID NO: 36671 - DNA, 591 bp, Glycine max
  Peptide Sequence Number=SeqID_128356
atggggcaaaacacaccaaaagattatgatgatggatggctcaaattctcacaaagtcccacgagtcaactcggtagtaaactcgtttttgaccagactcggtggactcggagtgaactcgtgcaaactcgcgagtctggtccaagttgcgcaagtttagttgaaaaaaaaatcccacgaaatggcgtcgtttttgctgtgactggtttagggatttgcttcccttcgtgcttgctcatgcattttttctttctccctcaaaacctcgcactgtcacacagtcaccctcaccccataggagagttggaggagttgctcagagccttagagttagaggacaaccttgttctgttggaagccgcaacatgtgacagcagacgacgtgcaacgcggcggcttgcggtagtccacgacggtagcagacaaccagacaaccttgttcatttagaagccgcgagtcccaactcccacgagcacaaggtccatgacgagcacaacccacgaaagaggatcgaggttagccacaagctaaaccaagacctctataagctgctgaatccaaatttggatctcctgcttcatatattttga

SEQ ID NO: 36672 - DNA, 228 bp, Glycine max
  Peptide Sequence Number=SeqID_128357
atggcggttccaaagtcagaaaagatgcaaagacaagatgaaactaacaagaaacaagcgtataaccatgtttcaacgaagaacaacaacggtttgcggtggctaatggtggctgtgggtgatggagaaagttattgggacattagaaatggctttggaagaaaaaaaggagaagaaatggcgttttgcctaagctacacgaaagcaaagactgaaatgcttaaataa

SEQ ID NO: 36673 - DNA, 537 bp, Glycine max
  Peptide Sequence Number=SeqID_128358
atgggcataagagaagaagaatttgtagaggttgaagctcaagagggaagccttgtaaaagagcatgatttagaagaagaaaggcatgaagaccatgaggttccaattattctgggacaaccctgtctgtcaattgctagttgtgtattaggcatgggtaaaggtaagttggaactaaatgtagaggatcagaagatctcctttgacttatttgaagcaatgaaacactcagatgatagtgaagcctgttttgaagaagaaacattggagcaggagatagaattaacagcctcagccatggtattacagtctcctctggaggaagaattcgataatgtgacaaaatgcatagttagtgaaaatgaaggagaggagctagcttctattgaagagctgtatgatccacaatctcaggaccttgacaaaacatgggtggtgaatggtcaacgattgaaactgtaccatggtggagagtttgaaaaggcaaacaccatcttaaatttgatatcacccattgaggtatatgcgtcaagctaa

SEQ ID NO: 36674 - DNA, 423 bp, Glycine max
  Peptide Sequence Number=SeqID_128359
agcttgcaagtgatagctcctccaaggtccattctatcggtagagcagttcattgagaaggtatcttggcctggaaccttgccttttgttgtgagagaaggtgagggtcccaatcctcaggcaggcagggcacaggtaaggcaggaggctgctacttccgagagatcaccacagatttcaccagatccaccctctccagtggtggatcaatcttttcttcagcagccagcaaaccttcctacaccagtgcttgatcttccaacagacccgtctacaccattacttgatcttccagaggacccttccacaccagtcctgggactgactaccactcctctagccactcctgtgctacatttggcagatgaggagggcactcaggatcaggagacccagcaggatgaccagtcacaggagttttag

SEQ ID NO: 36675 - DNA, 1176 bp, Glycine max
  Peptide Sequence Number=SeqID_128360
atgaccagaaggcttcttgctggttcattggcttttgaaagccgcatccttcattatctcattgtgcgtatcttgcttccaagatcttcaaaccttgcccagcgattaaatgctccattgccatatccacacttagtcactctcttccttcaacactttaacatccctgttgattttgaaccttatgttccaatcaagagatccttcttaattggtgccgctgtgattgcatcttttggttaccgtaaagagcatgatggctcttgggtgaaaaaaggtgcacaacccattgatgaagaaggacacttaccagttggagaagattccactcttcttcaaaagattttggacaggtttgatggtcttcaaacctttgttggtgaaaggtttgatgctctggagttacaaggttcatctacttgggttgttgtaactgagaacaagagagggtacatctcttgtggatcagttcaagtggagggtacatccacttggttgttcaaagagaacaagggagggtacatcccttgtggatctttgcttaacctggatgatcccaccttagatgctcctgcttcttcttctgctccacctgctttagctccaccaccaccaactccaatcccagcacccttcggcccctctactcagagcatagaccttctagtgtcgatgttgcagagccttcaccatggcttatgcctgccttctcctgtggggggaggtgaggctcctacaacccaggagccacagccagagctagaggtgacacccgaggcagaggctcaggagacaccggaggacaccccttctaccacacccgccaaggacacagattatgcagctgatatggcggcgacacagatctcctgggatccctggcctactacagccacccgcgctggaaacccctccaactcggcacccctccagcaaaggacatctgctcagccacaaagggctccagctcaaagctcggctcccatgcaacctcgccctatcggtggttccaatcctagcacgggtgcaaattcggggaggaaccctctagtgaagaagcttccagagttcgccccgatttcggtgtcgtacgagggcttgttgccatctttgattgctaaccaaatggcagtagtgacccctgaaaggatttaccagtctcctttccctcagtag

SEQ ID NO: 36676 - DNA, 123 bp, Glycine max
  Peptide Sequence Number=SeqID_128361
atgatgatttggaaacaacgtgcaaaattagtcgtggctacagctaggtgggatgacgttcctaaaggaaagctctacaaggttccggaacttcaacaaacattatcgacaataacgaagtaa

SEQ ID NO: 36677 - DNA, 333 bp, Glycine max
  Peptide Sequence Number=SeqID_128362
atgggtaaagcagaggaggtacaagggaagatgaaggccgacatggaggccatgaaagagaaaatggccacgatgatggccatgatgaacatgaggaagataatggaagccaatgcggttacatttgccgctaccagcactgttgctaaggtgaacccgatgcccccatttggcctcaaccaaatgaatcatccaaccttagatatgacacatgaaattccccaccacaatctagtcgacttcgagccttgcctcggatatgccacggaagggcaagcagttggtggtatacccctacaaaaccctttggaaggccctcagtatcacccataa

SEQ ID NO: 36678 - DNA, 570 bp, Glycine max
  Peptide Sequence Number=SeqID_128363
atgggagaaatagaggaggtgcaagagtggatgaaggccgacatggaggccatgaaagagcaaatggccacaatgttggaggccatgatgagcatggagaagataatgaaggtcaatgcaactgcagttgccactacaagggccattgctgagaacaagcataccttcccgccatatggcttgcctctcaactatataccaccaaatgtggcacacactcccgatgagaatgtcaataactccactcctatactcattgagatccaacaacctcaatctaatcatgcacatgtctctcaacccatgggggagacacatgagttggtgatgaacccttgccaaacactttggagggccctcaatttttgcccacaaccacaaccattgcatttcacaacgggaagaatccctcctgctatggtggaaaaaggaaagttggatcatttagaggaaaggctcaaggccattgaaagaggcagagaatatgcctttgctaacctagaagagttgttcctagtatccaacgtcgtaatccctcctaagttcaaggtgccagactttgacaagtag

SEQ ID NO: 36679 - DNA, 586 bp, Glycine max
  Peptide Sequence Number=SeqID_128364
atgagctcgcgcaccagtctaaaggagttagggcagttaatgggtcaactccagcgacaagcttttcgcaaagcttacgataaaatctgggacttagccatggtagaagtctccacagaggccattgcctcccttgcccaatattatgatcagccgatgaggttcttcacctttggggacttccagctatcacctatggtagaagaatttgaagagatcctaggatgccctctagggggaaggaaaccctacctcttcttagggttctatccctcattagctagaatttccaagatagtccaaatctcagcgcaagaattagaccataggaagcaagtcaaaaatagggtggttggaataccgagaaaatatttggaggcaaaagcaaaaatcttggcaagtaaaggcgaatgggccccgttcatagacattctcgcgttgttgatctttagaggagtcctctttccaaatgtggatgggttggtggacctagcaacaatcgacgcctttctcgcctatcataaccacaagaaaggcccggttgtcgctatgttagccgacctatatgacaccttcgaccaacgat

SEQ ID NO: 36680 - DNA, 114 bp, Glycine max
  Peptide Sequence Number=SeqID_128365
atggaaggaaaacttgcacacactgtggcaagatcggacacacagtggacgtttgctatcgtaaacacggatatccgccgggttataaaccatatcccacctcctggattctag

SEQ ID NO: 36681 - DNA, 595 bp, Glycine max
  Peptide Sequence Number=SeqID_128366
atggtagaaataaatcaagatgagagggaaaaaataagggaagaagaaagaagaaaaatactaaaagagttgagaaaagaaaagtatgccacctatggtagtcatgactcttgtaagagcctaagtgaagaacttcgtgactattatgaaggaaggcataggtcacatcttagacctcactcccataggatagaaaaggaaaaaaagcttcaagaggctaacattaacctctcatacttccatgggaaggacaatgtagaggcttacttagattgggaaataagggtagagcaaaaacttaaaagaaagtctactttaaaatcttatggctctcactcttatccaaagaaagaccaaggtctaggaatcttagggacagcaccttctaaccccaaagatgataaggggaagacaatagaaaagcaaccccctaaggctagtatgcaagagaagactagttctataaagtgctttaaatgtcttggaagaggacacattacttctcaatgccccaccaagaaaaccatgattatgaggggccaagacatttatagtagccaagatgaggctactactttaccttcctctagtgaaa

SEQ ID NO: 36682 - DNA, 267 bp, Glycine max
  Peptide Sequence Number=SeqID_128367
atgaattgcgttttcgttcatgcgtcctccaccctcgagtttggagtgatgcgtagtgattgcttagtgcaattctccattctcaacccctcttttcggagccccatgaattgcgttttcgttcatgcgtcctccacccacgagtttggagccatgcgtagtgattgcttagtgcaattctccattctctaccttttttcggagccccatgacattgcgttttcagttcatgcatcctccacccaacgagtttggagccatgcgtag

SEQ ID NO: 36683 - DNA, 258 bp, Glycine max
  Peptide Sequence Number=SeqID_128368
gcggccaaccaccaggcacatgtgcagacccatgattgtctgtaccagatgagcctcagcatgcagagccagggcttcgcttctttgtcatgccctactccagaccagttcagggtagaggttgcatggcccggggattggcccgaggctcaagcaggagaggcacccccggaagttcccagtgatggagaagaggcccatgaggacgagaagatggccgatttgcttgacttcttgggagggagtggagctacatga

SEQ ID NO: 36684 - DNA, 384 bp, Glycine max
  Peptide Sequence Number=SeqID_128369
atggcttctccaccagcctcacctcctcttcctcctccttctccttctgacgcattagcttcgccgtctgccatgaagcggacacagaaagcctcacgtctacgatcgttgtctactagaccagctagtgctgagagaccagtggtccacgttgatcctgctactggaaagtccgacggtccccacaggaagaaattaagaacatatttgtggattgtggcgcgtgataaggtggacgtgatgtacgagaactggaaggaggtccctactgctcagaaggacttgatttgggaggatattcagacggaatttgaaatcccagaggcttctgacaataggacgaaaaagaagttacttcagactgttggcgagagatggaggtag

SEQ ID NO: 36685 - DNA, 348 bp, Glycine max
  Peptide Sequence Number=SeqID_128370
atggctccgaaaaagctttccacgaagagatctagcagagacgccgcggctgaagggacctgtgccgctcccgaagagagactcgtccagctcagggacgatgagtacacagattttcaggaggagatagctcgccaacattggacgtcgctagtcactcccatggctaagtttgaccctgatatagtcctggagttttatgctaatgtttggcccacagaagagggagtgcgagacatgcggtcatgggtgaggggtcattggattccctttgacgcagatgccctcagccagttcctgggtgacctgttagtgttggaggaaggccaggagtgcaagtttagttag

SEQ ID NO: 36686 - DNA, 105 bp, Glycine max
  Peptide Sequence Number=SeqID_128371
atggattcggaaagagagggattcgaacctccggtaaacaaaaagcctacaatagcagttccaatgctaccccttgaaccactcggcccatctcttcctacataa

SEQ ID NO: 36687 - DNA, 270 bp, Glycine max
  Peptide Sequence Number=SeqID_128372
atgaaggtactggttaccggggcgaccagcggcttaggccgaaatgcggtcgaatttctgcgcaacaagggcatcagcgtcagggctaccggtcgcaacgaagcgatgggtaaactgctgcaaaaaatgggcgcagagttcgtccatgccgatctgacggagctggtctcctctcaggccaaagtgatgctcgccggtatcgataccctgtggcactgctccagctttacctctccgtggggtacccaggaagcctttgatctcgccaac

SEQ ID NO: 36688 - DNA, 249 bp, Glycine max
  Peptide Sequence Number=SeqID_128373
atgaagaacggtgaagaatcttcacgaaatcgcacacggaaacgttacggaaacgcctcggcttggattttttccacggaaacaattttcctcactaatttcgagagaatcctaaataccagaaggactgaaccaaaatactctgccctctttcccttatttataggggaaaagaggaaggtggttgccgcccagctcgcccaggcaagcttccaccagaaggcaccgccttctgttggaaccccctag

SEQ ID NO: 36689 - DNA, 657 bp, Glycine max
  Peptide Sequence Number=SeqID_128374
gcgaacgtcttggcaagtcaaggcgaatgggccccgttcatggacatcctcgcacttttgatcttcggggtggtcctctttccaaacatggatgggttggtggaccgggcagcgattgatgcttttctcgcttttcatgaccgcaaggaaagcccggttgttgctatcttagccgatctatatgacaccttcgaccgaagatgtgagaagaacagtgcaaggatcctttgttgtacaccggccctctacgtatggttggtttcacaccttttcggccaagagacaaggggttgcattaattacaatcctatcctcgccataagacaacttggctaccctgcgagaggggcaccattagagaaaggcctcacacctgttattgcacgaggtttcgatagctccaacgcgggggacaaggaacttagaggcagtagtaacgggcccatcggtggctaccataggtggttgaaagccaatactcaaggtctcgattggctcccgaatatgagaaccactaaggaggtggaggttgaaactacgaaagaagacgaagaggtacaggccctcaagacagaactcgagaaagctcaaacagtcaaagaaaagttcaagtcagcagctattcggatccgaaaggagaatgccgaactgagagac

SEQ ID NO: 36690 - DNA, 324 bp, Glycine max
  Peptide Sequence Number=SeqID_128375
atgtatgctttaaaccaaattgttgttgagtttgagtgtgtaagttatgatggtattgatagttctcgttgcggatgtgtaatgagaactacttatggtctttcttgtgcatacgagttagctggatatgttgttggtagcatacctctcagtgtaatccatatgttttggcggaggctaagtttttcataccaagggttatctgagcccaaagtcagcataaccgaagagatggaaaccatattcaagcggttgaagagcttgatgttagtggcaaagttactctacagagtaaactttgggaaattgcctaccttgatctaa

SEQ ID NO: 36691 - DNA, 618 bp, Glycine max
  Peptide Sequence Number=SeqID_128376
atgacaacccagtatggattttttattgattccagccgttgcaccgggtgcaaaacctgcgagctggcctgtaaagattacaaagacctgactccggacgtgagcttccgtcgcatctacgaatacgccgggggcgactggcaggaagataacggcgtctggcatcagaacgtgttcgcttattacctgtcgattgcctgtaaccactgtgaagatcccgcctgtaccaaggtctgcccgagcggcgcgatgcataagcgcgaagacggttttgtggtggtggatgaagatgtttgcatcggctgtcgctattgccatatggcctgcccctacggcgcaccgcagtacaacgccgcgaaagggcatatgaccaaatgcgatggctgccacacccgcgtcgcagagggcaaaaagccgatttgcgtcgaatcctgcccgctgcgcgcgctggacttcggccctgttgaagagctgcgtcaaaaacacggtcagcttgccgcagtggcgcccctgccgtctgcgcacttcacgaagccgagtattgtgattaaacctaacgccaacagccgtcctacaggtgataccaccggctacctggcaaatccgaaggaggtgtga

SEQ ID NO: 36692 - DNA, 141 bp, Glycine max
  Peptide Sequence Number=SeqID_128377
ataataatcgtgcaggaagaaaaggaatcacatgaagacagtatgaatggaggcttcaatcccttctccgtctctctaacgtttgggaactctattggagcagtcggaggaaaaattggagaaatctcagggaaccgctag

SEQ ID NO: 36693 - DNA, 375 bp, Glycine max
  Peptide Sequence Number=SeqID_128378
atggctttgaatcctatttacttacggcaagaaattgaaaaacggaaaatcttgagaactattcgaaactcagaagaattacgggaaggggccattgaacagctggaaaaagcccaagcccgcttaaggaaagtcgaaacggaagcagatcgttttcgggtgaatggctattctgagatcgaacgagaaaaattgaatttaattaattcaatttatacgactttggaacaattagaaaattacaaaaacgaagccattcattttgaacaacaaagagtgattaatcaagtccgacaacgggttttacaacaagccttacagggagctctaggaactctaaagagttgcttgaacaacgagttacatttacgtact

SEQ ID NO: 36694 - DNA, 288 bp, Glycine max
  Peptide Sequence Number=SeqID_128379
atggatgaatttgacatccttgtctctctcatcctctcacaaacacatctttgcttattcaacttccaccggaatgcgagtgtaatccattggtttgtttgctcaaagcaacctgcgcccttgagtgttgactttcaagaccgttcaatcagagattactcgtcctgcacgttggtggggtgccgtaaacaacaagttgtgaaaacaaagatggataccgcagagccctacactggggcattgaggggcatcgtgcatgaacctcaagtgaacctaggggcagattag

SEQ ID NO: 36695 - DNA, 552 bp, Glycine max
  Peptide Sequence Number=SeqID_128380
atggcgaatcaagaggagtgggtcccgtttgtggacatattagcgttgctaatttttggggttgtcctctttccaaacgtggacggtttggtggaccaagccgcgattgatgctttccttgcatatcactatagcaaagagagcccggtggtagctatcttggcggacttatttgatacatttgaccgaaggtgcgagaagagtagcgcacagatcatctgctacttacctgctctttgtgtatggttggtttcacacctattccaacaagacataagacacccatgtccgctccgaagccatcgctcgtgtgtcgaaaagagaagagtagatagggaccaacacttggctggcataggaggcagaataatcaactggtttcctcgatggaaggaaggaaatgagggagttctcttctcatgtggggactacccaaacatcccgttgatagggatgaggggttgtattaactacaatcccgcacttgctataagacagttagggtacaccatgaagggagcaccggcggaagaaagcctctctcctttcctt

SEQ ID NO: 36696 - DNA, 273 bp, Glycine max
  Peptide Sequence Number=SeqID_128381
atggaacaagaaggtggattatgtgatgggaaagaagttgatcagtttcatcaaccgtctggtagtaatgaggttgccattgctaatgaggatggtatttcatatggatcagagctcatagaggttgacaaaatggtgctctctgggatattttttggagacaggatgtccctaagttgcaggaatatctggaagaatttcagagagtttaggtatgtccattgctgtcgtttaaagcaggattgggtgaaggatcaagctgctaataaatag

SEQ ID NO: 36697 - DNA, 201 bp, Glycine max
  Peptide Sequence Number=SeqID_128382
atgaaaatacagaaaaagggggaggaaatgatgcaatcctaccctgcaagggcattggatataagactccaagtagattgggccagagatccaagagaaggccctagggttcttatgagccttagggtagattttgtggaagcaaagcttcatgatgaatcaacaataattcaaaggtgttggaccttgtggcctcaataa

SEQ ID NO: 36698 - DNA, 408 bp, Glycine max
  Peptide Sequence Number=SeqID_128383
atgaacgaaataaagatgaaagtaaaaaaaacaagaaatgaattgaaagtctcagattcaaaaacttacccgttgaagaacgaagaacggatgaagaacggtgaagaacaacagaaaaccttcacggattcgctcacggaaacatctcggaagcgttacggaagtacctcggcttggattttcttcacagaaacatttttttccactcagcctatttataggaaaaggggggaggaggttgctgcccagctcgcccaggcgagctgggttgcttctgggcgagctgggttgcttccagaagcaatccagcttcgaaaaatactctcgaagacccacttcaaaatttcaaaattgctattcgcaccccccttctttcgtaatttacgggaaatttacggaagcctatag

SEQ ID NO: 36699 - DNA, 346 bp, Glycine max
  Peptide Sequence Number=SeqID_128384
gtcgactctagaggatccccgggtccgccgcctctggatgacaaaaagggtgcggataaccgtaagggtgcggataaccgtaagggtgcggataaccgtaagggtgcagataaccgtaagggtcagtatgacagatcttgtggggcggccgacaaaagcaacgctcttgctcctacgtatcctccaatgaggaactcagacctacgtgcggataaccgtaaggtgtctccgcgggttaccagctcttgggtcatgacagcaaaaggtggtgtggtcgacaaaagcaaggctcttgctcctacgtatcctccaatgaggaactcagacctacgtagttctggaactt

SEQ ID NO: 36700 - DNA, 360 bp, Glycine max
  Peptide Sequence Number=SeqID_128385
atgggtagaagtatgattgatgcaatcagtggaggcgctttaatggacaaaactcctattgtttcgaaacaattgatttccaacatggcaataaattaccagcaatttggtactagagttgctgcaccatccagagttgctgcaagtaaagtttctgtttctatggttgttgacaatcagaggctggagaataaacttacagagttgacatcccttgtgagacaactagccattggtcaaacaacagaatgtgatggcagccaatcaaccaaggctatatgtcattcagacctcaacaacaacaatataatccttactccaacacctataatcctggttggagagatcatccgaacttaa

SEQ ID NO: 36701 - DNA, 746 bp, Glycine max
  Peptide Sequence Number=SeqID_128386
taccctctccttcagaggactgcacgtcgtcaccttcagaggactacacgtcctcacctttagagggctgcacgccctcgccacccttaggtactagtaccctgtccttcagaggactgcacgtcctcacctttagaggactgcacgtcctcgccttcagaggactgcacgtcctcacctttagaggactgcacgtcctcgccttcagaggactgcacgtcctcaccttcagagggctgcatgccctcgccttcagagggctgcacgccctcatcttcagaggactacacgtcctcgccttcagagggtcatgtacctttatcttcagaggactacacgtcctcgccttcagagggtcatgtaccttcacctttagaggactacacatcctcgcctccagaggactacctgtcctcaccttcagaggacttcacatcctcaccttcagagggctgcatgccctcacttttagagggctgcatgccctcactttcagagggctgcacgccctcgcctttgtagggctacacgccctcaccttcagaggactacacgtcctcgcctccagaggactacatgtcctcgcctttagagggccacacaccctcttcttcagaggactacacgtcctcaccttcagaggactccacgtcctcaccttcagagggctgcacaccctcgccttcagagggctacatgccctcgccttcagagggctgcacgccttcgccttcaaaaggcgacat

SEQ ID NO: 36702 - DNA, 258 bp, Glycine max
  Peptide Sequence Number=SeqID_128387
atgaaagaaaacgcaattcattggggctccgaagaagggttagagaatggagaattgcacaaagcaatcactacgcatggctccaaactcgtgggtggaggatgcatgaacgaaaacgcaattcaaggggctccgaaacagggtagagaatggagaattgcactaagcaatcacaacgcatggctccaaactcgtgggtggaggttgcatgaacgaaaacgcaattcatggggctccgacaaagggttagagaattga

SEQ ID NO: 36703 - DNA, 426 bp, Glycine max
  Peptide Sequence Number=SeqID_128388
atggccaaaatacaagggccaaaaaaaaggaaaacctttctaatatttacaaagaagagtggatccaaccttggcccatgggctcagaaatctaccctaagattcatcagaaccctagggccttctttagccactctagctcaatgctcttggagtcttctatccaatgtggaagcaatgccttccaaggttattttgatgatgccaaagaatcaagagttaagcaaagtttcaagtaatgattcaagaatcaagtttcaagtttcaagattcaagattcaagattcaagattcaagaatcaagttcaagaatcaagaatcaggaagaatcaagatcaagattcaagactcaagattcaagaatcaagagaagactcaatcaagataagtattaaaaagtttttcaaaacattgagtagcacatga

SEQ ID NO: 36704 - DNA, 132 bp, Glycine max
  Peptide Sequence Number=SeqID_128389
atggggtccatgtggaccttgagaaaatcaaggccatccaagaggggcctaccccaaaaagtgcaggagatattaggagctttcatgggttggcaagtttctataaaaggtgtgggggctgtgttgttgtag

SEQ ID NO: 36705 - DNA, 201 bp, Glycine max
  Peptide Sequence Number=SeqID_128390
atggaaaaatctgaaaaaaaaaatcatagtgagaagaaactaaagaaagcatacatcacatgggatgaaaatgatttggaatcctctgatgattctgaaaatgaagagataaatctttgctttatggcaagaagttacgaaagtgatgaagagaagaggacatggcatatcaacttgctacttcaagaaaaattacagtaa

SEQ ID NO: 36706 - DNA, 123 bp, Glycine max
  Peptide Sequence Number=SeqID_128391
atggttgtgagggatagggttgaagctccatgtagagcttgtaggccttggatcttcttcatcaatggagtcctttgcctcttgaagatcaatggtagcggaatggagaaggaggaaaggtga

SEQ ID NO: 36707 - DNA, 390 bp, Glycine max
  Peptide Sequence Number=SeqID_128392
atgggcattgatgttgttgtgtggaaagaagtagtcggtctggacatgggtggagttagcaagttcgatgaaacgcgtgatgggtacaacaagatgcaaacctataggggaatgcttcttgacccggctaggaacttgaggaatcacttaggcattggtggactggctgtagaggacaaaatgttagtatacctcatcacctacattctcacatctaggtcgagcaatcatgcacaaattatgttgaagtgtcatcatctgttggattatgaatttccttatgttgtgctcgtgtcaagattcattgactatttcaaggttaatgtctctattgagattgtggactttactaaagcctccaatgagattaccgaaaggcatctcaagtag

SEQ ID NO: 36708 - DNA, 258 bp, Glycine max
  Peptide Sequence Number=SeqID_128393
atgatgacaataaaagatgatgacaaaggtgatgaacaaaaagctcaaagatcaaagaacaactcaagtgaatcaagaacaagtcaagagttcaagaatcaagaagaattcaagactcaagaagaaagcctagaatcaagaatcaagattcaagattcaagatctcaagaatcaagatcaagattcaagatctcaagaatcaagatcaagattcaagactcaagattcaagaatgaagaaaagactcaatcaagataa

SEQ ID NO: 36709 - DNA, 519 bp, Glycine max
  Peptide Sequence Number=SeqID_128394
atgctaaaagagttgagaaaagaaaaacaggccacctatagtagtcatgactcttgtaagagcctaagtgaagaacttcgttactattatgaaggaaggcataggtcacatcttagacctcactcccataggagagaaaaggaacgaaagcctcaagagggtaacattaacctcccatacttccatgggaaggacaatgtagagactaacttagtttgggaaataagggtagagcaacaacttaaaaagaaatctacatcaaaatcttatggctctcactcttatccaaagaaagaccaaggtcaaggcatcttaggggtgacaccttctaagcccaaagatgataaagggaagacaaagaaacattacttctcaatgcccaccaagaaaaccatgattatgaggggccaagacatttatagtagtcaagatgaggctactacttcaccttcctctagtgaaagtgaagaagcaaaatgggaagaatctagtgaagaaatctacccccaagaagaatga

SEQ ID NO: 36710 - DNA, 354 bp, Glycine max
  Peptide Sequence Number=SeqID_128395
atgcttccattggatttccggtgtgtcacggaaacttacggattgtgcatcaatatttttttggttttccggcatgtcctggaatttcacaaattgcctaatgatgggaaagctggagttgctgcacatgatgtccaacgttatgtcaaggaatcagatcgggctgcacaatgcacaaggcaagataaaatgtcaaatgaagaattgaagctgcaggatccacgatgtcggatacaatgtccaggacatcctgcccgaaaatgcacaaggcaagataaaagaattgaagctgcaggatccacgatgtcggatacgatgtccaggacatcttgcccgaaaatactggacacataa

SEQ ID NO: 36711 - DNA, 1294 bp, Glycine max
  Peptide Sequence Number=SeqID_128396
gtcgactctagaggatcccacggacctagctagggtagaagtctccacagaggccattgcctccctcgcccagtattatgatcagccgttgaggtgcttcacctttggggacttccagctatcacccatggtggaagaatttgaagagatcctaggatgccctctaggggggaggaaaccatacctcttcacagggttctatccctcattagctagaatttccaagatagtccaaatctcggcgcaggaattagaccataggaagcaaatcgaaaatggggtggttggaatacggagaaaatatttggaggcaaaagcaagaatcttggcaggtaaaggcgagtgggcctcgttcatagatattctcgcactgttgattttcggaggagtcctctttccgaatgtggatgggttggtggacctgccagcgatcgacgcttttctcacctatcataaccaaaaggaaaacccgattgtcgctatgttagccgacctatatgacaccttcgaccgaagatgtgagaagagcagtacgaggattgtttgctgtactccggctctttatgtatggttggtttcgcacctttttcgccaagaggtgaggcatgcttgcccactaggaagctaccgttcatgcacagagaaaggaggggcaaattgggaccgactcttagcaaacaaagaaggagcaggatttccaaatgttcccttgatgaggacaaggggttgcatcagttacaatcccgttcttgctataaggcaacttggctaccctatgagaggagcaccactagaggaagagctcgcgcctgtcatttcacgaggtttcaataagaccaacgtggagacacttcagaaggtccacaaggcatgggaggtggtgcaaaagaaggacaaagaactcaggggcagtaacaatgggcccatcggtggctaccataagtggttgagagcccacgtgcaaggtttggattggctcccaagtttgagaaccgctaaaagggaggaagttgaggcaccggaggaagatgaagaggtgcaggcccttaggacagaactcgagcaagctccaacagtcaaagaaaggttcaaatcagcagctctgaagatccgaaaggagaatgccgaactaagagatataaatacagctaccaccaaagccttggaacaagagaccaagagggctcgtagggaagagcacggccggaacaagttccaaggggctctgtggggcagcaacagcgagcttaagctccagagagaggaaagggaccaatcacgagtgacagtttga

SEQ ID NO: 36712 - DNA, 324 bp, Glycine max
  Peptide Sequence Number=SeqID_128397
atgatagttaaccaacaagtgatggatggcatcttaggggctgcaccttctaagcctaaagatgataagaggaaggcaatagaaaaggaaccccctaaggcttgtatgcaagagaagactagctctgtaaagtgttgtaagtgtcttggaagaggacacattgcttctcaatgccccaccaagaaaaccatgattatgagaggccaagaaatttatagtagccaagatgaggttactacttcaccttcatctagtaaaagtgaagaagcaaaaggaaagtatctagtgaagaaatctacccccaagaagaaggggatcttttaa

SEQ ID NO: 36713 - DNA, 243 bp, Glycine max
  Peptide Sequence Number=SeqID_128398
atggaagagaaggtaaagcaaaaaattaatggagcttcaatgaggtcctttaatggtgattttccaccatggagatgtagtggaatacaaaggagaagaggtgagaggaggcgccatccactagggaataagccatggaagaaggagcttcaccaccaagatgagcgttggataagaagcttggagaggatgcttcaatggaggaaaagaaagagggagagaaagacagaggggggagcatga

SEQ ID NO: 36714 - DNA, 324 bp, Glycine max
  Peptide Sequence Number=SeqID_128399
atggtggtcattcctgccatgaaatacctagttgtctggttttgttcattgcataacaggccatacaactaccttaaggggataattaacagtgctttaaaaggtcttgatgatgctccacaacctaaatcaaaggttgttgctaggtggattgtcgtcaattgtaatagacaaaaaggaagcactgagtgcggtgattatgtcatgcactggatgtccaccatcatattaggaagttttaggaataactggaaagcgaccattggagccagagagattaaaggcgcttcggatccagtggggacattattatctccgagttag

SEQ ID NO: 36715 - DNA, 306 bp, Glycine max
  Peptide Sequence Number=SeqID_128400
atgagaaggcacatacttcaaaaagctgtggccaataacccagtttccgtagctatcgatgccagtggctctgactttcagttttacaagagtggtgtcttcactggttcctgtggaactgagttggatcacggtgtcactgccgtggggtatggtgttagtgatgatgggactgaatattggttggtcaagaactcgcggggacccgagtggggtgaagaaggttacattaggatgcaaaggggtgtggattctgaggaagcactgtgtggcatagctgtgcaagcatcttaccctagtgcataa

SEQ ID NO: 36716 - DNA, 113 bp, Glycine max
  Peptide Sequence Number=SeqID_128401
ccgaggcgcttccgtaacgcttccgtaagcgattctgtggaaattcttcatcgttcttcgtcgttcttcaccgttcttcatccgttcttcgttcgttcttcgttcttcaacgg

SEQ ID NO: 36717 - DNA, 411 bp, Glycine max
  Peptide Sequence Number=SeqID_128402
atggcgcgggtcgaaatcgctagctggccgaggacatgcgcaccaccagcctgcgcgtggtggccggcggcatggcggcggcctggcgcgctgttccgccgaaagctggcgatgctgaagatccggcggacccagaggcttcaggagcatcaccgcgtggtcttgaatgcctgggccgcgccatggggccgagccgctgctgggcgccctggttcgtggccaggccctgatcgacggctggcagcgatgcgcaaaaggaacgccgcagcctcatcggcggcaccatcgcggccctggcccatgacgagcccggcagctacttcaacaacgtcgccaccacggcctgcgcatcttcggcggctccaacgaaatccagaagaacatcatctccaagatgatcctgggtgctga

SEQ ID NO: 36718 - DNA, 117 bp, Glycine max
  Peptide Sequence Number=SeqID_128403
atggatatgctagctgatgctgaggtaatgttcaatgcaagttatttgacattacctattggtgaaatagaccatgatccactgcttggacgccccttgacgcctacaaagcggtag

SEQ ID NO: 36719 - DNA, 284 bp, Glycine max
  Peptide Sequence Number=SeqID_128404
agagggatggttcctgggtgaagaaagacgctcagccacaggcagcagatgatcgctctccttctcctcctcctcagagggatgactcttcatcctttatgcaaaacgttctagacaagttggatggtctcctcacctttgtcggtgagcgttttgactccttggacagccgcattgatgtcattgatgcacggtttgcaggaatggatacacgcatcactcagcttgaggaggatatgagtttcatttgccagtgcttcgaccttccaccaccgtcttcatag

SEQ ID NO: 36720 - DNA, 387 bp, Glycine max
  Peptide Sequence Number=SeqID_128405
atgctccattgccatattcaacacttcaacttttctcttgattctgaaccttatgttccaatcaagagatcttttctaatacgcgctgcagtgattgcatcctttggttaccgaaaagagcatgatggctcttgggtgaaaaagggtgctcaacccatcgatgaagaaggacacttacatggtggagaagattcctctcttcttcaaaagattttagacaggtttgatggtcttcaaacctttgttggtgaaaggtttgataccttggagttacaagtgggcatgcatttcaatgagatggagtcaaggatcaccaaggttgaagaagatgtttcttacattcgtacaagctttgatctaccaccaccacaaccaccatcatcttag

SEQ ID NO: 36721 - DNA, 444 bp, Glycine max
  Peptide Sequence Number=SeqID_128406
atgaagaagaagttggaggaagctacacagtcgggaagcattgatggcgtcatcgaccctccatccccggtcagacaccacgtgaagtggaagatggcccgcacaaagaaaacaggggagatgacgactgaggccgcaaaggaaatcgctgagaagatcataagtcattttcaactaaccattacaattatatttcaatattttttaatgccatgtaccactgtgtgttttctgtgcaggattcctttgaggagtaagcaacacagggatccttcgtcccccatggacgtcaagatgttctcaccgctgctattggacatccagagcaccctggacgtgtccgtgctgctggagccggtgtcaccatcaaacaatactttggatcagctccacggacgtcccacagctcttcctccctacctcccgaagaattgcagcagctga

SEQ ID NO: 36722 - DNA, 297 bp, Glycine max
  Peptide Sequence Number=SeqID_128407
atggctaagtttgacccggatatagttctagagttttacgctaatgcttggcccacagaggagggcgtgcgggacatgcggtcatgggtaaggggccagtggatttcttttgatgcagacaccctcagccagttcctgggagacccgctagtgttagaggagggccaggaatgtgagtttagattttgcccagaccactgccaggagatgggtgcggatcatgcgcaccagcatgactaccttgacctagacgtggatgacgttgctgctcagcaacatcctgcccagcgatcataa

SEQ ID NO: 36723 - DNA, 698 bp, Glycine max
  Peptide Sequence Number=SeqID_128408
aactggcgatgcgggatgaaccgggaagctgggttacggtgcccaaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtggtagtagcaaatattcaaatgagagcggtgaaggccgaagaggggaaaggttccatgtgaacggcacttgcacatgggttagtcaagatcctaacgggagggaagcccgtctgatagtgtacccgaagtcggaatgtgcctgctcgcccctggaaacggtcatcatcgcgattgggatggcagcgcgcgcccttggtgcaagagcacctgcgcgctcctggcgtcggcctgtgccctgtgggttgcgaccgccgaaccctgaatcttctgtgcaagggattcgaaatgagacgcatacctgtcgggacccgaaagatggtgaactatgcctgagcggggcgaagccagaggaaactctggtggaggcccgcagcgatactgacgtgcaaatcgttcgtctgacttgggacggtgcggctgctctgttgagccgcgccatggaatcgagagctccaagtgggccatttttggtaagcagaactggcgatgcgggatga

SEQ ID NO: 36724 - DNA, 465 bp, Glycine max
  Peptide Sequence Number=SeqID_128409
atggcggaatgtggggagtttaaaccagctcacatccacgggaccctaccgaaagatgaatttcagcttgctaacgatcaaggggcaacgccgtttacattgaggaggtggcaggcctgtgttccgtttgaggtagaagcacacgtcattaaggatcttggacagacactccggattaaaggaatcagaggggctcaaacacgctatgatcgagctcaactcattgaggatgaagatcttgacaagagcaggttacgttactgcaagttccatggaaagggagaccttgtgtcctgtgaggaaaaaaagtgccatgctgtcaagccatcgagggataatgggccccgacccatcctactgaatgtcatgtccgccccttggcctttctccatgtggggaagagctttgtcatcggggagccctggtgcttaccaacatggatggcgaagcatcgctctcatcctc

SEQ ID NO: 36725 - DNA, 456 bp, Glycine max
  Peptide Sequence Number=SeqID_128410
atgcagagggctaatgcatcattatgcaaagaaaaatcttcaagtaccaaagtactcaagacgagacagtatgataatggctcagcacagacattgtcacttgtagtaaaattgacatatgcaagatgcatgctttttaacgcaggcaagtgcagagaatttgcaaatttccctaagggggcacttttacaaagttattcccgagataggtctgttttcaaactatgcaaaccgccagctccattggcgcgtttgctgtggctgttacacgtggcgaagacgccattgccactagcgggttccatggtgtcgcctgccccattggcgatatcgccatgcaaggggagtagccagtcaaactggcgagttccaagcacagggcgcaggcttctcagccttttcaggcttttcagttggcaggctttttcagttggcaggggcaggggtacaggctaa

SEQ ID NO: 36726 - DNA, 651 bp, Glycine max
  Peptide Sequence Number=SeqID_128411
atgagaggggcaccgctagaggaagagctcacgcccgtcatttcacgaggtttcaataagaccaacggggagacacttcagaaggtccgcaaggcatgggaggtggtgcaaaagaaggataaagaactcaggggcagtaacaatgggcctatcggtggctaccgaagggaggaagttgaggcactggaggaagacgaagaggtgcaggcccttagggcagaactcgagcaagcccaaacagtcaaagaaaggttcaaatcagcagctcttaaaatccgaaaggagaatgccgaactaagagatacaaatatagctactgccaaggccttggaacaagagaccaagagggctcgtagagaagagcacggccggaacaagttccgaggggctctgtggggcagcaacaacaagcttaagctctggagagaggaaagagaccaatcacgagtacatggcatggtcttaaaagaggagttagcagcttgctcaagatccaagaaaagtttggcccaacacttagaagccacggagcaaagcatgctagctataataggacagtacaaagaagagttaaaccagtctttgacccatgagcaaaagctagaagaggacttcgcacaagcatacgccgagaaggaagcaagagggagg

SEQ ID NO: 36727 - DNA, 413 bp, Glycine max
  Peptide Sequence Number=SeqID_128412
ggacagcgagtcgggtggtgggcggagataccttatggtcatccgcacctttcatcgaccgagaggaacgaattcagcagtatcaggatgatgttggtcgttcagtgctgaccattttcaaaatttttgcagtttttttcactctcgccgtcttgaaacatttaagtccaacgatgcacggaattcttctctgctgggcagagacgattgggtgcaatggcaaagggaagcacttgacacccattgttaggcaatccgtgaagttccacgacatgtcgggagtcgaaaggaagcgtcaatgcgcaatccgtaaagttcctaaacaagggtgtacaaatagcagtcagtgggccttccaggatgttccaacagaaggcggtgccttctggtggaagcaacccagctcgccttga

SEQ ID NO: 36728 - DNA, 507 bp, Glycine max
  Peptide Sequence Number=SeqID_128413
atgcgagcagggaattctgatatctatggattcctcgagcctcagtccattcagaggtctgggcaatcgcagtttgaatctgaaagttacataaagagttggatgcagagttcacaacgcgatgtgtattggagcctacctaaatggatggtggtcatcctgcccaaggaacacttagttgtctggttttgttcattgcataacagaccagacaactaccttaaggggattattaatagtgctatcaagggtcttgatgatgctccacagcctaaatcaaagactcctgctaggtggattgtcgtcaagtgtaatagacaaaaaggaactactgagtgcggctactatgtcatgcactggatgtccaccatcattttaggaagttttagaaataattgggaagcgtattttaacgaccctagaccattggagcccgagagattaaaagcattgcggattcagtgggcacagttttatctccgagttagagatcagcctaggatttag

SEQ ID NO: 36729 - DNA, 678 bp, Glycine max
  Peptide Sequence Number=SeqID_128414
atggcattcttaggagaaactttgtctcagatgatcgtcaactcaaggttgacattcatttttccaaatggagttgtcattcacaatgagtgtggggtttattttcaaagttctactccagtgcccatgagagtaccaaacctctgcgatttttcaactcttaaaagcataatacataacacccttcagctaaacaacaatcaagttgtggatgaaattcattatcggcgaccgctcaaagatacaggtaataacattcacttccattgtatgcaattgaaacatgacatggatgtgaacaccatgttaatgtgtaatgatcaattttcatgtgttgaaccgattgagttgttatgcaccattggtagaacaccagatgcaattttaaacttacttgaatgccccagcatccgtactcatgatgcggttctgtattacaacggaaggtggaacatgccacgcccaaacaactttgtgggttacgcgttcacaggaataaatccccaaaaatttgatgttccaaaaggatgtaccatagatgaactgaaggatttgatcaagcaggtaacacctaaagggaatcctcctcatgggattcatgaatcccaacttgtaaggcgtttgttttatcaacaacctgctcatttggagtattctgacaaagttttaagaatttga

SEQ ID NO: 36730 - DNA, 159 bp, Glycine max
  Peptide Sequence Number=SeqID_128415
atgacgatgttagtctccgcatgtcaacggactcgcttgcctctagttgacaaaaggtgcgcgatgcaatcctacctcgcaagggcattggctagaagactccaagtagattgggctagagatccaaggaaaggccctagggttctcatgagccttagg

SEQ ID NO: 36731 - DNA, 300 bp, Glycine max
  Peptide Sequence Number=SeqID_128416
gatgttgctgagcaacaacgtcatccatatctgggtcagggtggtcatgctagtgcacatgatcctcacccgtctccctgcagcaatttgggcgaaatcttgccctggaatgcacaaaagctgagcaatggcctcctcatcaaaaccagagacctgactcctcctctagctgaattcatactgctgaccctcttccaaaatcagcgggtggcccaagaactggctaagggcgtctgcatccaaggggatccactagccccttgttcgttcgccggcaagtacaccggatcgcgcaactag

SEQ ID NO: 36732 - DNA, 399 bp, Glycine max
  Peptide Sequence Number=SeqID_128417
atggagtgcctagagggtgtttgggagacctttgaaggcaatgagaggtgccgattccgtggcacaattcgactcactgctacttcattagtacatccggaggaacctgcacgcacacttcagcagcctgtggggtggatactacctacacctactccatatcgactagttgagccggtccaagtgatagaggtgtcatcctctgaagaagatcttgaagaggatccagagaaattacctcctgaacctgctatggacgcccttgacttacctgaggatgatgaagatccgctccctgatgttgattccccagaggatattatgtcagcatctgaggcagactctacagaggagagtggccctggagggacagcgattagtgacgactcttcatcatag

SEQ ID NO: 36733 - DNA, 364 bp, Glycine max
  Peptide Sequence Number=SeqID_128418
ttttattgagaagtattgcacgcagagacaggcccaggggaatgctccgcaggtcgcagacgcaccgccacctcatcaggccggtccagccggatcgtttgatacggagcagtatttgcggcatttggttcgccagcaggcggccaaccaccggataagtctcagcctgcagagccagggctttacttcttttccgtgccctactccggaccagttcagggcagaagtcgcatggcctggagattggcctgaggcccgggcaggagaggcaccagcagaggctcccgacgaggcagatgaggcccgcgaggacgaggagatgaccgatttacttgatttcttaggaggaagcggagccacatga

SEQ ID NO: 36734 - DNA, 468 bp, Glycine max
  Peptide Sequence Number=SeqID_128419
atggcgatgacgtgtaatcctctcaaggtgaggttttgcagccctctgttggcgaggatgtgtagtcctctcaaggtgagggcttgtagccctctgaaggcgaggacatgcagtcctctgatggcgagagcgtgtagccctccaaaggttagggcgtgtagccctacgaaggtgaggacatgcagtcctctgatggcgagggcgtgtagccctacgaaggtgaggacatgctgtcctctggaggtgagggcgtgcagccctctgatggtgaggacgtgtagtcctctcaaggcgaggacgttacccaaggtgagggcgtgtagccctctcaaggcgaggacatgtagtcctctggaggtgagggcgtgcagccctctgatggtgaggacgtgtagtcctctcaaggcgaggacgtgtagtcctctcaaggcgaggacgtgtagtcctctcaacggtgagggtaactag

SEQ ID NO: 36735 - DNA, 180 bp, Glycine max
  Peptide Sequence Number=SeqID_128420
atggcagtaagcagtgaagaccagggggccggaaaccccaacgggaaacctttcaccgcgccacacgattctttcacgaagcgctctctcagacgcactcctgcctccgcaagcaaagaggtttcaaagataccaccaggcgaccaagtgaaagtgaacagccccgagcaaatcttctag

SEQ ID NO: 36736 - DNA, 577 bp, Glycine max
  Peptide Sequence Number=SeqID_128421
gaatcaccctaacctcattttgtccagccctcagcaacaacaacagcagcctgctccttccttccaaaatgctgctggcccaagcagaccatacattcctccaccaatccaacaacaacaacaaccccagaaacagccaacagttgaggcccctccacaaccttccctcgaagaacttgtgaggcaaatgactatgcagaacatgcaatttcaacaagagaccaaagcctccattaagagcttaaccaatcagatgggacaattggctactcaattgaatcaacaacagtcccaaaattctgacaagctgccttctcaagctgtccaaaatcccaaaaatgtcagtgccatttcattgaggtcgggaaagcagtgtcaaggacctcaacccgtagcaccttcctcatctgcaaatgaacctgccaaacttcactctattccagaaaaaggtgaatcttcttccacaggtaattctgatttgcagaagcagcacattccccctcttccattccctccaagagcagtttccaacaaaaaaatggaagaggcagagaaaagagatcttggaaacgtttag

SEQ ID NO: 36737 - DNA, 222 bp, Glycine max
  Peptide Sequence Number=SeqID_128422
atgcggtaccatgtcaatgaaaaaccacgtcgggcgcctaggagtaagatcataaggagaccagtcagggtcacaatgttttgcgagaatgcttcaatcatatgggatcaacataggcttaaaggagcactcaaaccggatgacccccaaggcctacactccgaagagtctagtcagggccgctccctcctgattcaggtccaacccaaaaaaacattctag

SEQ ID NO: 36738 - DNA, 512 bp, Glycine max
  Peptide Sequence Number=SeqID_128423
atggcttctatggatacctctgctatggtcaactctagggggggttccgaaggaaaggagggagtccttttctcatgtggagggtacccaaacattccgctgataggaatgaggggttgtattaactacaatcccgcgctcgctataagacaactagggtactccatgaggggagcaccgatggaagaaagcatgtctcctttccttgtgagggatttcggtgcacaaaatttcaaggctatacaaagaatccataaggcatgggaaaccccattaaggaaagatcaagaacataggggcattcgtaatggcatcattggtggttactatgaatggctgaaagttcatatacgaggtttagattggctcgccaagttaaaagacgtcagcgaagagagttttgaagcaccggaagaggatgaagaagtccaagctctcaaaagcggagttaggaaaggagaaacttgccaaggagaagtttcaagttggccgctacacacatccggaaagga

SEQ ID NO: 36739 - DNA, 258 bp, Glycine max
  Peptide Sequence Number=SeqID_128424
atggagaggaagttgataacgatgatagtagacacgttatcggtgtcctcatatgagaagatggtggattacatgccttcaagctttgccgatttagtgttcgtcggcgaaacggtcaaagtgggtttgagaagaggcaaatttgattgtctcactttgacaagtaaaaagcctggggcaaatggagagaatgagaaggaggaaggaacccatgttctggctgccattcctacatggccaaatttcccacctgcttaa

SEQ ID NO: 36740 - DNA, 417 bp, Glycine max
  Peptide Sequence Number=SeqID_128425
atgaaaagagcggcgcaagaattgtttgttgtgcactggctctctatgtgtggctggtttcacacctttttctccaagaaaggtaggcccgtctatccgctacaaggtcaccgctcgtgcgtcgaaaaaggaaaggcgaattgggaccaactcttggctagcatggaggggcgtctgttaattggttccctcgctagaaggaaggaagaatcaggttctatcttcatgcgagagtccaaagttggggcaattaatgggtcaacttcaacggcaagccttcgccagctagtgccgactgtgaagcatgaagaaaggatgcccaaagagcttaggaaggaagccataatcttttcatcgacggctatcgctatccgaacacaaggattggattggctcccaaatctacaagaccgttga

SEQ ID NO: 36741 - DNA, 339 bp, Glycine max
  Peptide Sequence Number=SeqID_128426
atgagctacttcttaatgagggggattaggtttggctccatcttaggaaggatagattccctactaagaggaaatccaagcttagtcctagaggtgatggaccttttcatgtcttggagaggatcaataacaatgcctataggttggacctcccagaagaatggtgctcatgctgaagaggaggaaccaacaaatttgaggtcaaatcctcttcaagggagaggggatcatgcaatcctccctaggaagggactagtcaccagagccatgaacaagaggctccaagaggattgggctagagttgctgaagaaggccctagggttctcatgaacctcagg

SEQ ID NO: 36742 - DNA, 423 bp, Glycine max
  Peptide Sequence Number=SeqID_128427
atggcgattcagcggattagcgggcacgcgggcgcccccgcgacgcagcgccgcaccgataccttgaatgggcgggttggctctcctcgcgcaccgcttccgccaactgctcgcccgccagctgcagctgatacatctggtagtagcgcccctgctgcgccagcagctgctgatgattgccctgctccaccgcctggccgcgatgcagcaccagaatggagtcggcatcgacgatggtcgacaatcggtgggcgatcaccaccagcgtggtgtgctcgcggatcgcacgcagcgcgcgctggatcgcctgttcggtgcccgagtcgatgttggcggtcgcctcgtcgaggatcaggatcttcggcgcctgcaccgacacccgcgccatcgccagcagctgtttctgcccgaccgacacgctaa

SEQ ID NO: 36743 - DNA, 546 bp, Glycine max
  Peptide Sequence Number=SeqID_128428
atggcggctcagccggtccagcgccgtgcccttattgcaaccgagcggcagcacctccaggcaatcgtaggcggaaaagcacaggtctgcctcgtcgcccagctgtgcccgcagctgcacctgcaacgccagcagctcctcatgcggcgcgacaaagcacaccttgctgttgccgaacgccggcaggcggcgcacgtcggccagctgaaaacgaaagccgctcaggtggtgcgcccgcagcatctcttccggcacgggaaactcggtcagccagccttcgtcgcggaacacgtgcatgctggcgcgggtgcgccaatgatgatgcaaaacctcctcggcgaccgccgccggcagatcggtagcgtgcagctgttggccgcggttgtcatacacccgcgtgccgttgccggtgatcaggtagccctgcagccccagctgcgccatgatcggctgcgcgtcgaggtagtgccgcccggtggcgaacgtcaccaccatctcccgttccaccagctggttcagcaccgccagcgtttccgggccaacccg

SEQ ID NO: 36744 - DNA, 189 bp, Glycine max
  Peptide Sequence Number=SeqID_128429
atgaccctttcatcatggcagaacaagctagacaagtattttatgtgcaagacccttgtgatgaaaggtggtgcatggttctacagggcaaaacaattggtgttaatgatcatggcttctccacctgcctcgcctcctcctcctcctcctccttctcctcctcctcatccacctcttttcgacgcataa

SEQ ID NO: 36745 - DNA, 369 bp, Glycine max
  Peptide Sequence Number=SeqID_128430
atggcatcttcgtcgtcatgttcatcaaatattaaaattaagtctggcccgatcgatggtggtgtattatggatgcaagctaagcatgtttcaaaacatgtttggaatgggaaagaagactggaaattactcatcagacgagctgtccccacgtatcaaggggaagaagaaataccagaggaaattattcctctacttcggcaatgtgatttttattggataatgaagatgggctacctaaaaattagtgtgtcattaattactaccttgattgaaagatggaggcccgaaacacatacgtttcacatgagatgcagagagtgtacgattactcttcaagatgtctgtattattaggtctgcgtgttaa

SEQ ID NO: 36746 - DNA, 363 bp, Glycine max
  Peptide Sequence Number=SeqID_128431
atgaatcaaaatgagaccatacaagatatgcaaaagagatttacacatatagttaatcatcttacatcattaggaaagatatttcctaatgaggatctcattaacaaagttctaagatgtttaagcagggaacgacaaccaaaggaatacaaaatggaacttatgagactaaatcaacatgaagaaaatgacaagaaaaagaaaggaattgcacttaaagcctcatcttctattcaagaagaaagtgacagagaatactggaatgaaatagaagaagatgatgattttcgtttcttagtaaatagattcaacaagtttataaggaacaaaggaaatcaaagaagaacaaatttcaatccaaag

SEQ ID NO: 36747 - DNA, 222 bp, Glycine max
  Peptide Sequence Number=SeqID_128432
caagaggttccataccaagatgatgagcttgtagggcttcaagatgtgttggaagttgaccctgatgtcattaatgaatctcttgtagatgttgatggcggtggagaagagataaatgcagatttacttaaacatctagacttgattggaccaaacgaggatgaatgcatattaagtgagaatgagattgagagtaattttgatgatacagatccttcttag

SEQ ID NO: 36748 - DNA, 555 bp, Glycine max
  Peptide Sequence Number=SeqID_128433
atgatgaaggccatgatgagcatgaagaagataatggaagccaatgcggttatagttgccgctattagcgctgtcgctaaggtgaacccgatgctcccatctggcctcaagcaaatgaatcatccaacctcaaatatggcacatatctctcaaaccatgggggagacacatgaaattccccaccacaatctagctgactttgagccttggctcggatatgccactgaagggcaagcagttggtggtataccctttgaaaacactttggagggccctcagtttcgcccacaaccacaaccattgcattttgcggtgggaagagcccctcctgctatggccgaaaagggaaaggtggatcatctaaaggaaaggctcagggccattgaaggaggtgaagattatgcctttgctaacctagaaaagttgttcctaatacccaaacatggtcattcccaagttcaaggtgccggactttggcaagtacaaggggactactcgctccaagaaccatctaaagatgtactgtcggaagatgggggcatacgcaaaagatga

SEQ ID NO: 36749 - DNA, 660 bp, Glycine max
  Peptide Sequence Number=SeqID_128434
atgtggtatggttcagcaacaacccctattgaattattcggtcctactcgttatcaatgggatcagggatactttcagcaagaaatatatcgaagagttggtgctggactagccgaaaatcaaagtttatcagaagcttggtctaaaattcccgaaaaattagctttttatgattatatcggaaataatccagcaaaaggggggttatttagagcaggttcaatggacaatggagatggaatagccgtcgatggggatggaattgttagggccgatgttccttttcgaagggcagaatctaaatatagtgtggaacaagtaggtgtaattgttgagttctatggtggcgagcttaatggagtcagttatagcgatcccgctactgtgaaaaaatatgctagacgtgctcaattgggtgaaatttttgaattagatcgtgctactttgaaatcagatggtgtttttcgtagcagtccgaggggttggtttacttttggacatgcttcttttgctctgctattctttttcgggcacatttggcatggtgctagaactttattcagagatgtttttgctggtatcgacccagatttagacgctcaagtagaatttggagcattcaaaaacttggagatccactacaaaaaacaggtagtctaa

SEQ ID NO: 36750 - DNA, 277 bp, Glycine max
  Peptide Sequence Number=SeqID_128435
atggccaccgctgatgccttggaacgagaaaccaagaaggccctaaaggaagaacacgtgccagcaaagctagaggatgagtacgccaagatatcagcagaaagcgaagcaagggaaagggtaattgattcattgcaccaagaggcaacaatgtggacggaccgatttgctcttactttgaacaggagtcaagaacttcccccattgctagccaaggccaaagcagtggcggacacctactccgcccccgaggagatccacggacttctcagctatt

SEQ ID NO: 36751 - DNA, 536 bp, Glycine max
  Peptide Sequence Number=SeqID_128436
atgagaggccctctcgatgagtcaatcttttgcttactcatagaggtggacccttcagtacaaaaacctattgcctttagaggactacacgtcctctccttcaaagggctacacgccctcaccatcagaggactacacgccctcgccttcaaaggactacatgtcctcgccttcagaggacttcacgtcctcgcctttagagggctacaagccctcgccttcagaggactacacgtcctcgccatgagagcattgcatgccctcgccttgagagggctgcaagtcctcgccttcatagggcttcacgccctcgccatgagagaactacacgtcctcgccttcagagggctgcacgtcctcgccttcagaggactacacaacctcgccttcagaggactacacatcctcgccttcacaagactacacgtccttgtcttcacaggacagcacgtcctcgccttcaaaggactacacgtcctcacctttagaggactacatgttctcgccttcagagggctacacgccctcgccttcag

SEQ ID NO: 36752 - DNA, 519 bp, Glycine max
  Peptide Sequence Number=SeqID_128437
atgcggcaggtgaaatttggcgatccggcgcagcaggccgatgtggatatggggccgctgattagcgcagccgcgtgcgaccgtgtcgggcaaaaggttgccagcgccgttgcgcagggcggcaaggtggtgctgggcggcaaacgcgccggtgaacgtggcttttattttgaaccgaccatcatcaccggggtacgtcaggagatggcgatcatgcgtgaggaaatttttggcccggtgctgccggtgatgcgctttaacacgctggatgaagccatcgcgctggctaacgactgcgactatggcctgacctcatcgctgtatacccgcgatctgaacaccgcgatgatcgcgctgcgccggctgaaattcggggaaacctacattaaccgcgaaaattttgaagcgatgcaggggttccatgccggctggcgcaaatccggcatcggcggtgccgatggccgccacgggctggaggagtatctgcaaacgcacgtctcctatctgcagtttgcctga

SEQ ID NO: 36753 - DNA, 219 bp, Glycine max
  Peptide Sequence Number=SeqID_128438
atgaggctgtttttcctgagccaattgtgccagctatacacgggactatggaagcaggtagcagatcctcctgcaccagtacatgagagactagctgacccctctacacccaccatggagatgccagaagaccctaccacgctagtcctgagattgtcatccactcctccagctaccccagttttacatctgacagatgaggaggatatgcaggactag

SEQ ID NO: 36754 - DNA, 702 bp, Glycine max
  Peptide Sequence Number=SeqID_128439
atgggtaaagaacactacattgctgataaaacgtttaataaaggtcataaaaatgagcttacgcttaaagacctggaattcttcacctgggagaaattagacaaagtagaagagattaaaacaacatttggagttgaaggaaccaataaatatattgcacccaaagtaggggttactttattcgggctgctggatttgactgcagggtatgcttttccctttggagacgctgaattgaacggaaaacagctaaaaggagtgaatgatacattcatgaaaatcatcgtgatgttgaaggaaggacgttataacgaagaaggaaaatttattctttgggctaaaagaattgcctataatcttattattgaccatttcagattgaaatcgaaaaatatcaaggtttcggaaacaacttttgaaactgacgaatattctattttcgatttaatcagagagccttcagaaaatattgaagatcaattagtgactaatcagattcaggaagatttattgcgaatgctgcaatacctgcctcagaatcagcaagaggttattaagttaagattttttgatgggttgagctttaaagagattgcagatcacacggatatgagcattaacactacattgggacgtgtaaggtatgcgctgatcaacctgagaaaaatcatggaagagaataatattatccttaccagataa

SEQ ID NO: 36755 - DNA, 409 bp, Glycine max
  Peptide Sequence Number=SeqID_128440
ttgttgaaaagttcctaaagaaatacttcccagagtccaagactgcagaagggaaagctgcaatctcttcatttcatcagtttcatgatgaatctctgagtgaagcattggagagaccacaaaccaagaaactattagatgcttctgcagggggaaagataaaactaaagaccccggaagaagcaactgagctaattgagaacatgtcagccagtgatcatgccattctacgagacagaacccatcaacccacgaagaaaagcttgatagagctatcatcacatgatgctttattggcacagaacaagccaatgtattctctactgaagaaaacactcaagaaattcattatatgggaaatcaacaacggcaagggtatacttaacgaggattttcagcttccagcagg

SEQ ID NO: 36756 - DNA, 573 bp, Glycine max
  Peptide Sequence Number=SeqID_128441
atgaccggaaggctgcttgctggttcattggctcttgaaagccgcatccttcactatcttattgttcgtgtcttactcccaagatcttcaaaccttgcacaggtttctgaagaagatcttatagtcatgtgggcctttcataccggccgaaaaattgattgggcacatttagtccgatctttcttgatcggtgctgctgtggttgcatcttttggttaccgcaaagagcgtgatggctcttgcgtaaaaaagggtgctcaaccaaatgatgatgaaggacaattaccggttgaatgggactcttctctccttcagagtaatttggataggtttgatgctttggaacaacaagtggacatgcgattcgatgcaatggactcaaggatcacaaaggttgaagaagatgtcaccatcattcgcgactgccttgatttacctccaccaccatcagattgtcatcatcaaaagggggagattgtggaagcaatgtcttccaaggttattccgatgatgccaaagaatcccgagttaagatcaagttttcaagaatcaagattcaagattcccgaataa

SEQ ID NO: 36757 - DNA, 378 bp, Glycine max
  Peptide Sequence Number=SeqID_128442
atgtgggcttttctcaccggtcgtcagatcgactgggcccatttggttcggtaccgaatgcataaggcattacgggccaatgcacctctacgttatccacagttgataactttgtttctgcatcattttcaaattccgcttgatgatgagccatttgttcaagtcaagcgttcctttgcaattggtgctggtgctgtgacttcctttggttacctccttaccgaattacgaggccttcgttcttatgttggtgaacgtttcgactcattggatacacgctttgccggcatggatattcgcctcacacaagttgaagaagatgtctccttcatccgtacttgctttgatccaccaccaccgcctccatcatcctcttag

SEQ ID NO: 36758 - DNA, 762 bp, Glycine max
  Peptide Sequence Number=SeqID_128443
atgcttgtctccttcggtgatcttgtgccagttctaccgatactgaatgcgattgtgcggcagcgccgcgtctggcggcagaccaccgacggggggtatgcctcccccaaagcggggtatctggccgcgatcgccggccgggcctcacggccccggcgcgatcaggcccgccttgatggcgcaggccaccgcctcggcgcgtcgccggcgcccagcctcgacatgatcttcttgacgctgtccttgaccgtgtggggactgcggtggacgatgccggcgatctccgcattggaccgcccctgcgccagcaggcccaggatcttcaggtccgaggcgctcagcccatgcttttcggcggccagacggctgagcatgcattgcgcctcgcgcagcttgtcatcccccgcctcgccggcctcaggtgccccgtgcaccagttcggcgatgcgcgcgtacatggccatcgcaatgcgcgtgcgctcctccaacagggtcacgcgctgcgacttctcggttaccagcgactgcagcgccttgagggaaggtctcgttgatgtcacgggcgatgcccatggcgcccgaccactttcccgccccgcatcagcgggccgcgtccagcacctcgagatggacgatacggccgtcgcgatggcgcgcctcgtacagcttcatgcggccgtgcggatcagcacgatgtccaggcgccctgctgcagcgcggtcttctgccgcgccagcgccgccttcaggtcctggcgggtaa

SEQ ID NO: 36759 - DNA, 429 bp, Glycine max
  Peptide Sequence Number=SeqID_128444
atgtatagagttgctgcaccgactataagagtgattcttggtggtgcttttgtagtaaatggcaatgtgaatccaactgttgaagtcaacatatttggttattcagaggctgcagacgttgtatttacaagtggggtagatgtacttgcagtggggataaatgttacccaccaagttgtactaactgaatttatgcataagactccagtgccgccttggagtttgatagtcaccgttttcggtgtgtcgagcaccaatagcgcttcgaggccatcaagggatggtctttccacagggagagacaagtatcctgacttccagggagatatctcttgcagacattgggcacgactagtgacccctatggctaaatttgacccggagatagtcatagaattttatgccaatgcctggcctactgaggagggg

SEQ ID NO: 36760 - DNA, 690 bp, Glycine max
  Peptide Sequence Number=SeqID_128445
atggcccgccactggtgcgtgctggtgagccgtaccacggcgaacccattaccgggcagcgatgagatcaatcgcgcctatgaagagggatgggtgggtaatcatgccctggcgttcattggcgatacgttggcggaaaacggcgacaaagtgcctgaactgtttatggtgacgctgccgcgggatgaggcgggctggaagcggcagggcgatatgccgctggccggtaccgcaacgacgctgcccgcgccgccggcaggcattaaccagcgccgcttgacctttacccaccagcgccgctatccggggctggtgaatgtaccgcgccattgggtacgcgccaatccgcaggccaccgagatcgcctttctgatgcgtgatgacgcaggcgttgtacagctgtggcttatcccgccagcgggcggtgagccgcgccagctgacacatacggtaatgggcatccagtcagcatttaactggcatccgtcgggcgcgtggctgggatgcgtggtggaaaacaaaatcgcgctctgcgatgcccgcagcggcgcggtaagttatttgacgaacgatcgcgaaaatccgccgtccgcggatgccgtcgtattttcaccggatggcaaatacctggcgtggatggaagacgtcgacggttatcgccagttgtggataaccgaaacgcagcgctag

SEQ ID NO: 36761 - DNA, 378 bp, Glycine max
  Peptide Sequence Number=SeqID_128446
atgggagaatttgtggacggcagatgggaatggaagttatcttggagaagggacttttttgactatgaaatacaaatggcagctgactttgtagatgagattcattctgacccaaagaaccactttttgcaattcactcaatggaacaacaaagctagtataaacaacagatggaaatttctgtggttagctctatccttcttcgtctggcatcatagaaatgctatgattttcaagaaccacccgtttgatcctgaaaagagaaggactacaccagggactacaccatcgatatgtagcagttgcatgtggaggtcaacaccaggttgtctcatgaacgacaactccattagccatcttccagcggtcaatgacatg

SEQ ID NO: 36762 - DNA, 231 bp, Glycine max
  Peptide Sequence Number=SeqID_128447
atgtatcttccaaaaagagataaagcatactttcgctgggatacttgtacaaaggcaagattgggtcctgacaggagaatgtcatctacatatactagtaaaatgactaaggaatttcctgagccaatggcactgctcgaggataaaacttgttccttgatgagggaagagtggaagcaagttctaaacagccaaaacttcttaaggcatgatagtcaggttcctttttga

SEQ ID NO: 36763 - DNA, 405 bp, Glycine max
  Peptide Sequence Number=SeqID_128448
atgatacgcggagataccttacggttatccgcacccttttgtcatccagaggcggtgggcccgatgacaagcagagacaaaatttggtcattctgcacccttgtatcatccagaggcggcgggcccgatgatacgcggagataccttacggttatccgcacccttttgtcatccagaggcggcgggcccgatgacaagcagagacaaaatttgggtcattctgcaccccttgtatcatccagaggcggcgggcccgatgatacgcggagatacctacgaggttatccgtataaacattcttttgctatctgtgcttggcacccatcattaggcgatttgagaaattccgggaacgacaagtcatggtcacccgcgactctcgtcaaccgagaggagcgaaattag

SEQ ID NO: 36764 - DNA, 180 bp, Glycine max
  Peptide Sequence Number=SeqID_128449
atggccactattcagcacctggcgattgccaacaagaagacaaggcctattatttgcatgatcaagttagaactcaatagaacttccaaggaaactaccaaggctacagaggtggctcaggtccttctaacaactcttatgcgggtccttcaaataggggtccacaacagcaacaactag

SEQ ID NO: 36765 - DNA, 126 bp, Glycine max
  Peptide Sequence Number=SeqID_128450
atggagtctccgaataaagtggagaatggagaattggcgaacagcgctacgcaacgctacgtagcaataacttcgcggggctccagactcgaaggtggaggacacatgaacagcgcttggcaataa

SEQ ID NO: 36766 - DNA, 288 bp, Glycine max
  Peptide Sequence Number=SeqID_128451
atgcagaggatggaactctatatgcagcatgtggctgaccagcaagtggccaatcataagggtcaggtgcatttgaatgagagcttttaccaatataccctggatcaaaagagccaggatcccagtccttactcatggcctactctcgagcagttcggagcaacagttgcatggcctggagataggcccagttttcaggtagaggcaggacccgcaggggccccaggagatgaagatggagctcaggaagactatgacatggccgatgtgatggacttcttcctttga

SEQ ID NO: 36767 - DNA, 519 bp, Glycine max
  Peptide Sequence Number=SeqID_128452
atgccatatgtggaagccgcggaggagtcattagaaacagccttccaatcttttgaggtagtaagcattgcctccgtagattccttctctgggcaaccgtgcctgtccgatacggcgatgatggtagcccgagtgatgttggggaatggttacgagcccagaatgggtttaggcaagaacaatggcggcaaaaccagcctgataagcaccagaggaaaccgtgggaagtttgggttaggctataaacccacacaagtagacataaggaaaagggttgcgggaagaaagagcggaagtcaaggctcgcaattgggacgaaaagtcgaagggggcccgccctgccacatcagtaggagctttataagcacgggtctaggacacaaaggccaagtcattgtgatatgcgaagatgatgctccgagtgagtcggatttggtacgaccatgccctcctgatttccgactaggaaattggcgagtggaggagtgcccagacatttacgcgacaagcataatgtaa

SEQ ID NO: 36768 - DNA, 282 bp, Glycine max
  Peptide Sequence Number=SeqID_128453
atgcacgtggttggacatgtgtttaaagtaaccttgtacaaaaaactatttggcatggtatcaaggtatgctttaaatgaaattgctgctgagtttaagcgtgtagcttatgcaggcaaaaacccttcacgatgtggatgtgtcatgaggagtacccacggtcttccatgtgcatggttaagtgagacacaagcgaccataactgaggagatggaaatcatatcgaaacgctttgagaagctagatgtttgtggtaaaatacatttgaagtcaaagctgtga

SEQ ID NO: 36769 - DNA, 906 bp, Glycine max
  Peptide Sequence Number=SeqID_128454
atggcatcattgaccctccatcccccggtcagacgccacgtgaagtggaagatggcccgcacaaagaagacaggggagatgacgactgaggccgcaaaggaaatcgctgagaagattgattcgtttgaggagcaggccacacagggatcgttcgtcccccatggacgtcaggatgttctggccgctgctattggacgtctagagcaccctggacgtgtccgtgctgctggagccgatgtgaccatcaaacaatactttggatcggctccacggacatcccgcagcgcttcctccctgcctcctgacaaattacagcaactgacccagcagatcagggaccagctaaaggagtccatcacagagaaagtgatgaggcagggacttgcagtgcctcctgagcctctggttggtcctggtccctccggtcctcgagtcagcacaaaggggagttgtgttgatccctcaggaaacgatcctgagacgggtgactctaacaggtgcggcttgtacatagaagcagatgctgcccgcctggttgccatggggagagtttatgagggatccactcttgttcataacactcctttgttgcctggccaagtaaaggcacttcacaccttccttgcttggccgacacatctggtcatgtctttatcacagcaggtagctgtgtctccgccaaaaccacctccgaagcccgatccggaggtcgatgatccgctttatctgatgacattgaccatcccagagcttttcttgaggccttatcaggttagatgggatgccaccgtattcggggtcgtcaatccagatttccccctgtacataaagcacgaagacctctccgaaatcgcacacggtggtcaatgtctcagcatatcagtgttacagttgtggattctgtaa

SEQ ID NO: 36770 - DNA, 387 bp, Glycine max
  Peptide Sequence Number=SeqID_128455
atggtgggttacacaccttcaagctttgcggatttggtcttcactagtgaaaggatcgatgtgggtccgaaaagaggcaaatttagtcattctgcttggatgaatgagaaaactggggcaaatgaagagggtgagaataagggagaaacccatgttgtgactgccattcctatatggccaagtttcccaccaacccaacaatgtcattactcagccaataacaacccatttccttacccaccacccaatcattcacaaaggccatccctaaatcaaccacaaagcctgtctaccacacttccaatcacgaacaccacctttagctcgaaccaaaacactgacaaagaaatgaattttgcagcgaaaaagcctataaattcaccctaa

SEQ ID NO: 36771 - DNA, 198 bp, Glycine max
  Peptide Sequence Number=SeqID_128456
atggcattgtggtcgcctgtaggactgacagaggccctaaccagtagcaaactcccagcggcacgggtgaaatcttgccccggtatgcatagtagatgcgtgatagcctccctctctggatgtgctcgcacagttggtcgccctctaatatcagggggtggcccaggaactgataaaaggaaactactggccccttaa

SEQ ID NO: 36772 - DNA, 376 bp, Glycine max
  Peptide Sequence Number=SeqID_128457
atggcagaatcgtcaaagaagagaaagggatcatcctccaccactgctcctgctggccatcgccaccacggaccatctgaagcacccacaacacctatctatccttccttatcatctccaagatcatccactctgttttcttccgatgatcaatgtctacgatacctttctcaattttcttctaggatcattttagaccctaagtacctagacatagatttcttcaatgatgagacatttgattgttatcaagtgtttcaaaattctgacttggttgatttcatgtatttaaaattcccttattatcctgaacttgtcaaagtcttttactgcaatttaaaaattcaggatggcattatttcttctgaggtgcatg

SEQ ID NO: 36773 - DNA, 440 bp, Glycine max
  Peptide Sequence Number=SeqID_128458
atgacggaagggtgtggtgaagggttttgccttgcaaaccttcccggtgatgcttttagtctatgggggaacttctttgaggcaaagaaacaaatgatggtgatgccaagtcttggcaagccgttggttgaaatttttgccccccggtcaacttcgtggtttttgcccgttgttggcttggctagggtcggcggtgctgggtttatggccccgattttgccaactttggcttgcgccccgttggctaagtctgtgcctcggtggtggatcatcatgcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgc

SEQ ID NO: 36774 - DNA, 426 bp, Glycine max
  Peptide Sequence Number=SeqID_128459
atggtggcacgggtgatgctcaagcacggatatgagcccggaatgggtctgggcaaggacggccttgggaatgccgacgtggtcgatattaggggaaactcgtacaaatatgggttggggtatgaactcgggatgccgggaaggaggaatgcgtcgtcaagattctgggcggatagtgcatggcccgaccatgttagccagtgtttcaccagtgccagaataatgtatgaggaagaggtggcagcaataggagaggagtgccctcaagacccgccaagtttcgtgcggccatgccatcctgattcccaagtagggaactggtgcgtgataagccagtcagaggtctatactgctgattcaatatatgagggtcgattctttgaggatcctaacaacgagggtttgacaatcgatttcgaccgagat

SEQ ID NO: 36775 - DNA, 1218 bp, Glycine max
  Peptide Sequence Number=SeqID_128460
atgaagttagagaaatcaaaattagaaggagatcaaaccatacaaatcagcggttcgaaaagtatttcgaatcgtttgttgattttggaaagcctgtttaataacatacaaatcggaaatctttccaattcccaggacacagaaatgcttacgaaagccttatcagaaaattctgaagtggtggacattcatcatgccggaaccgccatgcgctttcttacttcatatttttctatcctcgagggcagggatactatccttaccggatccggaagaatgaaagaaaggcctatcaaaaacctggtcaatgctttgcgtgatctgggagcagatattgaatatatggagaacgaaggttttcctcctttaagaattaagggtaagaggatcacacaatctgtggtgaatgttcctgccaatatttccagccagtttattacttctttacttcttattgcagggaagctggaaaatggtttggagatcaatcttgtcggcgatatcacatcgaggtcttatattgaaatgacgcttgatattattaccagatttggcattaaagctacttttacaggcaatgtgattaaagtagaaccttttgcaaacccatcttctgttatccattatgaagtagaaagtgactggagctctgcttcatacttctactctatctgtgcattgggaagaaagactattcatctgaaaagcttctataaacaatccactcagggagattctgcaatagcaaacatctatgagaagttctttggaattacaacgactttttcggaagaagaacataaaattactttaaaggctgatcctgacttttcttttccggaaaaaattgaactggatatgaacgactgccccgacattgcgcaaactctttgtgtaacggcagctgcattaaaaattcctttcgccatttcaggtcttggaaccttaagggttaaggaaacagacagattacaggctttatataacgaactaaaaaaaataggaactgaaactgaaattacagatttcacaatcgaatcagtgagttttggagaaccggaagaaaatatttcgatcaaaacttatcaggaccataggatggccatgagtttcgctccattctgcctgatcaaagagcttactatagaggaagaaaatgtggttgaaaaatcgtatcctatgttctggaaagatctttccacaattcttatatcgtaa

SEQ ID NO: 36776 - DNA, 1356 bp, Glycine max
  Peptide Sequence Number=SeqID_128461
atgccttttaccgttgcactgaccggcggcattggtagtggtaaaagcaccattgctaacgcttttgccgcgctgaacgtcgacatcattgatgccgatgtgattgcccgcgaggtggttgaaccgggcacacctgcgctcaatgcgattgtgaaacgccacggagaatcgattctgaccgcagaaggcacgctttatcgcgcgcggctgcgggaaattattttccagcagccgcaagagaaaaactggctcaatcaattgctgcatccgctgattaacgcccgtacccagcagctgaaggcgcaggcagcttcgccttacgtcatgtgggtagtgccgctgctggtagaaaatggtctgcagcatcaggctgaccgggtattagtcgtggatgtcgatgaggccacgcagctgcagcgcacccgccagcgtgatggtatctctctcagccaggcgcaacggattcttgccgcgcaggccagccgtcagcagcgtttagcctgcgcggatgacatcatagataacagcggcacgccggaacaggctttgccgcgcgttgctgacttcaccagcgctatttacgcctggcagcaaccggacgggattaatatcatgagcacagtggttctgtttgaacacccattgaatgagaaaatgcgcacctggctgcgcgtggagtttttgatcaaccagctgcacgaaacgctgccggttaacagctcggttgccgcattgggtgtgtttcgtattattggcgacctgctggatatcttcgaacgcggcgatatgcgcaccgagctgttaaaagagctggagcgtcagcagcaaaaactgcgtgcctggctggatgtgccgggtgtcgatgaacacaccgtcagccagttgcgcgatcagctgaagcagcaatccagcgagctgatggccgcgccgcgcatgggtcagcagctgcgcgaagaccggctgattgcctccgtacgtcagcgcctgagcattcccggcggctgctgcagttttgatctgccgggtttacacatctggctgcaccagccacaggcgctgcgcgatacgctggtgaatagctggctggcctcgctcgatccgctgcgcaacagcctgacgatgatcctcaacctgattcgtcagtcgggcgtgtttcgccatcagaccagcctcaacggcttttaccaggataacgccgagggggccgacctgctgcgcctgcagctaacgctggaagatgcgctctatccgcaggtctctggtcataaaagccgctatgctatccgctttttaccgctcgatagcgaacgcggcgaagtgccggcgcgactgaattttgaattagcctgttgttag

SEQ ID NO: 36777 - DNA, 633 bp, Glycine max
  Peptide Sequence Number=SeqID_128462
atgactaccttgacccagacgtggatgatgttgctgctcagcaacatcctgcccagcgatcataactccgacctccctctaccgaagtgtcagctggtgtatgccatcctgacacggatgagcgtccatatggctcagttgattgctgacgccatttatttatttacaggtatgccacctaccaggcaccctctagacccagataagtctaacagggctttggggtttccagcattgatcacgagcctctgccagtcatttagggttcctgtcacacctagcaaggccgctgacgcaccgccaccacctcatcaggctgatccagctgggtcattcggcatggagcagtatttacatcacttggttcaccagcaagcagccaaccacagggggcaggtgcagatccatgagtgtctctaccagctcagcctcagtcagcagagccagggtttcgatccttttgcgtgccctactccagatcattttagggctgaggtcgcatggcccggagattggcccggggaccagacagaggaggcacccacaggagctcccgacggtgtagagggcgctcgcttggatgaggagatgacagatttactcgatttcttgggaggaagcggagccacatga

SEQ ID NO: 36778 - DNA, 300 bp, Glycine max
  Peptide Sequence Number=SeqID_128463
atgaagaaattcaaatggtcagaacttttcactaggatgtacgattcaggtgtgtcacatatcgagacgcttgaaattgaacaacggaagctctcgagaaattcaaatggtcataacttttcactcagatgtccgattcaggcgcttcacatatcgagatgcataaaattgaacaatggaagctatgaagaaattcaaatggtcataacttttcacttggatgtacgattcaggcgtatcacatatctagacgctcaaatttcatcaacggaagctctaaagaaatgcaaatggtcataa

SEQ ID NO: 36779 - DNA, 178 bp, Glycine max
  Peptide Sequence Number=SeqID_128464
atggaggagttgattaacaaaacacaactctcttcccaaaataatcccaacgtcatcacgtcggcttggcggctcctcaacagaatctcatccctgcaccctactgctgtcattctgctcccacgagtaaggttcacgatcatcacaagtatcaaccacacgatacaaaattgcgagg

SEQ ID NO: 36780 - DNA, 423 bp, Glycine max
  Peptide Sequence Number=SeqID_128465
atgctggcggccagtctccccgcgcttgctgtaacgggcgataccgaccagccgatccatattgagtccgacacccagtctctcgatatgcagggtaacgtcgtcaccttcacgggtaacgtcgtcatgacccagggcaccatcaaaatcaacgccgacaaagtggacaacggcaagccggtgaaaggccgcgctacgcacatgcactatgagctggcgaaggatctggtcatcctgaccgggaatgcgtatctggaacagctggacagcaacattaccggcgaccagattacctatctggttaaagagcaaaaaatgcaggcctccagcgagaaaggcaaacgcgtcaccaccgttctggttccgtcgcagctccaggacaaaggcaagggccaggccccggcacagaagaagagtaactaa

SEQ ID NO: 36781 - DNA, 1147 bp, Glycine max
  Peptide Sequence Number=SeqID_128466
atgctgcgtatgggcttcatcgaagacgttgaaaccattatggcgcagatcccggacggtcatcagaccgcgctgttctctgcaaccatgccggaagctatccgtcgcattacccgccgcttcatgaaagagccgcaggaagtgcgtattcagtccagcgtaaccactcgcccggacatcagccagagctactggtctgtgtacggcatgcgtaaaaacgaagcgctggtacgtttcctggaagcggaagattttgatgcggcgattatcttcgttcgtaccaaaaacgcgaccctggaagtggctgaagccctggagcgtagcggctacaacagcgcagcgctgaacggtgacatgaaccaggccctgcgtgagcagactctggagcgtctgaaagacggtcgtctggatatcctgattgcaaccgacgtggcagcacgtggtctggacgttgagcgtatcagcctggttgttaactacgacatcccgatggattccgagtcttacgttcaccgtatcggccgtaccggtcgtgcgggtcgtgctggccgtgcgctgctgttcgttgagaaccgcgagcgtcgtctactgcgtaacatcgaacgcaccatgaagctgactattccagaagcggacctgccaaacgcagaactgctgggcaaacgccgtctggaaaaattcgccgccaaagtacagcagcagctggaaagcagcgatctggatcagtaccgtgcactgctgtcgcagattcagcctacggctgaaggcgaagagctggacatggaaaccctggctgcggcactgctgaaaatggcgcagggcgaacgtactctgatcgtgccacctgatgcgccaatgcgtcctaagcgtgaattccgtgaccgtgacgatcgctttgaacgtcgtggcgaccgtaacgatcgtggcccacgtggtgaccgtccagagcgtggtggtgaagaccgtccacgtcgtgaacgccgtgaagcgggcgatatggaactgtaccgcattgaagtgggccgtgatgatggtgttgaagttcgtcacatcgttggcgcgatcgctaacgaaggcgacatcagcagccgttacatcggtaacatcaagctgttcgcatcccactctaccatcgagctgccaaaag

SEQ ID NO: 36782 - DNA, 549 bp, Glycine max
  Peptide Sequence Number=SeqID_128467
atggcgacggcaacggcaacggctacagctacagacggcaacagcaacaccctggaattagaaatcaggtcaatggttcaatatctagacactgcatcacggacattgacgcatacaattgtgtttgatgaaggtatcatccatctagggttgttcaattcaatatgcttagacaatgatggcctccttgttgctaaggattatggttattttacaaataagtgtcatagtacatgggatgaaatctgttatgggaaaaacattggcttctacactctaagtcctatgaagcaatacagacttgggggctacagttatggggattactcagttagatatattaggccgaacagatgtaaaggaccatatgagataactacaagttgggccatggttgtgaaattcgtgctacttccgtggaaaccacaattgatctttacagaaacttccattatgggcattaacccagaaaatggcaagttttacagccatgtggtaggttccaactatctcgtagtggtgttgtgctatcaagtgatgagtttttaa

SEQ ID NO: 36783 - DNA, 162 bp, Glycine max
  Peptide Sequence Number=SeqID_128468
atggctgaagatcttttgcaggttgtcgcaacgtgcccttcgcaggcgagcgagggcgaggctcacgggtgtgctttccaaaggaggaaagatgcgcggagtcgccaccaacgtttatttgtggaaaacgtcggaaaaaccgaaggaaaccggtcaaaatga

SEQ ID NO: 36784 - DNA, 288 bp, Glycine max
  Peptide Sequence Number=SeqID_128469
atggctccgaagaaactctccacgaagaggtctagaagggacgccactggagaaggctccagtgccgcctcagagtttgatagtcactgtttccagagtgccaagcaccagcagcgcttcgaggccatcaagggatggtcattccacagggagaggcgtgtccagctcatggaagacgagtaccctgacttccagggagagatagctcgcaggcattggccacgactagtgacccctatggctaaattcgacccggagatagtcataaaattttatgccaatgcctag

SEQ ID NO: 36785 - DNA, 984 bp, Glycine max
  misc_feature (888)..(888): n is a, c, g, or t
  Peptide Sequence Number=SeqID_128470
atgaaaatactgaagacagtttccggccttgctgccgccgctgccgtttcccttttcgcgctgtccgcatccgctcagacctatcccgagcgtaacatcaccatggtcgtgcctttctcggccggtggcccgacggacacggtggcgcgtcttgtggctgaatccatgtcgaaggatctcggccagcagatcatcgtggaaaatgtcggcggcgccggcggcacgcttggcgctggccgcgttgcctcggcagatcccgatggttacaccatccttctccaccacatcggcatggcgaccagcgccacgctctatcgaaagctcgcttacgacacgacaagtgctttcgaatatgttggtctggtcacggaagtgccgatgaccatcctgtcgcgcaagaaccttgagaccacggacctcaaggggctgatcgattacgccaaggcgaacaaggacaaggtcaccgttgccaatgccggcatcggcgcggcctctcatctgtgcggcatgctgttcatgagcgccatcgagacgccgctcgttacagtgccctacaagggcaccggccctgccatgaccgatctgctgggcggccaagtcgacatcatgtgcgaccagaccaccaacaccaccaagcagatccagggcggcactgtgaaggcttacgccgtaacctcgccgaagcggctggatgtgctgaaggacgtgccgacagttgccgaagctggcttgcccaaactcgaagtcggcatctggcacggcatctacacgccgaagggcacgcctgcggaaatcaacgaaaagctctccaagtcgctgcaggtggcgctgaaggacaagaatgtcgcggcccgttttgcggaactcggcaccacgccgtcgccgganagcgatgcgacaccggcggcgctgaaggccaagcttgagagcgaaatcgcccgctggaagccggtgattgaggctgccggctcatatgccgactga

SEQ ID NO: 36786 - DNA, 730 bp, Glycine max
  Peptide Sequence Number=SeqID_128471
tcaagattaagggcctagattatcacagtattaggagtggggcggtgatgggactctccgaatgcaagcctttcgcaaggcacttccaattagtaccgactgttgaagaatttgaggagattctaggatgtcctcttaggggaaggaaaccgtatcttttctccgggttttttccctccttgagcaaggttacagttgtggtcagggattcagcgagaggattggatcgcgtaaagcaaactcggaatgacatagtgggtttaccacggaagtacttagaagacaaggcgagggatatggcgaatcaagaggagtgggtcccgtttatggacgtattagcattgctaatctttggggttgtcctctttccaatcgtggacggtttggtggacctagccgcaattaatgctttccttgcatatcaccgtagcaaagagagcccagtggtagctatcttggcggacttatttgacacatttgaccgaagagtagattgggaccaacacttggctgggataggaggcagaatagtcaactggtttccacgatggaaggaaggaaatgagggagttctcttctcatgtgggggctacccaaacatctcgttgataggaacgacgggttgcattaactacaattccgcacttgctataagacagttagggtaccccatgagaggagcaccgacggaagaaagcctctctcctttccttgtgagagatttcggcac

SEQ ID NO: 36787 - DNA, 978 bp, Glycine max
  Peptide Sequence Number=SeqID_128472
atggccaagttcgatccagagatagtcctcgaattttatgccaatgcttggcctacagaggaggccgtgcgagatatgaggtcctgggtgaggggtcagtggatcccgttcgatgcagatgctatcggccagctcctgggatatcctttactgctggaagagggtcaggagtgcgagtatagccagaggaggaaccggtccgatgggttcgatgaggaggccatcgcccatttgctatgtataccagggcaggattttgcccggacggctgccgggaaacgggtgcggatcatgcgcaccaacatgaccaccctgactcagatctggatgactttgctgctcagcaacatccagcccagcgaccataattccgacctccccctgccgaagtgtcagctggtgtacgccatgctgacgcggatgagtattcacgtggctcagctaatcgctgatgccatctatatatttgcaggtatggcgcctaccaggcaccctctggacccggataagtccaatagggccctgagatttcccgccttgatcacaggactctgccagtcgttcggagtccctgtcgcacctagcaaggtgattcggccgcccatcacccgagcttttattgagaagtattgcacgcagagacaggtccagggggatgctccgcaggccgcagacgcgccgccacctcatcaggccggtccagccggattgtttgatacggagcagtatttgcggcatttggttcgccagcaggcggccaaccaccgggcacatagccagggttttacttcttttccgtgccctactccggaccagttcagggcagaggtcgcatggcctggagattggcctgaggcccgggcaggagaggcaccaacagaggcaccagcagaggctcccgacgaggcagatgaggcccgcgaggacgaggagatgaccgatttacttgatttcttaggaggaagcggggccacatga

SEQ ID NO: 36788 - DNA, 588 bp, Glycine max
  Peptide Sequence Number=SeqID_128473
atggggacgaggggttgtattaactataatcccgtacttgccataagacagctagggtaccccatgaggggagcgccaacggaagagagcctctcgcctttccttgtgagagatttcagggcgcaaagtctcaaagttgtacaaaaagtccacaaggcgtggagaagtccgttgaggaaagataaagaacttaggggcatccataatggcatcatcggtggttatcatgaatggctaagagttcatacgcgagggttagattggctctccaagttgaaagttatcaatgaggagaacttcgaagcttcggaagaggatgaagaagtccaagctctaaaattagagctagggaaggcaagactcgccaaagaaaaattcaagtcagccgctacaaacatccggaaagagtgcgccgagttacgagaggaaaacgcggctactgcaagagcccttgaacagaaaccaagagggctcgcaaggaagagcatggtcgagataaattccgaggagctttgtggggcagcaacaatgagctcaagctccggagagaggaaagagaccagtcatgagtacatagcatggtcttaa

SEQ ID NO: 36789 - DNA, 228 bp, Glycine max
  Peptide Sequence Number=SeqID_128474
acacttgttagcattgccacacttcttaggcttgagtttattcctcaagtaaaggagttgttggatgagggtttggttcgcaagagcttaagtccgtgtgcgttgttggtgcccaaaataggttttgagggaaggagcccagagtatgaagaacctcgggatttgaggtcaaatcctttccatggtgaagggactgatgcaatcctaccattcaagggcattgggtag

SEQ ID NO: 36790 - DNA, 429 bp, Glycine max
  Peptide Sequence Number=SeqID_128475
atggataatgaagagggcgtgcaggaacagatgaaggtcgatctatcggccttaaaagatcaaatggcttccatctcggaggtcatgttaaaactccagaaaactatagaggataaagccacggcaaccgcctccagtatagttcgggaagcggagccggtgctgcagcccgccttaaatccgggccgagatagaaacacggaagtgtttggtcgaaggtatagcccgcaagcttatccttatggcttgcttccggacttcactccccgtgccaccccggaagatttaagccaagcccctactttcgaggggcaactcccaccttatgacgactatcccgggcaagacgatgaggaaggagatacccatctcggtcccctgctccacctcaaagatccgttcccccatgaactaccccaaccaaacata

SEQ ID NO: 36791 - DNA, 334 bp, Glycine max
  Peptide Sequence Number=SeqID_128476
atgatattatgcttctatctagaggagatatcccttctgtgtcaactatgtttgccaagcttcaacacttctgtagggtttcagggctttccatcagctctgataaatctgccatatactcacccggtattaggcctcatgagctttctcatattcagcagcttactggatttagcttgggtaagttaatcagagcggttattcaagaaattgtgaatttctggatgggaatttttcctttgccgcaatctgttctggaccggatcaacgctttgtgccgtaattttctgtggggcaaagcggatattggcaaacacaagcccttggttgcttg

SEQ ID NO: 36792 - DNA, 537 bp, Glycine max
  Peptide Sequence Number=SeqID_128477
atggcttccaactcccagcaatttagtgctagaagtaatgctattgtcattagaggagtgcatgaagtagccacaaagtcatcctcatcaggcgagactaagaagcttgaaggtaaattggatgtcttggttaacctggtaacccaactagccatgaataaaaaatctgcacctgtcgccagactctgtggtttatgctcctccatcgaccaccacacagacctttgcccttctgtgcaacaatctgaagcaattgaacaacctgaagcttatgctgcaaacatctgcaacagacctcctcaacctcagcagcaaaatcagccacaacaaaataattatgatctctccagcaacagcccatacgttcctccaccaatccagcaacaacaacaacaacaacaaccccagaaacagcaaacagttgaggcccctctgcaaacttcccttgaagaacttgtgaggcaaatgactatgcaaaacatgcagtttcaacaagagaccagagcttccattcagagcttaactaatcagatgtga

SEQ ID NO: 36793 - DNA, 664 bp, Glycine max
  Peptide Sequence Number=SeqID_128478
aggactgcatgtcctcaccttcagagggctacacgccctcgccatcagaggactgcatgtcctcaccttgagaggactacatgtcctcaccatcagagggctgcacgccctcacctccagaggactacacgtcctcccctcaccttgggtactagttaccctcaccgttgagaggactacacgtcctcgccttgagaggactacacgtcctcgccgtgagaggactacatatcctcgccatcagaggactacatgtcctcgccatcagaggactacatgtcctcgccatcagaggacttcatgtcctcgccatcagagggctgcacgccctcaccttcagaggactacacgtcctcgccttgagagggctacacgccctcaccttggaggactacacgtcctcgccttgagaggactagcacgtcctcaccatcagggggtgggctacacgccctcaccttgggtactagttaccctcaccgttgagaggactacacgtcctcgccttgagaggactacacgtcctacaccatcagagggctgcacgccctcacctccagaggactacatgtcctctgccttagagggctacacgccctcaccttgggtactagttaccctcactgttagaggactacacgtcctcgccttcagagggctgcac

SEQ ID NO: 36794 - DNA, 234 bp, Glycine max
  Peptide Sequence Number=SeqID_128479
atgagtcttcatttttcatctagtgttaatgatgagggttctactcctaaagaccccttgtataagatattagatgagttgagatcccttaagttgtggaaagaaaaacaagagagaaaagaaaaagcgaagagagaaaagttccattggctacccttagctttcaagggtatgccctatattggtggacttcccttgttagggaatgaaggattcatggggatcctccagtag

SEQ ID NO: 36795 - DNA, 192 bp, Glycine max
  Peptide Sequence Number=SeqID_128480
atgggggtgcaaatagcaatcaggcccacttgggtcctccagaaggctgttgcttctggaggaagcaaccctgctcgcctgggcgagctgggtggcaagcttctcccccaattttctataaatagggggagaagtgaagttttcgaccgttcttcgacgttcttcattcgttcttcagtcttcaacgggtaa

SEQ ID NO: 36796 - DNA, 408 bp, Glycine max
  Peptide Sequence Number=SeqID_128481
atggtcgatgccagccagctgcgcgttgtcagccaacgtcagccaaccgaacaggaactgcgtgacgcgctgttctgctggaaagtggcgaaattcgttaaatccaacgccattgtgtatgcacgcgacaacatgacgatcggtattggcgcgggccagatgagccgcgtttactctgccaaaattgccggcatcaaagccgctgacgaaggactggaggtgaagggttccgccatggcttccgacgccttcttcccgttccgcgatggcattgatgccgcagcagcagtgggcatcacctgtgtgatccagccgggcggttccattcgcgatgatgaagttattgctgccgccgacgagcacggcatcgcgatgatcttcactgacatgcgtcatttccgccattaa

SEQ ID NO: 36797 - DNA, 261 bp, Glycine max
  Peptide Sequence Number=SeqID_128482
atgacggtgaaaacctctgacacatgcagctcccggagacggtcacagcttgtctgtaagcgtatgccgggagcagacaagcccgtcagggcgcgtcagcggatgcgtaaggagaaaataccgcatcaggcgccattcgccattcaggctgcgcaactgatgggaagggcgatcagagcgggactcttagatattaatccagctggcgaaaaggtatcaagttgctcggcggcaacgaaatctacatgcggatcaagttga

SEQ ID NO: 36798 - DNA, 68 bp, Glycine max
  Peptide Sequence Number=SeqID_128483
gatcccacgaaagcgtaataactcacctgggatccactcgaattcgtcaaagaaagattggatcccag

SEQ ID NO: 36799 - DNA, 225 bp, Glycine max
  Peptide Sequence Number=SeqID_128484
atgggctcaaaatctaccctaaggctcatgagaaccctagggccttcccttcgatccctagccaatctacttggagtcttctacccaatgcccttgcggggtaggattgcatcaaacactcaggagcgcaggtcgcttgagcaaacaaaccaatggcttgcaccctcattccagtggaagttgaataagcatagatgtgttcgtgagaggatgagggacaaagat

SEQ ID NO: 36800 - DNA, 949 bp, Glycine max
  Peptide Sequence Number=SeqID_128485
atggctaaagtgatgcgcgcaattatcgtgggtggaggcattggcggtgcagcgactgcgctctcgttggctcgccaggggattaaagtgatgttgctggaaaaggcgcacgagattggtgagattggggcgggcattcagctcggacccaacgccttttccgcgctggatagcctgggtgtgggcgacgttgcacgcgagcgcgccgtctttaccgatcacataaccctgatggacgcggtaaacgcccaggaggtagtgcatattgagaccgggcaggcatttcgcgatcactttggcggtccctatgcggttatccatcgggtggatatccacgcatccgtctgggaagcggtattaacccatccggatgtggaataccgtacctcaacgcaggtggtgagtatcagccaaacgacggatgatgtgacggtatttgatgagcagggcaatcgctggacggcggatattctgatcggctgtgacggcgtgagatcggttgtgcgccagtacctactggaggatgcgccgcgggtgaccggacatgtggtttaccgcgccgtgattgattgcgatgagatgccggaggatttacgcattaacgcgccggtgctgtgggcggggccgcactgccatctggtgcactacccgctgcgcggggggaagcaatataacctggtggtgacgttccatagccgtcagcaggaggagtggggggtgaaggacggcagtaaagaggaggtgctctcctatttttccggtattcacccgcgtccgcgtcaaatgctggataagccgacctcgtggcgccgctggtcaaccgccgatcgtgagccggtggagaaatggggcaacgaccgtatcacgctggtgggacatgcagcacacccggtggcacagtatatggcgcagggagcctgcatggcgctggaggatgcggtaacgctgg

SEQ ID NO: 36801 - DNA, 411 bp, Glycine max
  Peptide Sequence Number=SeqID_128486
atggctttgaattcctatttacttacggcaagaaaattgaaaaacgggaaaatcttgagaactattcgaaactcagaagaattacgggaaggggccattgaacagctggaaaaagcccaagcccgcttaaggaaagtcgaaacggaagcagatcgttttcgggtgaatggctattctgagatcgaacgagaaaaattgaatttaattaattcaatttatacgactttggaacaattagaaaattacaaaaacgaagccattcattttgaacaacaaagagtgattaatcaagtccgacaacgggttttacaacaagccttacagggagctctaggaactctaaagagttgcttgaacaacgagttacatttacgtactgtcagtgctaatattggcatgtttggacgatga

SEQ ID NO: 36802 - DNA, 308 bp, Glycine max
  Peptide Sequence Number=SeqID_128487
tatgctctttcggataccacaaagagagggatggctcttgggtgaagaaggatgctccagtacgagccactaaagactgctctccatcaccacctcctcagagagatgattcttcatctcttatgcacaacattcttgacaggttggatggactccacaccttcgttggtgaacgctttgacttgttggattgccgtattaatgccatggatgcacgatttgcagggatggacacacgtatcaccaaacttaaggaggatgttagctttgttcgtcagtgctttgaccttccaccaccatccacatag

SEQ ID NO: 36803 - DNA, 222 bp, Glycine max
  Peptide Sequence Number=SeqID_128488
atggagaggagtatgattgatgctgccagtggtggagctcttggtgatatgactcctactgaggctaggaatttgattgagaagatggcttctaactcccaacaattcaatcaccatacagatctctgtccttctttgcagcaatctggagtcaatgagcaacctgaagcttatgctgcaaacatttataatagactccctcagcagcaaaaccaacaatag

SEQ ID NO: 36804 - DNA, 131 bp, Glycine max
  Peptide Sequence Number=SeqID_128489
gataagatagaacctgtatcaagagccgaagctctgataccagatgatgtgaacctgagtaggagtggatcgcttgatacaggttatagagtttggatgacgccacttccggttaaggaagataagtccgg

SEQ ID NO: 36805 - DNA, 335 bp, Glycine max
  Peptide Sequence Number=SeqID_128490
gggttcccatgaaccctaagagaataaaggtcattcctgagtggcctgctccaccaagtgtaagaaaaatttggggcttccaagacttagcaaacttttacaaaaggtttgccccatatttttctatacttgtagcaccactcattgagttggtgaggaaccatgttccttcatgggaagatgcccagaaaatgagttttcagaccttaccttacttcaacatactaaacattagggtattggatagaaaactccaagtagattgggccagagatgcaagagaaggccctagggttcttatgagccttagggtagatttcgggcccatgggctaa

SEQ ID NO: 36806 - DNA, 265 bp, Glycine max
  Peptide Sequence Number=SeqID_128491
atgttgaatccagctcagtttcaggccaaagaagaaaaggtaaaagctgctaatgactcactcagcgaggcagatctgctcagcgagatgcatccgcttaacgaggcatccaactcgcttagcggatgggaaaccctagaagaggataagtcagagatttccacgcctaatgagcagccagcctgcctagtgtggatgttgtctcttctcgcactcagggcgccccctctcgctaagcaaaaattcactaactatcgcttagcga

SEQ ID NO: 36807 - DNA, 477 bp, Glycine max
  Peptide Sequence Number=SeqID_128492
atggcctcttcaaatcctttgtttcctgaaggaaattccattcatagaccacccattttcaatggtgagggttaccattattggaaaacccgtatgcagattttcattgaagccatagatttaaacatttgggaagcaatagaaattggaccatacatacccactgcagtagatgtaagcacaagcaccacaacacaaaaacctagagataagtggacagaagaagatagaagaagaatccagaacatgagatggaacttcaacgtcttaatcagaatgaagaaaactgacaaaaagaaaataagtatagcacttaaaacctcatcatcaatgcaagaagaaaatgaagaagaagattcagatgatgaagaagactcctcactctttgtgaagaagtttcaaaaatttgtcaagaagagaagaatcgaaaggcgtcagaacttcaacaatggaagaagatctcaagaagactctcaa

SEQ ID NO: 36808 - DNA, 132 bp, Glycine max
  Peptide Sequence Number=SeqID_128493
atgccatttttgtttctcctcctttattcttttgcgtccgtccatattttgtttcacgatagtctaacgacggtgctgaaggttacgaggctttgcccatggaagagttgggataggctactaaaagaataa

SEQ ID NO: 36809 - DNA, 135 bp, Glycine max
  Peptide Sequence Number=SeqID_128494
atggccaaaatacaagacccatggaagaaagctggatctttcttcaatgaggtccttcggggtgattttccctccaccatggagatgcagcggaagacaaaggagcaagaggtgagaggaggcaccatccattaa

SEQ ID NO: 36810 - DNA, 516 bp, Glycine max
  Peptide Sequence Number=SeqID_128495
atggttagattattaccacctcgagatagtctaacattatctacctcatccttgtcttctgtgtctatcccagttaggcctcccgatgttgcacctacaccatctccacctccgactaaagctagaccatcttcatctcatgttaatggacgtggaccatctcaggtacatgcatccaccccatctctatcctacgttgatgcacgtggaccgtccccagtacctacatccacacctttcccatccccgcctgtgggcagtatgcctacaaatgaagatactataaatttggcaatggaagacccttcccttaatgatcgtcctatggttacgctaattaatcgagcgtttcatccatctaatgttgcggcaaaggctgtcactttgtccattaggcaacaatttggtcagccttggcctacatggggaacgattccaaaagatcaaaatgaacttctttttttagtgtttataagagaaaattggtctggagacccgaggaagagaatgaaataa

SEQ ID NO: 36811 - DNA, 643 bp, Glycine max
  Peptide Sequence Number=SeqID_128496
atgggatcaagtcaaatgccttcacttaaaaggaggttctatcaagtcaaggtcaagagcctagggaccaccagtctaaaggagttagggcagttaatgggtcagctccagcggcaagcttttcacaaagcttacggtaaaatctgggacttagccatggtagaagtcaccacagaggccattgccttcctcgcccagtattatgatcagccgttgaggtgcttcacctttggggacttccagctatcacccatggtggaagaatttgaagagatcctaggatgccctctaggggggaggaaaccatacctcttcacagggttatatccctcattagctagaatttccaagatagtccaaatctcgacgcaggaattagaccacaggaagcaagtcgaaaatggtgtggttggaataccaagaaaatatttggaggcaaaagcaagaatcctggcaggtaaaggcgagtgggccccattcatagatattcttgcactgttgattttcggaggagtcctctttccgaatgtggatgggttggtggacctagcagcgatcgacgcttttctcaccgatcataaccacaaggaaagcccggttgtcgctatgctagccggcctatatgacaccttcgaccgaagat

SEQ ID NO: 36812 - DNA, 607 bp, Glycine max
  Peptide Sequence Number=SeqID_128497
tctcggtgagctcgatggcgtaccaggacggcgtgccgtcgtcaccgacccgataggttcctggagcgaacagcacgcgggcggagttcttcggcgcggcggccgtccatgccgcggcatcggcgatcgtctgccggatcgcggggccgctgtccggctggccggggacggcgccgcggctcgatacggggaagtccctgcggaacggcgtgccgccggcggcgacggggccgccggcgacgacgctcgttccggtcgtcgccgccgtagcgggtgcggccagggcgacgctccccgccccgacggcggtgccgacgagcagggtgcgacgcgtgatcgtgcggaccccatgaccgcactgcctccggccctccccgcacccgatccagccgaagcgcggttcgtcgcgggcgagcccgccgaactgccccccttctccgccgacgtgtggtcggggcgatacgtcccgcgcgggatcctggtgccgttccgcgggcaggtcggcacccccgcgccgtatgcgctcgacacggcctcgctggtcgtgcgtcgcggcggcgcgctgttgcgcgaggggacggactacgtggtcgatgccgtctacggc

SEQ ID NO: 36813 - DNA, 150 bp, Glycine max
  Peptide Sequence Number=SeqID_128498
atgagtgagataggaagatttggaggtttgggaatggaggaacgtcgcaaggaggaaggggctgcgcagggatttctggaaaatgtgatatttatagagcatgacgcgtggccatctgttctagtggaatcgattacagtattcatgtaa

SEQ ID NO: 36814 - DNA, 270 bp, Glycine max
  Peptide Sequence Number=SeqID_128499
atggagaacaaaaagaacgatatgttcattatgatgctaagagatgtttatgcggtgcatgatatgaatgcatttacggacacgagagcccgaaaattatctctctttactgcgcatttgggggcgcagtgccccatgtgtgcagttaagaagatgatatggatctttcgacttcccacgacaaaagacgagacccacatacaatgcatgtgtgacggcatgatgcatatgcgcaacagggggatgcacaaagtacgacaatatccataa

SEQ ID NO: 36815 - DNA, 842 bp, Glycine max
  Peptide Sequence Number=SeqID_128500
atggccttgagaaagcttccatcaaagaggtccaggaaggacaccgtcggagaaggctccagcactgccccacaggctgatgtagacttcgacaagcatcgattccggagcgccgaacatcagcagcaagtccagctgagggacgatgagttccctaattttcaggaagagataggccacaggcgttgggcgccacttgtgacacccatggctaaattcaacccggagatagtcatggagcgcccacaatcagttcttaggccacctgctgatcttggaagagggtcactagtgcaaattcagccagaggaggagtcaggccatcgctcagctattgtgcataccggggtaggatttcgctcgaatcgctatcaggagatgggtgcggatcctgcacaccagcatgaccaccgttacccagatatggatgaccttgctgctcagcaacatcctacccaggacaaggcctacgagacaccctatagactcgaagaggtccaacagggccctggggttcctagctttgatcacgggcctctgccagttctacggagtgcccgtcgcccccagcaaggtcattcagcctcccattacaagagccttcatcgagaagtactgcatcctcaggaaagcgcagggctaggcaccacagcagcccgaggaagattagcaaccaacggcagatgcgccacttccgccacaagaggaggcaccatctttgagatgttctatcgttacaacttgcaccagcaaagtcaagaccctagtcttttcccttggcctactcccgagcagttcgaggccacagtgacctggcctggggacgagaccgagtttgagac

SEQ ID NO: 36816 - DNA, 255 bp, Glycine max
  Peptide Sequence Number=SeqID_128501
atgtcattgcctagtgctgttcatgtgtcctccaccttcgagattggagctatgcttcatgattgcctaagtgtggaccctcaagtgcaatcctccattcaccactttttcggagccccacgaatgtcattgcgtagcgctattcatatgtcctccaccttcgagtgtggagccccgcgaatgtcattgcctagcgctatttgccaattctccattctccacttttttcggagccccatgaatgtcattgcctag

SEQ ID NO: 36817 - DNA, 141 bp, Glycine max
  Peptide Sequence Number=SeqID_128502
atggagaattggcggacagcgctacgcaataactttgcggggctccagactcgaaggagaatggagaattggcgaacagcgctacgcaataacatcttggggctccagactcgttggtggaggatacatgaacagcgctag

SEQ ID NO: 36818 - DNA, 225 bp, Glycine max
  Peptide Sequence Number=SeqID_128503
atgaagtcaggtgacatgcgggggtaccgtatggttatccgcacctttcgtcaaccaggggcaaacgagcccattgaagctcagagactaacatcgtcttttgcaccttttgtcatccagggacagcgagtcaggtggcaggtggagataccttatggtcatccgcacccccccccccccttttcccgaggcaaacgaattcgacggtttactctagtgtcctga

SEQ ID NO: 36819 - DNA, 363 bp, Glycine max
  Peptide Sequence Number=SeqID_128504
atgcaagaagaagaagaaaaagaatctgatcatgaagaggatttctcactctttgtgaagaagtttcataaattcgtcaaaaatagaagaatggagagacgtcataacttcgacaatgggaagagatctcaagaagtttccacaacacttaaatgctataagtttaatcgacccggtcacataaaggcacactgccccacaaatgaatcatggccaaaaaagaatgagaagaaaagccatgaagaaagaagatccaagaaggcgtatattgcttgggatgacaatgactcatctgatggttcggaaaaggagatgaacattctatccaaggactatgaaagcgatgagaacatctctcaataa

SEQ ID NO: 36820 - DNA, 1665 bp, Glycine max
  Peptide Sequence Number=SeqID_128505
atggtcggcctgatgctgcgcgtcgcgtacctgcaggtcatcaaccccgatcgtctggtgaaagaaggcgacatgcgttcgctacgcgtgcaggaagtaccgaccgcgcgcggcatgatcagcgatcgcgccggccggccgttggcggtcagcgtgccggtcaatgcggtgtgggcggatccgaaagagctgaacgagcgcggcggcatcacgctggacagccgttggaaagcgctttccgatgcgctgaacatcccgctggaccaactctcaaaccgcatcaacgctaacccgaaagggcgcttcgtttatctggcgcgccaggtgaacccggcgatcggcgactacatccacaaactcaagctgccggggatctacctgcggcaggagtcgcgccgttactatccggcggggcaggtgacgtcgcatatcatcggcgtgaccaatatcgacgggcaaggcatcgaaggcgtcgagaagagcttcgaccgctggctgaccgggcaaccgggcgagagaacggtgcgtaaggaccgcttcggccgggtgatcgaagatatttcctccgtcgacagccaggcggcgcacaacctggtgctgagcgtcgatgaacgcctgcaggcgctggtgtatcgcgagctgaacaacgcggtggcgttcaacaaggccgagtcgggcactgcggtgctgatcgacgtgaacaccggcgaagtgctggcgatggccaacagcccgtcttacaacccgaacaacatggccggtacgccgaaagagaccatgcgtaaccgcgctatcaccgatatttttgaacccggttcaaccgtgaagccgatggtggtgatgaccgcgctgcaaaacggcgtggtgagagaaaacagcgtgctgaacaccatcccgtaccgcattcagggccacgagatcaaagacgtggcgcggtactcggagctgtcattgaccgggatcttgcagaagtcgagtaacgtcggtgtttcaaagctggcgttagcgatgccgtcctcagcgttagtagatacttactctcgttttgggctgggaaaagcgaccaatttggggctggtcggagaaagcagtggcatatacccaaaaaaacaacggtggtctgacatagagagggccaccttctctttcggctacgggctgatggtaactccgttacagttggcgcgagtctatgcaacgatcggcagcctgggcgtgtatcgcccattgtcgatcaccaaggttgaccctccggtcgccggcgagcgcgttttccctgaacctctggtgcgcaccgtggtgcacatgatggaaagcgtggccctgccgggcggcggcggcgtgaaagccgccatcaagggataccgtatcgccatcaaaaccggtaccgcgaaaaaagtgggcccggacggcaaatacgtcaaccgatacatcgcttataccgccggcgtcgcgccggcaagtaacccccgttttgccctggtggtcgtcatcaatgacccgcagggtgggaaatactatggtggcgcaatctccgcgccggtgttcggcgccatcatgggcggcgtattgcgcaccatgaacgtcgagcctgacgcgttgcctaccggtgacaaaagcgaattagtgattaacaagaaagagggttcaggtggcagatcgtaa

SEQ ID NO: 36821 - DNA, 57 bp, Glycine max
  Peptide Sequence Number=SeqID_128506
atgcagtatctaggaagtgatcctaggttgtctccaacgagcaatggtcaaccaaac

SEQ ID NO: 36822 - DNA, 756 bp, Glycine max
  Peptide Sequence Number=SeqID_128507
atgcggaggaactcgcctgcctcctctagcgatacttctttcttgccacaaccgtcctttttctccgaaagacctttcactggaatattctcgttcggagtggggattattttgtcattttgttcttcctctatttttggcttccctttaacatttgaggtttgtgtcggcaggtcagggggtgagaacacgctaccgctgcgggtcacgtcgctcagccccgtgatattggttaccttggccgacaacgagctgatgtcgggggcttcttccttcctttcgcttggaggcgcatacctccacggaactgcgtggctgttttggcttaggccttccaaaacttccctcatctgcgcactgcatacatatatgctgctcttcactcccctcatcgctgacttccagccggcctcggtctatcatctgttgcaacagggcctcgtagataaacctcctgggtgtcgtcacgtccttcaaaggcttggacctacgtggcctacccgactcgacggcattaccttctccccctccatgattggcgagcaggttcgttttgacgttgggccggtcctcttgaaacgtcagccatccgacgtctatcaaatgttggaccttgtatttaaaggccaggcagcgttcggtggagtggcccaggattttcccatgatcttcccgggagatatcacagccatctggttggtgatgagggatggcaagaggtcttcgtacgtcattgggatcggggtgaattcttga

SEQ ID NO: 36823 - DNA, 291 bp, Glycine max
  Peptide Sequence Number=SeqID_128508
atggtcacgccgcgcacaccacgagtcgtccctcgggccccgcagacggatatccctcatgtgccagaggcaggagcatcgtccacatctgcggaggagcctagacatgcagtggaagtttgtgatgacattgttgagaggttggagcgccatctgagtctaggggtggtcacgcctagctcatcgacacatgaggtgatcgaagaatgcctcagattggccaggagtgtgacacaggaccatctagtatactctaggtgtagacgcaggcggcgcactgatcaggcgtag

SEQ ID NO: 36824 - DNA, 147 bp, Glycine max
  Peptide Sequence Number=SeqID_128509
atgttagccaccaagggaatcaaggagcttgaaaagaaatttatgaagaagcatgataaaggcaaatggtcattaaagaacaatgacgactctttgcaaatccagaagaaagagattccttacaattcaaaccataagcccaaatga

SEQ ID NO: 36825 - DNA, 213 bp, Glycine max
  Peptide Sequence Number=SeqID_128510
atgtcagtgaaaaacctcggcgggcgcctaggagtacatgacaagacaaaccacacaataagtcaagtcactcttactagaatgctccaaccatatgggatcaacataggcttaaaggagcactcaaaccgtgtgacccccaaggcctacactccgaagagtccgtcagggcctctccctcctgattcaggtccaacccagaaaacattttag

SEQ ID NO: 36826 - DNA, 529 bp, Glycine max
  Peptide Sequence Number=SeqID_128511
atggcaccagttgatgtagaggacactggggcagacattccagcagacacaggcgcgcaggctgctgaggatgagcatgagggatttccgggtggtccgagtgacccattcgtgctgacccagtatgcagatcacgttgcttgcagcgtatggacgggagataagcgtcctgagttgaagttatcctctcacgggaggaaggtccatagtttaggcaggcctgtccttgccattgagggactagttgctgggacaagactatgtcctctgatcgcgtgtttggtagacactagcgatcggggacttttgtcatcgtttgtcgagcgatggcaccgggagacgtctagtttccatctccctgtgggagaggtgatgatcacgctggacgacgtctcctcacttctgcatctgctcgtggctggcgacttgcacgcctttcagcccttgcacgtggatgatgcggttcagatgctgatggacttattgatggtctctgcagaggttgccagggttgagacagggcagtgtc

SEQ ID NO: 36827 - DNA, 397 bp, Glycine max
  Peptide Sequence Number=SeqID_128512
atgtcaaatcataaaagcactgagtcagcactgaagaaccttgagctccaagtgggacaattggccaagcaaatagctgataagtcatccaacagttttgtggaaaatagagaaaagaatccgaaggaggaatgtaaagctgtgatgacaaggagtaaaaggtttgtggaggctgaggatgaggagagtgttgggcataagaacaaagctgctgaaaagaaaggtactgatggcaagaaaaatgaggtgagaggtgaaagcaatcaagaaaaagagaaacaaataatggtcaagaaaaatgaatttaatgaccaagaaaaagaaaataaaaaaattgaaaaagatgaaaaaaatgaaaatgaagagaagagtagaagtgataaagctgtaaatgaag

SEQ ID NO: 36828 - DNA, 315 bp, Glycine max
  Peptide Sequence Number=SeqID_128513
atggttaaggaggagtgtaaggagacacttgttagcactgtcacacctcttgggcttgaggttattcctcaagtaaaggagttgttggatgagggtttggttcataagagcttaaatccttgtgctttgttggtgcctaaaataggtattattagtcaccaaatccctaaaataggtgatatgatgaatgtgttgagtggtgcaaccctcttttgtaaaatcactaatgcacccaacatcttcatgattcgtgtacatagcgactcattaggtaggtttcaatacaaacctaggtgctcatatgggataccttag

SEQ ID NO: 36829 - DNA, 327 bp, Glycine max
  Peptide Sequence Number=SeqID_128514
atggcaccgaagaagctctccacaaagaggtccaggaggaacgcccatggggaaagctccagcgcctccatggagttcgacagtcaccgggagaggcgcgtccagctcatagaggatgagtactcagacttcctggaggagatagcatgcaggcattggacacctctagtgactccaatggccaagttcgaccctgagatagtcctagagttctacgctaatgcctggcccacggaggagggaacttctggctttgacgaggaggtcatcgcccagctattgtgcatatcggggcaagactttgcccggactgctgcggggaggcgg

SEQ ID NO: 36830 - DNA, 1969 bp, Glycine max
  Peptide Sequence Number=SeqID_128515
gttttgccgcgccttggtgctgatcttgaacggcatcacgcccatagctcagcgggctcatgaagatctcgctggagttgatatcgcgcatgaactgcacgttgatgtagccgttgccctccatgccggccggcacgcggatcttctgcaccgagctggtggtgtcggtgtggaaccactgccaggcgtaaaccctgtccttctcgatggtgatcaagccgctgccggtataaggcgcgttgatcgccacctcgatctcttcgcccggctggtattccgcctggttcagtttcagcttcagttcggcgttgcgatccagcgaacggctcaggttggcgttgccggccacgctgtaggcgacgcggttgagcgttttgccctgcgcatcttcaatcaccagcacgaagtcgcccggcttatcggtcgccagccgcagatccgcgccctgcccgctcagcgccagcggctgttccgacagctgcacttccttcatcttcgactggtatttgtaaacgcccgaatcctgtttggtcagcaccgaaatgtatttctgctcgatcaatacctgcttcagattcggcagggcgatctgttgcagattcggatcgatggcgatcacgttcagatgccgctccgcgtcgcggttgatgtagcccagatcgccgtccgccttcaccccgatcaggtaatcgtaaggcgaaaccagcgtgcgggcggtcgccgccaccgagcgcccgccgccggcgacgaacgcctccgacagcagctgcagctgataagtggcgtcggcgtaggatttcagatcgagcgggatatcggccgcgccgtgctcatcggtggtgcgatcttccagctcggtttcgaacccgtcgctgttttgccgattttcatagaacgcataatccgggaagcgatcgaagctcggatacatcggccgcagcgtcagcctggtgctcacgcggcgatcctgcgccggagtaccgaacaggttctgcacattgatgctggccttcagctcggacggtttgacccagccttgctgacggttcggcgtcagcgccagcttcactttcagctgatccggttcgaactccttcacattgaccgcggtatggccgagcagcgtggaggtatcgttgtttttgccgatcagatacagatagacgttccactcgccggtaggcgagttttcatcggtggtatagctcagctcattgaaaccgctggcgcccagcgtcagcggcacggtggtcatcagcttgtcgcgcggatcgcggatttcggcgcgcaccggcacgccggccaggccaacgccccagtcggcggcgcgggtgatcaggccgatgttaaaggtatcccccggccgataaacgccgcgatcggagaacaggtaactgctgagcgtgcgcggatcggtcggcgtttgttcaccggcgacgtcgaagcgcgagaagtccagcccgcgatcgttatagctgccggtcggcaggaaggagacatccccctccttttccaccaggaacatcaccggctggcgctcgttggtgtacacgtcgagcgccgggaaacgcacgtggccgtcggccccggtggtttggctgagcagcgtcacgccatttttggccaccaccgacacgttggcgccgctgaccggcgcgccgctttgaatcgactgcacaaagacgtcgcgcgtcttatcctgcgagctcttggcgacgatgcccagatcggtcaccaccacaaagcgcgaatcgccgacgtcgggctgatcttccccagtgctctcgtccggttcctgttctggctcggcgcccgcctcttccgccgccggtttccggttcggctgccattcggacagcgtcagcaggaatactccgcgatgggaactggcgttggtggagagatagcgggagagatcgatgccctgatagttcacttcccccggccgctcgttgttgagcgccgtctg

SEQ ID NO: 36831 - DNA, 531 bp, Glycine max
  Peptide Sequence Number=SeqID_128516
atggggtcaagtcaaaagccttcacttaaaaagaggttctatcaagtcaaggtcaagagcctaggaatcatcagcctaaaagagctagggcagttgatgggtcagctccagcggcaagcttttcgccaagcttacggtaaaatctgggacctagccatggtagaagtctccacagagtccattgcctccctcgcccagtattatgatcagccgttgaggtgcttcacttttgggaacttccagctatcacccatggtggaagaattcgaagaaatcctaggatgtcctctagggggaaggaaaccatacctcttctcagggttctatccctcattagctagaattcctaaaatagtccaaatcttggcgcatgaattagaccgccaaaaacaagtcgaaaatggggtggtcgggataccgagaaaatgtttggagcgaatgggccccgttcatagacattctcgcactgttgatctttggaggaaccctctttccaaatatggatgggttggtggacctagcaacgattaa

SEQ ID NO: 36832 - DNA, 534 bp, Glycine max
  Peptide Sequence Number=SeqID_128517
atgtcggctttgaaagagcaaatggcttccatgatggatgccatgacaggaatgagacagcttatggagaataacatggcctccgttgccgttgttagttcggatgccgaagcagacccagctaccgcacaccatcctctcccaaacgtggtaggacaagaaagaagcacactggggcacatcagcaacccccatttgggatacaaccgagtggcttacccatatggattaccacctaattacacgccaccagtcatgcgtgatgacgcgggtcatgtcccttcccccatcctgaaggggagcctcctcgacagtcggacaaggttcacgaggatcatagagagtatgcccaaggagacatcgatttctaccccgcggttcccgttgaagggccggcacccaacacactgcctcagccaaacctcacgggagaacctcgaaacctcccagcatagccaatattcttgtccacagaaggaccacccccagcagcggaagaaaaaaggaaactcgatctcatcgaagagagattga

SEQ ID NO: 36833 - DNA, 498 bp, Glycine max
  Peptide Sequence Number=SeqID_128518
atgaccggccctctcgatgggccgacctcttgttttctcataaaggtggacccttgggtactagtacctatcttcttcagagggctacatgtcctcaccatcagaggactacacgtcctaaccttcagagggccgcacaccctcgccttcagaggactacacgtcttcaactttagaggactacaagtcctcgtcgtcaaagggtcatataccttcacctttgtagggctacacgccctcaccttcagaggactacacgtcctcgcctttagaggactacacgtcctcgccatcagggactacatgtcccccattttcaaagggcgacacgccctcacctttagaggactgcatgtcctcgccatcataggactacactccctcgccttcaaaaggcggcacgtcctgaacttcagagggctgcacaccctcgcctttagagggccacgtgtcctcattttcagtgtgctccatacccacaccttagaagaatataag

SEQ ID NO: 36834 - DNA, 341 bp, Glycine max
  Peptide Sequence Number=SeqID_128519
accagatcctagagccatccccagcacccatacatgatgatgccataccatctgcaccaacatctgagttagagcagcctatctctcaggattcaccagctgctcagccattagaagagaatgagcatgtgattggaattatgactaaaaatgttagtcaatttgtcagattgattgtgaaggaatgcattgattgtatctcagtgagacttctcgctaagccaatctgccggcttagcgagccatccgctgagtgcaccactcctacggctgagcgtgaggaagaatctggaagaaggatgagctggacacacgcgctaagcgagggctcatcccgctaa

SEQ ID NO: 36835 - DNA, 393 bp, Glycine max
  Peptide Sequence Number=SeqID_128520
atgaatacatcatcatcgaatgtgtctgttgctaacgtcattgaggttccttttgcttatcatagacaatggtcctcaaattatccaagttatgtgttatttgactacgaaggagacaaacactttataaagcttcataaatatggtaaccgattcttttttggcgatggactgaaggaacttaggagaacccatggcattcacaaaagtgttctgatgcattttgttggaagggacaaaaatactactttcagtgtggacattgtgggacctctacaccaaagggcagccacaaccataaggcaccatgtttttaccattgatgtctctgaagatatgatacaacacaattatcaattgatcgtggtagtggtaggcatcacaaatggatga

SEQ ID NO: 36836 - DNA, 213 bp, Glycine max
  Peptide Sequence Number=SeqID_128521
atgaagataaaaagcccaaagaatgatttcaagattgagtcaagaacaattcaagaatcaagagaaagattcaagagaaagtttcatcaagaagattcaagattcaagagaaagtttcatcaagaagattcaagattcaagaataatcaagatcaagattcaagactcaaagattcaagaatcaggagaagacttaatcaagataagtattaa

SEQ ID NO: 36837 - DNA, 69 bp, Glycine max
  Peptide Sequence Number=SeqID_128522
atggcggtggaggcaggtgaagagatgaatgacctgtctaatgctgaagtcgataatgatttggcatag

SEQ ID NO: 36838 - DNA, 450 bp, Glycine max
  Peptide Sequence Number=SeqID_128523
atggttaaggaggagtgtaaggaggtaagtgtttcctccaagaggttagctaagaaggaaagtcattttgcaataaagacaaacgttaaagaaacttcacctcttagacaacctccacatcttctccattgtaaaaagacacttgttagcacttccacacctcttgggcttaagattattcctcaagtaaaggagttgttggatgacggtttggttcataagagcttaaatccttgtgctttggtgcccaaaataggtattatgaggcaccaaatccctatgataggtggtctgatgaatgtgttgaatggtgcaaccctcttttgtaaaatcacccatgcatccaacatcttcatgattcacataagtagggactcattaggtaggagttatcaacatgaaaatataggaaaagtgatcaatgggttcccacagaccctaagagaataa

SEQ ID NO: 36839 - DNA, 612 bp, Glycine max
  Peptide Sequence Number=SeqID_128524
atggtagggttgtccgttaattggttccctcgatggaaggaaggaggggccggggttctgtgctcatgtgaaaggttcccaaacgtccccttgatgggaacgagaggttgtattaattataatctcgtacttgccataagacaactaggttatcctatgagaggggtgccatcggaagatagtatcgcgtctttcatcgcacgaggcttcagtgaccccaatgcaaaaatgcttcaaagagtccgaaaagcatggaatacggtgcaaagaaaggataaggagcttagaggaagcaacaacggtgttattggcagatatcataaatggttgaaggctcgaatgcaagggataacttggctcccgaagctaaagagttcaggtggggaagaggctgatgtccctgaggagagcgaagaagtgcaagccttgaaagcggaacttgaaagaacacaagtggtcaaggaaaagttcaagacaatagacatcagggtcaggaaagagtgtgacgagctaagggatgtcaacatagccacagccgaagcattagaacgagaaacaaagaaggcccgaaaagaagaatggggccaaaataagttccgaggggctttatag

SEQ ID NO: 36840 - DNA, 189 bp, Glycine max
  Peptide Sequence Number=SeqID_128525
atggttaaagcacgggaaaagagggaggtggttgccgcccagctcgcccaggcgagctcagctcactcaggcgagctcagctcacccaggcgagctgggttgcttccaccaaaaggcaccaccttctgttggaacaccctagaaggtccaaatgggcctggtagctatttgcacacccctttttactaa

SEQ ID NO: 36841 - DNA, 303 bp, Glycine max
  Peptide Sequence Number=SeqID_128526
atgcacttagcggataggaggaacccggaaaggaatctgtcacgcaagcacgcgctcagcacgtcatcagctcgctcaacaagtcatttgtcaccttccagtcttagcgcgagtttggcgctgagtgaaaattcacttactcgcgctaagcacgagaatgacgctaagcatgacgtcgaggtcagtgagcccttttttaagcctggaatagcagaaaagagagagagagcattgaatagtcgtaagagcttgaagagtgaaatacatagaggcaaagaacagagcaaagaagccaagttttga

SEQ ID NO: 36842 - DNA, 342 bp, Glycine max
  Peptide Sequence Number=SeqID_128527
atgaggggagcgccaacagaagagagtctctcgcctttccttgtgagagattttggcgcgcaaagtctcaaggttatacaaagagtccacaaggcgtggagaagtccgttgaggaaagacaaagagcttaggggcatccgtaatggcgtcatcggtgattggctccccaagttgaaagttatcaatgaggagaactttgaagctccggaggaagatgaagaagtccaagctctaaaattagagctagggaaggcaagactcgccaaagaaaagttcaagtcatccgctaccaacatctggaaagagtgtgatgcaatcctaccccgcaagggcattggatag

SEQ ID NO: 36843 - DNA, 345 bp, Glycine max
  Peptide Sequence Number=SeqID_128528
gaggatgctccgcaggccgcagacgcgccgccacctcatcaggctggcccagctggatcatttgatacggagcagtatttatggcatttggttcgccaacaggcggccaaccaccgggcgcatgtacagacccatgattgtctttaccagctgagcctcagcttgcagagccagggttttacttcttttccatgtcctactccggatcagtttagggcagaggtcgcttggcctggagattggccggaggcaccagcagaggctcccgacgaggcagatgaggcccgcgaggacgaggagatgaccgatttgcttgatttcttgggagtgagcggagccacatga

SEQ ID NO: 36844 - DNA, 797 bp, Glycine max
  Peptide Sequence Number=SeqID_128529
atggcctcgaggaagcttgcctcaaagagatccaggaaggacaaagcggctgaaggaaccagttccgctcccgaatatgacagccaccgttttagaagcgctgagcaccagcagcgcttcgaggccatcaagggatggtcatttctccgggaacgacatgtccagctcagggacgacgaatataccgacttccaggaggagatagttcgccggcggtgggcatcgctggttacccccatggccaagttcgacccagacatagtcctcgagttttatgctaatgattggcctacagtggagggtgtacgagatatgcgatcctgggtgaggggtcagtggatcccattcgatgcggatgctcttagccagttcctgggatatcctttagtgctggaggagggccaggagtgcgagtatggccagaggaggaaccaggctgatgggtttgatgaggaggccatcgcccagctactgtgtatactggggcaggattttgcccggactgctgctggaagacgggtgcggatcatgcgcaccagcatgaccaccctgactcagatctggatgactttgctgctcagcaacatccagcccagcgatcataattccgacctccccctgccgaagtgtcagctggtgtacgccatcctaacacgaatgagcattcacgtggttcagttaatcgctgatgccatctatctatttgcaggtatggcgcctaccaagccccctctggacccggataagtccaacagggcactgggatttcccgctttgatcacaggactctgccagtc

SEQ ID NO: 36845 - DNA, 474 bp, Glycine max
  Peptide Sequence Number=SeqID_128530
atgtgtgccaaagctagagcgatgagtgaaatagaggaggtacaagagcagatgaaggctgacatggaggccatgaaagagcaaatggccacaatgatggaagccatgatgagtatgaaaaaaatgatggaggtcaacatggctatagtcgtggccacaagtattgccattgaggtggacccgactcatccatctggcctcaatccggtaaatcctccagtctcggatatagtagggcagagaggcgaagtgttaggaagtgcgggcggcccccattttgtgcaagttcaaaacaagcattccttcccaccatatggcttgcctcccaactatacaccacccgatgttgcgcacgctcccgatgagaatgtcaataactccactcccatattcattgagagccaacaaccccaatctgaacatgcacatgtctctcaacccatgggggggggggggacgcatgaagcaccctaa

SEQ ID NO: 36846 - DNA, 132 bp, Glycine max
  Peptide Sequence Number=SeqID_128531
atgggtggtaacaagagggtaaggctggcttataaagagaggctgaggcattttggttggttgagatgggtggtgggagtaaatgcagtaataacggtggttgatgaggtgaagacgaagagatgtaattga

SEQ ID NO: 36847 - DNA, 387 bp, Glycine max
  Peptide Sequence Number=SeqID_128532
atggtcattgatgctgctatgtggaaggaagtagttggtctggacatgggtgaagcaaaaaatgatgatctacaaattgtttatggtatgaaatcgggtatcaagatgaactgggtactactgattaaaggcattatgctgaagagtcatcgtctggtggattatgaatttccttacgctgtggttgcctcaaaattcattgactacttcaatgttgatgtctctaatgagattgtagactttactgaagcctctagtgagaatactaaaaggcatctcaagaagcttgaaataaagtttgttgatcatgaatggataatgactagacagtcgacagctggaaactttaaccagatggaagatgttgctaaagttgaagctccataa

SEQ ID NO: 36848 - DNA, 303 bp, Glycine max
  Peptide Sequence Number=SeqID_128533
atggttgagcacaagtttaatacctcggtgtataagaattttcacggctttgtatcaagagaagcacaagacctggttttccatgagttgcaacaggttgacattgtaggtactgatagttctgcttgtggttgcacacttagagttactcgagttctaccatgtgcttgtgagcttactaaatttatcagtatatatggctacattcccttgaagagcattcatataaaaacagaggatgcaccaaaatttgtgaaatctaccaagtatgaaccttcaaagtgggagtatgttgatgaatag

SEQ ID NO: 36849 - DNA, 1005 bp, Glycine max
  Peptide Sequence Number=SeqID_128534
atgattttggaatggattttggagaagatgctgaaagaaaatgagaaagatcgagatctcttctctgaactcatctttctatgtggaaaagtgaaggacgtgatgctaggaatgcgtgtgtttagttctatggaggctactggagttaaacccaattcactagttttcaattcccttataagtgtttgtttgtcttcccatgatattgttacagcagttagtttatttgagatcatggagagttcagagagctataaacctgattttcacacttataatatctttatttcagcattttccaagtcagggaatgttgatgccatgttagcttggtactcagcgaagaaggctgccagacttggtcctgatcttcaaatgtttgaatccctcatatcaggctgtgttaattctagaaagtttaagattgctgatagaatttttgaagaaatgatgatttctggaattgttcctagtgcttccataattgaaagtatgcttaatgggatttgcaagcaaaagagattgggtcgggcagaggagtttttcacgtttgcgatggattctggatgggaaataaatgagaacatggttgataagttagtagctatgtatcttcaactagggaaagcggaagaaatggaaggtctacttaaaactatgatgaagccctgtgttactactactggtgttctcacacgaattcattgtgggattgtgaagatgtatgcaatggtagatagattggatgatatagagtttgctgtgggtagaatgcttaaacaagggttgtcattcacaagtgcagatgatgttgaaaaggtcatctgctcatactttagaagggaagcttatgataggctagacatattcttggaatgtttaaagagatgctatgtccttaataaatcaacatatgatttgttgatatctggctataaaagagcacgcttgcttgaaaaagtagaaagggtgatggaagacatgaaatcagcaggattagtttaa

SEQ ID NO: 36850 - DNA, 204 bp, Glycine max
  Peptide Sequence Number=SeqID_128535
atggtgatgggtgtcacaacctacccttcggcgggagggcaacgcggggctcatgggtgcgtcttccataggaggaaaatgcgcggagtcgccaccaacgtttattcgaggaaaacgtcagaaaaaccggaaaggtgtggtctacgaacattaatcatgaaaggttcgggagttgtttttatgcacggggaagacgaagcttga

SEQ ID NO: 36851 - DNA, 267 bp, Glycine max
  Peptide Sequence Number=SeqID_128536
atgtgcacttcctttgtgactaattgtcacaacgtgcccttttgcgggcgagcgaggcgaggctcacgggtgcgctttccaaaggaggaaagatgcccggagtcgctaccaacgtttatttgtggaaaacgtcgggaaaacggaaggaaaccggtcaaaatgaaaattctaagttcgggagttgtatttacgcttgaggaaggtcgacaaaagcggggctcttgctcctacgtaccctccatcaaagaggaaatcagacctacgtag

SEQ ID NO: 36852 - DNA, 372 bp, Glycine max
  Peptide Sequence Number=SeqID_128537
atgaagagagaatctcctctatccctgcactacaaactgtttgaggggacacatgtcccagacattgtctcgacatcagggaaagctgcttcaggtgctgtgtccaaggatgccttgattgctgaactcaaggacacatgcaaggtgctggaagcaaccatcgaagccaccacagagaagaagatggagctagaacggctgatcacaaggctctcagaaagtggcattgatgatgaagaagcagctgaagaagaggaagaggcagctgaggaagacaaagaagcagctgaagaagaagaagaagctgctgaggaagaggaagatgcagcagaagagacagaatcagatgatgattcggaagccaccccatga

SEQ ID NO: 36853 - DNA, 930 bp, Glycine max
  Peptide Sequence Number=SeqID_128538
atgtggagtgtttttcgcaagtatggaaacattaaggaggtgtttattctggcaaagaaggacaagagaaaggaaaggtttgattttgctcgctttgaggatgttggagatgagaggttacaagaaggacacaaacaagagtctgatggatcatgggaggacatgaagatttggaatgagtgctccctagaaactgaagatccaaaggatgttggagagtatattaacgaggggacggattgggtattcagatggtttgaggagatcacgtcgtggaagacctcccacatggataatgagatattggtgtgcctaaaagcaacagtacaggcatggacatatagcttttttaaactattggcatccttgtacaagcagttcatgtatgtcaaagttgtaaccgagaagaaagaaaggctagatgtatctcgttttgttataaggactaattctctagatttgatcaattacagtgtgagggtgccaaataacttggagtgtgcccaggaggggttggtcgaggaggtggcgaagaatggtgaacaagagggaaggaagaggtttgggttggggggaaagttggatatggccttgggccatatacctattcgaagtggacttgagggagctagtgagagcttaggtcctcttagtttttctcatctcaaaccaaagcatggtatcccaaaagagccttctctggagagacaattgatgggtgcagggttaaccatgaaagctccgagtggcatggggagaagatatagcttaggtgaagtcccatccattcttatgtcaagaacgagaatagtgggggttcctcctaagatttggggacttgcaaaggtcataggagtggatggtcttgaaccagatgttgtgtatgttcatcatatcgacaatttaaaggataaggatgctgatggatag

SEQ ID NO: 36854 - DNA, 273 bp, Glycine max
  Peptide Sequence Number=SeqID_128539
atgggtgaactttcaaagtctgatggaagaagggaacaactaggtaggatggagtcaacatttgtgatggaagcttgcttcggaagacaaaggagaagaggtgagaggagacgccatccactagggaataagccatggaagaaggagcttcaccaccaagatgagccttggataagaagcttggaaggatgcttcaatggaggaaaagaaaaagggagagaaagagagaggggggagcacgaaattgaaggaataaaagagggagagaagtga

SEQ ID NO: 36855 - DNA, 1448 bp, Glycine max
  Peptide Sequence Number=SeqID_128540
atggtgagggcctttgaaattttgtgccccttcttcaacattcgacctagtgtgccaatcttcctgtttttcatccagatgaatctgactggcaagattggtttggtctccttgaatagtgtgtccaataagctgtttgagttcaactcaaatgtctttcaccgcttcaaggatcatcttttcaaggttctagctactaatgttgtggctaatggaattataggcaacttcgcttggaggacctttgtaaagcagccttgttgttggggttatcctagtgccccttcctctattttggcaaagaggaaacaagataatggtgttgggccgtttggctgcaaaaagttgagggcccctatgggccttcgtgccctgaggcaagctgtagagatgacacctggtatgggtcccccttctagtttgcaagatctacctccggctccatcggtcgtcgaggctcctgctcttgctactactgttgctgctactcttgctcctccatgtcctcctgtcgtaccagtttgggaggttactcctgttgttggagttgatgcgttggctacttcagttagttttgttgcagcgtctacatccaccgttaccacacccttgttgagtgacgatgtggcgaccactagtgctcctgtgatgttgcctcctcattttttggctccctctgttccaccctctactatgttggcggtggcatcaccttccttatcttctcgtccccatgtctttttagaccacttgtacacttccagtgatgttgattcactgtgggcctttgaaagaaatctcatgaggtcagctagggtgcataatgccacatactccgccaaagtcttcttgttcagaagtttggcaattttggaaaagaatgggcagcggcaccaggaggctttgcacaagtggtcatccttggagacgaaggttgctaaatggagggctactgctcgcatggtttggagacaagagtgccttaaggtagctaacaccaccatcaccttcgctgaagctataagttcaaaccaccaactatcttccaaggttggcaatgtcttggccaagttgctgagcacatggttggacagtgatgaactgttcgcacgctgtaaaggcattgtggcagagaaggacaagcttgccaaggtggttgctaatttggaggcccgactaaaagagtcagtgttcgggttggaagagtctgagctacaggtggttgaggagagggaggacaacaaggagcttgaagaggagttgacgatgtataagaaggaggatgccctcaagaaggctgtgttcttcgccaaggaccttaacttaggtctttttgatcctttcaaggatgtgaaggacgatgttatgcttgacaaagaagaaatttttgcgacggaggagacaactgatgaggagcaggtgctgaggagcgaggcgatgatgctcaa

SEQ ID NO: 36856 - DNA, 507 bp, Glycine max
  Peptide Sequence Number=SeqID_128541
atgcgtgatcataaagcccaagaacttgcctccgtagaccctgaaagtacatttttccaggttgaggcgcatgtcatatttgtggagctcttccaagacctcttccaaatctatcacgtgttgggttatgctctgggatttgacaatcatgtcgtcaatgtagacctcgacatttcatttgatcttctgcttgaacattcggttcatcaatctctggacatcagcgatgcacctatgttcatggctggtgaggtccctaccgagttgcatacgctgcctgtgtttgggtttgagctacagcttgacgagctcttcgatgggcttttggcctctagtagaagtgtcaccgcacgaatctatatcgaatttgtcgtccacgctcacttggtagatgatcagggctcggatgggaggcccttcgtccatgttcatgacttgactaccttaagcctttatagggtgaggcttggtaggctccctagtgggaggataggatgccacctctag

SEQ ID NO: 36857 - DNA, 81 bp, Glycine max
  Peptide Sequence Number=SeqID_128542
atggagaagcttaggttttatggagcagttgaccttgcttcatttcttggagtgtccaagcctcaggtagggttcagctag

SEQ ID NO: 36858 - DNA, 480 bp, Glycine max
  Peptide Sequence Number=SeqID_128543
atggctactcagttgaaccaagctcagtcccaaaattctgacaaattgccttcacagactgtgcataatctgaaaaatgtgagtgccatcaccttacggtctggcaagaaaattcaagtgcctccaccagtagcagcacctgcacctcaacctgtcaagcttcattctacacctgaaaaagaagatgacttagttgcacaagagaagaagctccctgatcatgagggagttaacaaaaattttcatgcaggtggaccttcttctagtagttctgacttgcagcagcctcctatcactcttccatttccacctagagcaattccaaacaagaagatggaagaagtggaaaaggagatcttggagaccttcaggaaagtagagctttacatgatacttgtacacgatctgaccattgggatctttgagaagatgtttggagtgtgcgtgaagattcctttcccgagagcatttctcatttga

SEQ ID NO: 36859 - DNA, 747 bp, Glycine max
  Peptide Sequence Number=SeqID_128544
atgttttcttttgactttcggcatattacggaacttcacggattgcgcaacaatggatgccaagtacctcgaagtggtcaaacgagggtcgcatcccaacaaacagatggtccccggacgaaattagggtatgacaaagggcattcatgcaaacatttctgggtgactattcctacatcagcatcacttaatgtgcaacaaattgtcactgcatcttatgtcattctctctctgattctgacaaatgttggtgagaatattacgggagtgattgtccttgctaatggatcatggaaggcagtcttggaaaaggatcatgatgtggataagatgcaggagaaggcacacaattatgaaaaggaacaaactcaaccacaagaatctacttgccctcctagtactgttgacctcaccaaagatgatgacggtttggattcagtgggctcttgggatattgtagaaagaaaacctacctcgacatctattcatagtcagtttgtcaccccaaattcaacctccttgggtgtacaccttggtgatgtgtggcttatgcttatgcttatcagaactctactggtgttaatcaaaatgtctgatacccaaacaattggtaactctgagctacctattctgcctgatactgtttctcctgcatttagtcagcaatttgttggttgtgataataaccttgttgttaactcagccatgcataatcaattttcaagaccaaacaacttgcagatgtag

SEQ ID NO: 36860 - DNA, 198 bp, Glycine max
  Peptide Sequence Number=SeqID_128545
atggcatcttcatcatcatcttcatcacatattaacattaacatgtttcacaacatgtttggaatcgggaagaagatcggaaattacatatcagacgagttgttcccacgtatcaaggggaagaacaaattcctgagcaaatttttccttttcttctacaatctggtttcacctggattatcaagatggggtacttaa

SEQ ID NO: 36861 - DNA, 568 bp, Glycine max
  Peptide Sequence Number=SeqID_128546
atgaaggcttctttgaggtccatatctacatcgacatacatgcaacgtctagatggactcaggattcctgatgtttgttggatgccttacggtgaacatcgacccattcagaagttcgatttgatttcatgttactccgaaattgatgaccaatggatgcactactcagaccatcttgcactagcaggtcagatttatgttgtgccaggacggtgtgcactcgagtacatggttcttcctcatttctcattcattcatgatagcggcatagccatcagatccgctgacaacaaagcaatcacgttttcctccaccatatcgtgcaacttgaacctaattcctaagttctttcccacgccgcatctccttattgttctcacagaacgactctggttcacatcagagaattcatctcctcttcgtcctcacgcttcatctcgttgtggttctcaaagcacgactctagttcacgttctctcccactcacgtcacatttcgttctcacaacagactctggttcacgttagagaattcacgttctctttcatcagtgccggagttaaatcat

SEQ ID NO: 36862 - DNA, 498 bp, Glycine max
  Peptide Sequence Number=SeqID_128547
atgtatcaatatccattcgaaggtcatcaaagtgatacttctccaagcgaacattcattaggtggtgttgcggaaacatatcccaaattttcatggcctactatgaccccttcacagcaacatgatgctccaattccaacacctaatgctccattaggtactcaatggaatgtacccggagcaatacctgatatggatgacttattaggtattgatttacatcaccaattttctgttgaggctgaccaagttgaaccggggagacattggggcataagaaatcctgatagacaagcacgaagatgggaacgaccatgcggcacatcctcacgtcatcagagacatcaatgtttgagccaatccatctcattgcttatccttgttgattttggccgacctttcgcatggagtgtacttggatcaaggataagtgtccatgagtcatcagaaggaggaattgttgcttcattcccaagaggtcaccattgtgcggagtaa

SEQ ID NO: 36863 - DNA, 414 bp, Glycine max
  Peptide Sequence Number=SeqID_128548
atgaaaaaggtattacaaaatagtcttggagacctctgtagtgtttggaatgtcatgaacaatatgatgacgctgcagcatactcaaattaaagcatcattcgaaacaaaccatgggttatgtgaggtcaaagtcaacatcaaggaagagattgatagaatatataaaagatttgaggaacttgatgtctgcggcaaagttactttcaagagtaaacctcgagaattcacgtatcttgatgagaactctatgtgtcatcctccgtcaaaggttaacaccaaaggtgcaccaaagaatctgatgaaaagaagccaaagatcgacaaagtgtgatccgccatattgggagtatgttgatttatcattcagttcaaaacaacaacacttcagtcagacgtattgcaccatcttttga

SEQ ID NO: 36864 - DNA, 153 bp, Glycine max
  Peptide Sequence Number=SeqID_128549
atgggagagttgatttgcgccattgcccgattgccacctagtaccacatatgacggagtggtacctggagatatgtcgcgggggtcaagagaccttggggacgtcaggtggggtgctattgcccaaaaccaagcttggccaatcccgacctaa

SEQ ID NO: 36865 - DNA, 426 bp, Glycine max
  Peptide Sequence Number=SeqID_128550
atgagctatacaggttcgctaagcgcaccatttcatctcactaagcgtactgcttcagtttatccgttaagagagaaaggcgcactaggccaaaaatcaccaacatgcgctaagcggtccatacatgcgctacgtgcacgagccaaacaaggacacctatttaagcctgaaatcagattttgtgaagagagtttggactgggattcagagctttgcatgtctaaggtttctagagagagaaaggtccaagttccagagagttttgagagattttgctctccattggagcttgtaggccttggatcttcttcatcaatggattcctttgcttcttgtaagatgaatggcagcgaaatggagaaggaagagagagaggagatgccacttcaagaagaagatgagcctagaagaagctcactaccatag

SEQ ID NO: 36866 - DNA, 734 bp, Glycine max
  Peptide Sequence Number=SeqID_128551
agggctacatgccctcgccttcagagggctacatgccctcaccttcaggggactacacttcctcgcctttagagggttgaacgtcctcgccttcagagggctgcacaccctcttctttagagggctgcacgccctcgctttcagaggactacacgtcctcgccatcagaggactacacgtcctcgccttcaaagggctacacaccctcaccttcagaggactacacgtcctcacctttagagggttgcacgtcctcgccttcagagggatgcacaccctctcctttaatgggctgcacgccttcgctttcagagggctggacgccctcgccttcaaaggttcagttcctaggccaccccttgatcctagaggagagccaactgtgcaagcacaactagaggaggaggctatcgtacaaccactatgcatactggggcaagatttcacccgtgccgttacaaagagacgagtgcggatcatgggtcgcgcccacaagacacccagtggacccggagaagtccaacagggccatggggtttccaactcgggttacgggcctctgtcagtcctacagggtgcccatcccccccagcaaggtcatgccattgtgacatggggatcacgcccgcaaggacacccagtggacccagagaagtccaacagggtcttaggggtttccagctttgattatgggcctttgttagttctacgaagtgcccgtcgcccccaacaag

SEQ ID NO: 36867 - DNA, 228 bp, Glycine max
  Peptide Sequence Number=SeqID_128552
atgggggttaagtacctcgaggcagtcaagcaaaggttgcatgccaccaaacaatggtcctcaaacgaaattagggaaactggtaatccattaccagagagtaaaaactctggctctaaattcacgacgttgtgcttagcgccaccctcgcgcttagcgcaagtacgtggattcgggcttagcgccagtcgtgcgctaagcctgactgaagacacctgctactcttag

SEQ ID NO: 36868 - DNA, 75 bp, Glycine max
  Peptide Sequence Number=SeqID_128553
atggctaatgacaatggagaagaagtagatgatgtccatgcacatgactacaccaccaagctcccctcctcctaa

SEQ ID NO: 36869 - DNA, 731 bp, Glycine max
  Peptide Sequence Number=SeqID_128554
gggtagtggatccccttgacgcagatgccctcagccagttcctgggtgacccgctagtgttggaggaagaccagcagtgcgagttcaaccagaggaggaacagggccgacgagttcgacgaggaggccattgcccagctgttatgcacaccggggcaggatttcacccggatcgctgcagggaggcgggtgcggatcatgcgcaccagcatgactaccttgacccagacgtggatgacattgctgctcagcaatgtcttgcctagtgatcataactccgatctccctctaccgaagtgtatgccacccaccaggcaccctctagacccggataagtctaacagggccctaggatttccggcattgatcacgggtctctgccagtcgttcggggttcccgtcacccccactaaggtgatccgaccgccgatcatccagcaggcgcagggtgatgcacctcaggccgcagacgcaccaccaccacctcatcaggccgatcccatacatgagtgtctctaccggttcagtctcagtcagcaggggcagggtttcgctccttttgcattccctactccagagcagtttggggctaaggtcgcgtggcccagagattggccagaggcccaggcaggggaggagcccgctggatcccccggtgcggcagaggaggcccgtatggatgaagaaatgacagacttgcttggtttcttgggaggaagcgaagccacgtga

SEQ ID NO: 36870 - DNA, 540 bp, Glycine max
  Peptide Sequence Number=SeqID_128555
atgtccagccgttctacaagccttgagccgaaaaaccttgacctcagaagaaaacaaagaaaggaaattcccaatcgaaagagtgggggggaaagcaaaaaaaaagaaggaaagaaaattcccgatcaaaaatcggaagaaaatagaagaaatatgcagaaaggtcttcggaccagacaatatctaaacaatacagaattgtcaccaaagacaaattatggtcattccgctcacctttttgccattcatacacaatcgtgtctgatggcacgcagagacaaattatggtcattctgcgcccttttgtcatctagaggcggcgagcccgatgacatgcagagacaaattatggtcattccgctcaccttttcgccattcagacacaatcgtgtccgatggcacacagagacaaattatggtcattctgcgcccttttgtcatccagaggcggtgagcccgatgacatggggagacaaattatggtcattccgttcaccttttcgccattcagatatgacaatcgtgtctgatggcacgtag

SEQ ID NO: 36871 - DNA, 165 bp, Glycine max
  Peptide Sequence Number=SeqID_128556
atgattcaaatttgtcaccatgagcaggtcagggcaaccacaggatctgaagaactatggagagtaacatcgtggagcaaatgccatattggcagtgtctcttgcagtctgaaaagctggtgctgctgtcctgaaagttcctctttacaaggtatttatccatga

SEQ ID NO: 36872 - DNA, 662 bp, Glycine max
  Peptide Sequence Number=SeqID_128557
ctactacctaccctcctagtctgcacaacttaaggttcattgatgtcaagataattgttgacaaggtgtgtccatgtctccttgtttgggattctgctaaaaagaaagacttcaagttgtactataatgaggagatgccttcaaggaaagtgaagatggaaatagttagtcacctttggaattggagctccttattcagcaaaagaaggcttgttcattctcctgatgcatatgatgccaagaccttctggagccaactccaatggatagacactcaaaaagtctccacatatggggacagatgtcgtacaggatgtcacgacatcacgcttcagaacatgcagattgtatgtgtccggaggaaatccactctcaatagtgttagttcaaggtctaacaacccctgtttacaaccttctcacctaaccactacccacactccagagatcaactctgtacaaaagggatcaaccctacacaatagagatcaactctacacacaagagatcaactctacacactcaggtccaacacttgataactcgtgcagcctccatgattatatagccgtgtacgattctgggccgcaagttcttgatgctggaggagatctatcttcttctgaaaaatctgcagttaaagaactaaaagataacttttga

SEQ ID NO: 36873 - DNA, 633 bp, Glycine max
  Peptide Sequence Number=SeqID_128558
atgaattttggactaccccttttctgggagaggtgcttagttataggagaggatgcacaaaagggtgagtggatattgagaagatggaacaggaatcagattaccagtggcaactttggaaggagtatgccgcagtcttgtttggttatctttggacctaagatcaaagggtttctagtaccataccatcataatgaggttcttcatctcctcccatatatacagagccttgtatggagtcatttctattctagagtgaaaattattgttgtaggtgacgttgtatgtcgacaacaactacgacggtcaccctacaaccgtctttgtaatgtgagaagacaacgtcagtgtgcagtcaacaacagtcgtcatatacatcaaatcaacgacgcacattatcgtaaacccgtcgttgttttggagcatttcaacgtcggtgtatatgacactggtcaggttcttggcaggggtactaagatcactctctacctcaaggaagatcagcttgagtaccttgaggagcgttgcttgaaggatttgatcaagaagcattctgagttcattagtagttaccaacttgttggtctctctcctattacattacatttcagtaatagcaacccccaccaatga

SEQ ID NO: 36874 - DNA, 204 bp, Glycine max
  Peptide Sequence Number=SeqID_128559
atgcagaattcaaagcgagatgtgtgcctaggagtctacctgaatggtgcatattggcaaatggtcatcattttgccgaagaaaaatgttgtcatatggttttgttcgttgcataataggccagacaactacctcaaaggaataattaacagtgctttgaaaggacttgacgataaaagtaaatccaaggcttctgctaggtag

SEQ ID NO: 36875 - DNA, 630 bp, Glycine max
  Peptide Sequence Number=SeqID_128560
atggcacgtattgctgacaagataaaaaccattaatggttctaaagaaactctgaaacttgctgtaaggataactgagctctggtttgttgggacgccgggcaggtctaaacaagctgagatggtcattgttgactctgacccattagttagatatttttatgattcacagggtgatcaaatccatgtggtctgtaagcaagaccagttaaagacatggaaaatggatttgaaggaaggatcctatccatgcttggttagcaattctttgaaggcttctaaattgactattaatcagccagtggcaccaattgaagaattcaatcagaagctttcagaattgggcattgagattcgctcagttttgacatgtcgttctcagtggagttcacagccttcaggttttgctcagttatcatcaagggaaacattcatttccaagtcagaggcaaagaccatttctgagataaacaacctttgtgaagagtttgtttgtgttactattggtacaatcacgaggattgttatggacaatcattcatggtgttatgcaacttgcattcagtgccataagaaaacaaatgtctatacagaacctttagtgtgcccatgtggcaagcataatgattga

SEQ ID NO: 36876 - DNA, 234 bp, Glycine max
  Peptide Sequence Number=SeqID_128561
atggtcgattctgatgatggtgatgacatggactcggaggacttagtgaagatcactgctgaggttgttgattttaggaggccttatgtcgttttaaggaggtctaccctctatggtgttgggagtatgacgcctgaatgggtttctttatctttcaaggaccagatactatctcttttctataataccctctaccctgatacatataatcaagaaaaagatataaaaatctga

SEQ ID NO: 36877 - DNA, 393 bp, Glycine max
  Peptide Sequence Number=SeqID_128562
atggaagtcatggcaaggcttctcgctgctgagactttctctcacactgtagcagtacaagtaaaaccaaagcaccctgatttcaaacgcaaggatggctattctttctggcttggcaaggatgaaaagtgggttttgcctaaattggaaggacttcaatttgatgttccaactgctatatccaaaaaagcacacatgtctcaggtgatggtggtgagtcctggaatgatttgtggaagcaatgacttccaagactattttgatgatgataaagaatcaagagttaagcaagttccaaagaatcaggagtcaaaaagcttcaagaatcaagattcaagactcaagagaagactcaatcaagataagtacagaaaaagtttttcaaaacattga

SEQ ID NO: 36878 - DNA, 177 bp, Glycine max
  Peptide Sequence Number=SeqID_128563
atgaatgtgagcatgctcacctatttcagatttgacctatacctgaaatttcttttgacaaacatggaatttaaagaggccattaatcttgaagttgtgaaacttttctcaagaaacctggctctgataccacttgttggattaagtggcctcagaataattaagaagaggggttga

SEQ ID NO: 36879 - DNA, 609 bp, Glycine max
  Peptide Sequence Number=SeqID_128564
atggcttcctgtaagagaaaagccacaacttcagtgtcccaggccaggagaaactggcataaggagctcactaatttttcggagggaagcatagatgcagcatttgttaaagaattctatgcgaacttgtatgaccctgaggacaaatcgccaaagcaagttagggttcgagggcacctgatgaagtttgatgctgactccctcaacaccttcatgcataccccaatggtcttggagcaaggggagagcttgccctcttactccaagttttgtaggttgaggccaaatcctcaagagctagcagcctggttatgtatccctgggaggggatttgagcttaatgccaatggcttgcctctgaagatcttgaggaagaatcttaccactctggcccagacctggagtgttttatctttctctaacctagccccgacatcccatacttcttatattactttggatagggctaggttgacctacaggcttatcataaagatggatataaacttaagatacataatctcaggtcatatttctcttatttcccagcatgactcctcgaggctaggttttccaacccttatcactgccctatgcaaggcccgatga

SEQ ID NO: 36880 - DNA, 516 bp, Glycine max
  Peptide Sequence Number=SeqID_128565
atgaagaatttccacataatcgcttacggaagcgttacggaagcacttcgactcgatttttcttcacgaaaacgtaatgttgcgaaactttacggattacgcaacaatgctctttttgacttccagaatgttgcggaactttacggattgcgcaacaatttaagtatctcgaggtggtcaagcgaaggttgcatgccaccaaacaatggtccccggatgaaattagggtatgacagtggcgccgctgcaattcttggaggtcatcatcatcgtcttgaactccttgaagttgatgtatccgtcaccgtcggcatcgatggacttgatcatgtcgcggcattcatcgacagagcacttgaggccaaggtggttgagcgcgaggctgatgaagccgtcgcggtcagtgtcaaggtcttctatgatgcgcacactgtcgagctcatcagcggagatcttatcgtcgccgttggcgtcaaagtggttgaagactgtctcgagtttgttcatgtctttgaa

SEQ ID NO: 36881 - DNA, 78 bp, Glycine max
  Peptide Sequence Number=SeqID_128566
atggacacccgtctccgtgtgattggtgatcccatgaatggagttcaacgggggtgggggtcacaactcactctttga

SEQ ID NO: 36882 - DNA, 468 bp, Glycine max
  Peptide Sequence Number=SeqID_128567
atggtgtgggcagaggagatcgttatgattccgatgatgctccacaatgtcgatgacctatcgcatccgcatggaggaagcgataagccagtgctccctacaccagatgtagaggctgatgtattctcagatgacccgatggcaccaactgatgtagcggacactggcgtagacattcctgcagacacaagcacccaggctgctgaggatgagcatgagggatttctggggggtccgagcgacccatccgtgctgacccagtatgcggatcacgttgcttgcagcgtatggacgggagaggagcgtcccgagttgaagttatcctctcacgggacgaaggtccatagtttaggcaggcctgtccctgccattgagggactagttgttgggacaggactaagtcctctgatcgcgtgttcggtagacactagcgatcgaggacttttgtcctcgtttgtcgagaggtga

SEQ ID NO: 36883 - DNA, 387 bp, Glycine max
  Peptide Sequence Number=SeqID_128568
atggcggaaccattgaagaagcggaaagacacttcaagtcgaagtcagcgacattctgggtcacaggaaactccaattcctcccttcattccctctggaccattgttctcatcagaggaacaacgtatacggtacacaaacttcttttcctctcattccattatagacccaaaatttatagatatggagttcttctcaaatgagaattttgaatgctttcaagcatttgaaaactccaatcttattccatttatgtctctgaaattacctgtttattctgaactagtcaaagctttctattctaatttagaaatccatgaaggtaccctaatgtctgaggtttatgggattaagatggtcattgaccaatccctattttatgattaa

SEQ ID NO: 36884 - DNA, 317 bp, Glycine max
  Peptide Sequence Number=SeqID_128569
atgtcatcacatcaagtcgaaaatggggtggttggagtaccaaggaaatgtttggaagtaaaggcgagaaccttggcaagtcaagatgaatgggacctgttcatggacgtcttggcgctcttgatctttggagtggtcctctttccaaatgcagatgggttggtggacctggcagcgattgatgcttttctcgcctttcatgaccacaaggaaagcccggttgtcgctatcttagccaatctatatgacacattcgaccgaagatgtgagaagaacagtgcaaggatcatttgctgtacaccgaccctctacgtatg

SEQ ID NO: 36885 - DNA, 135 bp, Glycine max
  Peptide Sequence Number=SeqID_128570
atggttaaatactgtgcaaaatccaagacagagatgaaccaaggtgctcgtggacaggtacgagtagatgctacgtccgtgatcagcagatcgtcgtcccgcgtctggcttcggacgatcaagaagcactactag

SEQ ID NO: 36886 - DNA, 1788 bp, Glycine max
  Peptide Sequence Number=SeqID_128571
atggttatccacaccttttgtcatccaaagacgacgagtccgatgacatgcgggggtaacttatggttatctgacacctttggtcaaccagacgcaagagagcccgttgacacgcagagactaacatcgtcatctgcaccttttgtcaaccaggggcaagcgagcccatatggcgagtccgatgacatgcgagcgtaccttatggttatccgcacattttgtcatccacagacggcgagttcgatgacattcgaggggactaaaatcatcttctgcaccgtttgtcatccagagatggcgaatccgatgacatgcgggggtagcttatggttatctacaccttttgtcaaccagagagacgatgagtccgatgacatgcgggggtaccttatgtttatccgcaactttggtcaaccaaatgcaaacgagctcgttaacacagacggtgagtccgatgacatgcggcggtaccttatgtttatccgcaactttggtcaaccaaaggcaaacgagctcgcaagcgagcccgttgacacgcaaagactaacgtcgtcttctgcaccatttgtcatccagagaagggcaagcgagcccgatgatacgcagaaactaacgtcgtcatctgcaccttttttcgaccaggggcaagcgagcccatgggagtccgatgacatgtggggtaccttggttatccgcacctttagacatccagagtcggtgggtcacatgacagcaggatcttatggttattcacactttgtgatcaagagacaccgagcgatgacatgcgggggtgccttatggttatcgcaccttttgtcatccagtgacgacgagtccgatgacatgggggtggcaagcgagcccgttgacacacagagactaacgtcgtcatctgcaccttttgtcaaccaggggcatgcgagcctattgacatgcagagacaaatgtcgttttctgcaccttttgtcatccagagacggcgagtctgatgacatgcgaggcaagcgagctcatttacatgcagagactaatatcgtcttctacaccttttgtcatccagagatggcgagtccgatgacatgcggggggcaccttatggttatttgcaccttatgtcaacaaaaggaaagcgagcctgttgagacgcagagactaacagaaggggagtccgatgacatgcgggggtaccttatggttatctgcaccttttgtcaaccagaggcaagcaatcccgttgacacgcaaagactaacattgtcatctgcacgttttgtcaaccagaggcaagcgagctcgttaacatgcagagactatcgtcgtcttctgcaccttttgtcatccagagacgacaagtccgatgacatgcggggggtaccttttgggactaacgtcgtcttttgcaccttttgtcatccagagacaacgagtccgatgacatgcggggatggccagtccgatgacatgcgggggtaccttatggttatccgcaccttttgtcatgcacgggcaagcgagcccgttgacacgcagagactaacgtcgtcatctgcaccttttgttgaccaggggcaagcgagcccgttgacacgcagggacaaacgtcgtcttttgcaccttttgtcttccagagacggcgagtccgatgacatgcgggggtaccttatggttatctgcaccttttgtcaacaacaggcaagcgagcccgttgacacgcagagactaacatcgtcatctgcaccttttgtcaaccagagacaagcgagcccgttgacacacagagactaa

SEQ ID NO: 36887 - DNA, 735 bp, Glycine max
  Peptide Sequence Number=SeqID_128572
atggtgaaccttgggtttgaagtgcctttagagaagcaagacttaccaagggtagaccttgggttttacaagccttggagaagcaagactcaccaagggtggaccttgggtttgacgagccttcgtagaagagagactcaccaaggggctgaccttgggtctggcaagcatttggagaagcaagacttaccaagggaaaacattgggtctgacgatcctttggggaagcaagactcaccaagggaggacaatgtaacactgtcaagcctacttttggtctaccctgacaatcacgatttctcccatcaagacttcgagcctctagaatgtcttccagtaaagtatgtccatggagtttccttggtcaatgaggaccttagacaccatgaaattggcgatcacaatggatacaaccatggggaaggggacttcttggcgattgtatttgacacaattcatctcaatatcctggatggtgtggagatgaagcttttgggattgactagacaaccctccataggaaaatccatctacaatgatgttgattacacctttgatttgttgggtgggctcattttcctactcttgctaaggccagtgtctcgctcatattggattattattgatgcaatcctccctaggaagggacaagtcactagagccatgagcaagaggctccaagaggattgggctagagctgctgaagaaggccatagggttctcatgaacctcagg

SEQ ID NO: 36888 - DNA, 645 bp, Glycine max
  Peptide Sequence Number=SeqID_128573
atggcaacaccaccaacattccctccgcagtctaatcagcagtcagaggcgatgtctaggaatactagacgatccacatggctcaggatgttgactagaagaaccttggatcagccgcgacctattgtcgccgttgatgctgcaactgggcgaggatcgggcccccataaagagaaattccacaactatttaggtgttgtagctagagaaaaagttccaattgtacataacagttggaaggatgtaccagtcacactaaaggagctagtatggaatgagattttggccaagtttgatatcccagaagccctacatgcaaagaaaaaggtgatgtcaactacggtcactagatggaggcagtttaaatcatccctgacaatccttccaacactatatgttaaaccacatggaattaggaagaagatgcaggaaatccaaaagaataatgactgtccccatttgctttcctgcgggggatatgatttgctagaaaagaagttgttagacgagagaatgaagaaaaggaaacatgacgcattgctgactgaaaatctagcactcattgaggacctccccatctcccattcaaagacatgtcaagtggaagatggtctacacgaatcgatatgggaagatgacatctga

SEQ ID NO: 36889 - DNA, 390 bp, Glycine max
  Peptide Sequence Number=SeqID_128574
atgacctcggtcgtgacctcgtccggcgtctcgtcttgtggcggcaccgcgcaagccagtgagtaccccttttcagagttgtcttgccctacaacttgtcttcaagaagtaattattgaaattctgatactggggacagatgtcgtaccggatgtcacgacatcacgcttcagaacatgcagattatatgtgtctccactgtttacaaccttctcacctaaccactacccgtgcaatctctacctaagagccactcttagatatgagaaccctgctcactccctctcaatccacactcccgtgtttacaaataaatcaaagacacaccagagatcaactctgaacaaaagggatcaaccctacacactagagatcaactctacacactag

SEQ ID NO: 36890 - DNA, 93 bp, Glycine max
  Peptide Sequence Number=SeqID_128575
atggagataaatggaagcggaatggagaaggtagagagagaggagatgccacttcaaggaggagatgagtctagaagaagctcaccaccgtag

SEQ ID NO: 36891 - DNA, 600 bp, Glycine max
  Peptide Sequence Number=SeqID_128576
atgtcgcgggggtcaagagaccttggggacgtcaggcgagctcctggcagtcaaccgataaaagaacaaagaccacaaagcaaggaggcttgtgtggtggctggccagctatggattttgagtgatatatggaatatggcctctggtaatcgattaccaaggatcgtgatggcaacgcaattaatccatgaccgagtggagatggagtgcctagagggagtttgggagaccctcaaaggcaatgcgaggtgccgattccgtggcacgatccgactcacggctacttcgttggtacatccggaggaaccagcacacacgcttcagcgcacggtggagtggatattacctacacctactccatatcgactagtggagccagtccaagtgatagaggtgacgtcatctgaggaagaccctgaggaggacccagaggagctacctcctgagcctgctgtggatgctcttgactttctagagggtgatgaggatccactccctgaggtggattctcccgaggacgtcatgtcggcatctgaggcagactctacggaggagagcggtcatggagggatagcgactagcagaggttcttcatcatag

SEQ ID NO: 36892 - DNA, 144 bp, Glycine max
  Peptide Sequence Number=SeqID_128577
atggttgtcgttgtttaccttgttgccctcatattcttgccttttcagtgtatcttttcttttgctcttgcagtccttttcagacaagagtatttgagaatcatgactaaggccggggtagcaaaggccttagggagtccttag

SEQ ID NO: 36893 - DNA, 240 bp, Glycine max
  Peptide Sequence Number=SeqID_128578
atgtacaaagataattggacccaaccttggcccatgggctcagaaatctaccctaaggttcatgagaaccctagggccttcttcaacagctctagcccaatcttcttggagcctcttgctcatggttctagtgattggtcccttcctagggaggattgcatcagtggtcctcacactccttctctacacagtagtgtgtcttgtataaagcatccaagctattatacaatggataactaa

SEQ ID NO: 36894 - DNA, 274 bp, Glycine max
  Peptide Sequence Number=SeqID_128579
atggggatttttggagaaactggctgggagtggaaattctcctggagaagatatctttttgacaatgaattggggggagcctcagcttttattgaccagactgcagcaataagtaccaatgcagccttgatggattcttgggtgtggggagctgaaccaacagggatcttgtctacaaattctgcttataattgtatcagacctgatcagctattctatcagccaaatagtggcttcagacagctatgggaaatcaaaatccccccccccacag

SEQ ID NO: 36895 - DNA, 357 bp, Glycine max
  Peptide Sequence Number=SeqID_128580
atggtacatctcttgtggatcagttctagtggatcaattctagtggagggtgcatccactaggttgttcatagagaacaaggaagggtacatcccttgtggatctttgcttgtaaaggaatttacaaggttgaaaagaaatctcaaggaccacaagtcgcttggggactcgatgggtgagctgagtgacgagaggctagggttgggccgatgcggaaggggtgacctcaatgacgatgaccagcgtaactcaggggcaactgagtctactgaggtcacgagagtcttgttcgagtcacgtgactataatgccatgccaacgacgacggtgtccagcaaagcaaggtcatcgaagtaa

SEQ ID NO: 36896 - DNA, 558 bp, Glycine max
  Peptide Sequence Number=SeqID_128581
atgtatttacgtacaatttttccctttgaaggtgttggttctgaagtagaatacacaccaattcccagtggacctggcagtgacattgcaaaggacaccagaaacgaggaggtgtctatgcttgaaaatgtgtactggaaggagtttggacttcttgtttttgtttgggtttcattccttggaatacagattgccatgaaccagacaagcaaatgttcaacaatatattgggtactgaacatgttgcagattccaatttcagttggggtatctggatatgaggcagcttccttgtataaaggacggagacaaatttcttcagtgggagatcaagggaaaacttttacttctcagcagctaactatatattgtatctttggtgtattggctggaatagttggtggcttactgggaataggtggaggattcgtaatggggccactctttttggagctgggagtcccacctcagttcctatacctggaaattattcatgttagtcctgctaaatacactaattcatatttgtctctacacatacactttcaattcttataa

SEQ ID NO: 36897 - DNA, 288 bp, Glycine max
  Peptide Sequence Number=SeqID_128582
atgacaagacaaacaacactagcaagtcaggtcactctcactagaaattacttgattgtcatcatcaaaaagggggagaatgtgactgcatgtatacatgattttgatgatgccaaagaagaatcaaacaaggccgcttcaaaggataagcactacttcaagattaatacaagattgcttcaacaaacaaagccttgcttcaagatttcttcaagatcaagccttgcctcaaagcaaagggtttcaaagtcacccaaggctctggtaatcgattaccagacagtgtaa

SEQ ID NO: 36898 - DNA, 462 bp, Glycine max
  Peptide Sequence Number=SeqID_128583
atggaatcgacaaaagaggtagtcatgatattgcacgagattagaagacctaactctctaaaaacagtccccagtggagtcaccaactgtcgcaacctacccttcgacgggagggcgacgtggggctcacgggtgcgtcttccaagggaggaaggtgcgcggagtcgccaccaatgtttattcgaggaaaacgtcggaaaaatcggaaaggtgtggtctacgaactttgagtgtgaaaggagaaaagagggaggtggttgccgcccaactagcccaggcgagctcagctcacccaagagagctggattgcttctaccaaaaggcaccatcttctgttggaaccccctggaaggcccaagtgggtctggttgctatttgcacccccatcttgataagttcacccccgtctttcgtaatttatggaaaagttatagaagccttacagaagcatataggacttga

SEQ ID NO: 36899 - DNA, 2297 bp, Glycine max
  Peptide Sequence Number=SeqID_128584
cgatcaagagaagcaataaccatggaccaccagtagcagggcgcacaacacccaaggggtgcaaaccacccaacagttacgacccacccaaagggtgcaaggggtgcaaggtcaggagatgtgaatcaaggggacatgacccttgggaacagtcacaaccaaccgttatgatccgcccaaggggtgcaagcactgaacaagagaatgctaatgataacaatgccaacttcggagactggatagaggtatcacgcaaaaggagaaagagagcagaagaaaacagcagcagagtggttggaaatggaaaacagagacgttacaaaaacttacaccggagggatcatgaagatgtcaccacgttttacttttccaggttccctgacgggacaagggagactgacttatggaagattttccagaaatggggcagagtaagggaagtttttattcctaagtacaaaaacaaagaaggacacaagtttggttttgtccgattcaaagaggtgatggatgagaggaggttggaacgtgacttggataacaatatattcattgatggaatgaagctgtttgtgaacagacccaaattcgacaggggtagggtgtttcgagcaaaaccatttgaagagcccctccagaaaatgccgagctgtcaggagaagcataacgggaagcagctgggagataaagccccctgttacgatggagaaccacggtcatacttggacgtggtcaaggaaacgacacgtgcaaagggaagctcttatctgatgaaggaagatccacagggtgatacaatagaaatacagaggttggtggttctgaactcaactaaggaggaccgtgaatggttggagaaggcatggatagggagattgaagaatagagggatgtttgaaaagttggaagaggagctaaggtgggtggttgaccgagaagttaacccctgttattggggtgatgactggattatccttcctggtatggatgaatccaacgcgaacaggtggattaacgcagaactgaagaatggatctacacccataatggaccttcagaaatggtcaccggatatcagaccagagtttagactcacctgggtcctgctccggggtctcccgctgagtgtgtggaaacctgagtacatgaagaaggtgatggaggatatcggtgagatggtggaggtagatgattacgttgaggagcgtagacggatggacgtagctcgaactctcatccggacaaatcagagactgggcttccatgagagtgtacgggccatgattgacggggaggaacatcaactcaccgtcgtggaggacatgagtagtatgggcgccaaaatgaaaagttatcagaaccatagctggttccctccatcaccagtgtcgacgccgccaaacacccccttacccttcaccgatgacactcctgggcgcgactccggcaacgacgacagtggtgacagtgacgccgagcttgatggtgccgataccggcacacctaaccactggcacaactctcgtttgtccaaacgacggccgtccaaactgcatcgcgaccactgggtaaaaccccatggtcgttccccttcggtccggtccatcagtgatgtggctgacgtggaccactccaaggtggtcaatgctgggggcaattcagatttaccgcgtggtgtggactccgaactccacaacggtcacattacccatagtggtaaagcttgcattaatgagggggaaagtcaaaaatggactaacataaatatagtgagttcatctcagaaaaatgatgcaacacaggaggggagggcaggtcagacttatgaggagaaaaaggaaagttcaaccatagatgcaaaaggggacagggaagaggtctggcctattgaaaaaggcttcccacatagggttcacgccctaaatataaaggaagccggtgctaattttcattttggtcgacatgctgtaaatgaagctataggggaagtgggcctgaagataaaaggcccaattaagtcagcaacaaaagtgtatgttagaagaaaagaggtgcaattaagtcatggaaaggcccaatactctcaaggaccagacgtggagtcagttttggtcccagaagcagatcacacacttgcagttcaaggagataaaattgatcaggagctttctttaataagagacctgggcctcacttacgggggagatgacaaggagatcaaagaaattctgaaagatatggataacaaagacactatgaaggctgctgcgatgggaattaaaaatcagatattatga

SEQ ID NO: 36900 - DNA, 705 bp, Glycine max
  Peptide Sequence Number=SeqID_128585
atgtcctatcacacatttacggcagcactgtcaacatgtggtgggatcaaaggtgaggaggatatagtggggaggtctatctggagacataggaacaatgttatcttctccgaccagcagccccatgtgaaacaattactgcactccatcgaattcatatcatgggcctggatgagagcaaaaccggaaaagttcggggccacatattatgattggatgatccagccaaagcagtgcctagcagcagtgaaagcttcagacagaaaaagacagactaatctgattaagagcatcattgatgggatgaggggaaccgtcacagagggtgtattataccagtttgtggcgaaaatagccatggatgatgctgagttgggcatggagagaaggtgtggtggtgaatgtgggaagggaagggagagagagagagtcagacagagagggtttgagagtgtgaatgcgagagggcagcgaaatggtggtggtagtgtcgacagtagcagtggaatggtagtagtggcaccaacaacaatagtggggtggaatagtagtggtggcgacaacaatgatggaggtggtggaatggcgacaaaggtgaggtgcagtggtgatgcaatcctacccccaagggcattggatataagacttcaagaagattggacaagagatgcaagaaaaggccctagggttcccatgaaccttagg

SEQ ID NO: 36901 - DNA, 213 bp, Glycine max
  Peptide Sequence Number=SeqID_128586
atggcttattccctagtggatggtgcatcccctctcctcttctcctttgccttccgctgcatctccatggtgggaaaatcaccattgaaggacctcattgaagctcaaagatccagcctccatagaagctccacaagcaagcttccatcactaggcttagcacctgaactacactggagtgtgaagaagcaagggatgcagaggggtagataa

SEQ ID NO: 36902 - DNA, 555 bp, Glycine max
  Peptide Sequence Number=SeqID_128587
atggcaagtccgatgacacatagagaccaatatggtcatctgcttcctttgttgaagactcgatgtctatcaatcgagactactttagtctcccttcgtcatccagagacgacaagtctgatgatgcgcagagaccaacatggtcgtttgtaccctttgtcaaagacgcaacatctatcgaacgagactactttagtctctcctttcgtcagccagaggcaagcgagccgccagaggcatgcaagcatgttgacatgcagagaccaatatagtcatctgctcttttcatcgaagactcaatgtctatcgatcgagactactttagtctccatttcgtcaaccagaggcaagcaagcctgtcgcaacgtgcccttttgcgggcgagcgagggcgaggctcacgggtgcgctttccaaaggaggaaagatgcgcggagtcgccaccaacgaaggtattagcacctctcacgtcaacaaaagcggggctcttgctcctacgtaccctccatcaaagaggaaatcagacctacgtagttcttccttatgcgtgaatcaa

SEQ ID NO: 36903 - DNA, 323 bp, Glycine max
  Peptide Sequence Number=SeqID_128588
atgggtgaaacagacgaggttcaagagtggataaaggctaacttggaggccatgaaagagcaaatggccacaatgatggaggccatgatgagcatgaagaagataatggaggtcaatgcggccacaattgccgctactagtgccgttgctaaggtggacccgactcccccatctagcctcaaccaaataaatcatccaacctcagatatggtcatggaggcaaagaattgggaagtacgggcggcccctattttgtgcaaattcagagcaagcatgccttcctaccatacggcttgccccccaactatgcaccacccagtgtg

SEQ ID NO: 36904 - DNA, 419 bp, Glycine max
  Peptide Sequence Number=SeqID_128589
gtatgccacctaccaggcaccctctagatccagataagtctaacaaggccctaggttttccagcattgatcacgggtctctgccagtcattcggggttcccgtcacacctagtaaggccgcagacgcatcgccaccacctcatcaggctgatccagctgggtcatttggcatggagcggtatttacaacacttggttcaccagcaggcgaccaaccacagggggcagagccagggttacactccttttgcatgccctactccagatcagttcaaggctgaggttgcatggcccggagattggcctgaggcccaggcaggggaggcgcccgcagaggctcccagcgacgcggaggaggcccgcatggataaagagatgacagatttactcggtttcttgggagggagtggagccacgtga

SEQ ID NO: 36905 - DNA, 202 bp, Glycine max
  Peptide Sequence Number=SeqID_128590
atggcacgcaacaagtccgcttcgtgcccctattcaaggggcctatatgggagggagctaactaggcttttagtgataattcccaaggtggtcagatctgtcttgatggtctttagaggtatcatcccctttgaagaacatatcgcagcagtagggactactagcaacaatatgttatcaaagagaaaaactctagatgagg

SEQ ID NO: 36906 - DNA, 370 bp, Glycine max
  Peptide Sequence Number=SeqID_128591
ggtttgttggtgatttggaggggaggtttcttcactttgacattcagagcactgggcagaaatcacttgactgttcgacgcccggggaagaggccccgaagggcccgttcccaatccgtcccccgaccggcacgcgacgacccgctctcgccgcggaagcagctcgagcagtccaccgacagccgacgggttcgggactgggacccccgtgcccagccctcagagccaatccttttcccgagtacgaccgggcgtgggaggcactcggtcctccggattttcaagggccgccgggggcgcaccggacaccactcgacgtgcggtgctcttccagccgctggaccctacctccggctgatccgtttccagg

SEQ ID NO: 36907 - DNA, 156 bp, Glycine max
  Peptide Sequence Number=SeqID_128592
atggcttacactcacattccgcctttagcccgcattcaattagaccttgcaccttacgcttcagagctacttctgaatgaacccccggggcttaacgatgacaagcacactattgcgttacgagtcgtattctcggagacacaatggaagggttga

SEQ ID NO: 36908 - DNA, 78 bp, Glycine max
  Peptide Sequence Number=SeqID_128593
atggcggaaatcaaccaaggtaagacgatgactagtcacgattggccgcgtattgtttgtctcctacttgcaggttag

SEQ ID NO: 36909 - DNA, 273 bp, Glycine max
  Peptide Sequence Number=SeqID_128594
atgggggtgcaaatagcatccaggcccacttggccctccagaatattcctccagaacgctgttgcttctggaggaagcaaccctgctcgcctgggcgagctgggcggcaagcatctcccctattttgctataaataggggaggaagtgaagaagaaaaggccgaggcgcttccgaaacatttccgtaacattttccgtgaagaatttcgcaaaggtttcgaccgttcttcgacgttcttcattcgttcttcatcgttcttcgatcttcaacgg

SEQ ID NO: 36910 - DNA, 192 bp, Glycine max
  Peptide Sequence Number=SeqID_128595
atggagaagatgattaagaacaaggaattaaagccttggatcttctttatcaatggagtccttttcttcttgaaggtcaatggcagcggaattgagaaggaggaaaggacaagctcaccaccacaggaagccatggataggagcttgaaggtaggagaagatgagtattgggagagggagagagggcaatga

SEQ ID NO: 36911 - DNA, 177 bp, Glycine max
  Peptide Sequence Number=SeqID_128596
aagcaacaaacaataataaataaagaaaggaagagagagaggagacgccacttcaaggagaagatgagcctagaagaagctcaccaccataggaggccatggataagagcttggaggaagaaggagatgaatgaagggagaggaagagaagagcacgaaattttgtgctctaaatga

SEQ ID NO: 36912 - DNA, 267 bp, Glycine max
  Peptide Sequence Number=SeqID_128597
atgacccaagagtccggtagcatgcggagataccttatagtcatccgcaccttttgtcaactagaggcaaatgagcctgttgacacgcagagactaacgtcgtcatctgcaccctttgtcaaccaggggcaagccaagcccgttgacacgcagagactaacgtcgtcttctgcacctttgtcatccagagacggcgagtccaatgacatgcggatatacccaagtggttatccgtacaaaacgatttctgttaatcctgacccgtga

SEQ ID NO: 36913 - DNA, 414 bp, Glycine max
  Peptide Sequence Number=SeqID_128598
gcaaaagcaagaatcttggcaggtagaaacgaatgggccccgttcatagacgttctcgcactgttgatctttggaggagtcctcttttcgaatgtggatgggttggtggacctggcagcgatcgacgcttttctcgcctatcataaccacaaggaaagccggcccgtctatccgctacaaggtcaccgctcgtgcatcgaaaaaggaaaggcgaattgggaccaactcttggctagcatggaggggcgtctgggttgtattaattataatcccgtccttgccataagacagcttggctaccccatgagaggagtgccatcagatgaaagcatcacgcctttcatcgcacggggtttcagtgaccacaacgcgagggtactccaaggagttcgcaaggcatgggatgcggcgtga

SEQ ID NO: 36914 - DNA, 266 bp, Glycine max
  Peptide Sequence Number=SeqID_128599
aagttgtcatcatcaaaaagggggagactctagaagcaaagcttcatggtgaatcaaaggtgattcaaagatgttttgatgataacaatgatgatgacaaaggtaatgacaaaaagctcaaagatcaatcaaagaaaaactcaagtgaatcaagaacaattcaagagttcaagataagaattcaagactcaagcagaaagtctagagacaagaatcaagattcaaggttcaagatctcaagaatcaagatcaagattcaagaataa

SEQ ID NO: 36915 - DNA, 204 bp, Glycine max
  Peptide Sequence Number=SeqID_128600
atgtcatcgtggcatagggagtgtcagtcgcccccagcaaagtcatcagacccccctaccaatcgagctttcatcaagaagtactgcgcccccaggcaggcgcagggcgaaacaccgcagcaacctggggatggccagcagcgggcaacagacgcgccgccatcacctctagagttcacctcagctcatccacaaaaaggttag

SEQ ID NO: 36916 - DNA, 422 bp, Glycine max
  Peptide Sequence Number=SeqID_128601
gactctgccagtcgttcggagtccccgttgcacctaccaaggtgattcggccgcccatcacccgagcttttattgagaagtactgtacccagagacaggctcagggtgatgctccacaggccgcaggcacgccaccaccgcctcatcaggctggccaggctggggcatttgacatggagcagtatttacggcatttggttcgccagcaagcggccaaccaccgagcacatagccagggcttcgcttctttttcatgccctactccagaccagttcagggcagaggttgcatggcccggagattggcccgaggcccaagcaggagaggcacccccagaagctcccggcgatggagaagaggcccgcgaggacgaggagatggccgatttgcttgacttcttgggagggagtggagatacgtga

SEQ ID NO: 36917 - DNA, 150 bp, Glycine max
  Peptide Sequence Number=SeqID_128602
atggtgcttacatcagcaccgtctttgaaagtaagcattctaagacggtgcttacatcagcaacgtcttagaatgcctactttcaaagacgttgttgagtgtattaactaccaggaaggattaagcggtttccacaatgtaaacctttga

SEQ ID NO: 36918 - DNA, 378 bp, Glycine max
  Peptide Sequence Number=SeqID_128603
atgatcatcatcaaaacatcaaagccaattgcatctacagtgccaacggacacgactgtgtctgaatgcaaaggggtgcggataccaatgaccaaacttggtctctgcgtgccatcggacacgactgtgtctgaatggcaaaggggtgcggataaccgtaaggtatctccgcgtatcataatgaccaaacttggtctctgcgtgccatcggacacgactgtgtctgaatggcaaaggggtgcggataaccgtaaggtatctccgcgtatcataatgaccaaacttggtctctgcttgtcatcgggcccgccgcctctggatgacaaaaggggtgcggataaccataaggtatctccgcgtatcatgggtgcagaatga

SEQ ID NO: 36919 - DNA, 264 bp, Glycine max
  Peptide Sequence Number=SeqID_128604
atgcaacagggacaagcagatattctcatagctaggttccctgaccctaactatggtgtcaaaacgaggtctctctctcgttcgtgcctgtcggtccaacgcaagtctctattacgccaaaacgaaaggaattttagcataggcttcgaaaacaaggtcaaaggcaacattcggggtcaaataccgttgtcaaaacataaagggatgagggtatttcgggttctacagaaaggaaacatgtttttgaaattccgatcacgctaa

SEQ ID NO: 36920 - DNA, 390 bp, Glycine max
  Peptide Sequence Number=SeqID_128605
atgggatattatttctaccaaccttctaaccataaagtgtttgtggcaagaggagcaaactttttggaaagagagtttcttgtagaaggaaaccatagcaaagaaattgaacttgatgagactcaagtcaccaatgataacataactcaagaacatgagatggaaactgagaggcctttctttgatgttttgaaattaggacaaaactcttcaactcaaacaattatggctcaagaaccagctattgttcaagaacaagtcgttgttcaagaagaagttaatgaaccaatcttagaacaattgcagcaacctttgaacccaacacaagaacctcttagaaaatctactcgaatgcatcgtgcacctgataaattaaacttaatggtgtaa

SEQ ID NO: 36921 - DNA, 408 bp, Glycine max
  Peptide Sequence Number=SeqID_128606
atgtcgaggaaaggaccaagtatgaagaacctcttaggggatttgagtgaagaagcaaaaggggaaaaatctagtgaagaaatatacccccaagaagaaggacaaccattagtggttaaagagaagtgtaaggaggtaagtgtctcctccaagagtttagctaagaaggaaactcattttacaataaagacaaacattaaagaaactttccctcttagacaacctccacattttcgcttttgtaaaaagacacttgttagcattgccacacctcttgggcttgagtttattcctcaagtaaagaagttgttgaatgagggtttggtttgcaagagcttaaatccttgtgctttgttggtgcccaaaataggtattattaggcaccaagtccctaaaatagtggtatga

SEQ ID NO: 36922 - DNA, 183 bp, Glycine max
  Peptide Sequence Number=SeqID_128607
atggaggttgatgaaccttggttggggttatggctaccattgaattatcaagtagatatgggagcaaactttgtggttgatttagggatggcctttgtggataactgggtggtgggtaaggagaaggtttgttattggctgagtaatgacattgttgggttggtgggaaacttggctgtatag

SEQ ID NO: 36923 - DNA, 438 bp, Glycine max
  Peptide Sequence Number=SeqID_128608
atggacattgaagaggatgatgaaatccctctgattttgggtcgtcccttcatgctaactgctaattgtgtagtggatatagggaaaggtaatctggaaatgggtatagatgaccagaagatcacatttgatttgtttgatgccgagaagaacttacttgatcgaaatccaagattgctccagacccttgaggtaatatgcgtcaagctagtgacgttaaagaagtgcttattaggaggcaacctgtcgcaacatgcccttttgtgggcgtgtgaggcgaggtttacgggtgcgctttccaaaggaggaaaaatgcgcggagtcgcacccaacgtcgacaaaagcggggcttttgctcctacgtatcctctatcgaagaggaaatcagacctacgtagttctttcttaagagtgaatcaagcgattccttttacttga

SEQ ID NO: 36924 - DNA, 351 bp, Glycine max
  Peptide Sequence Number=SeqID_128609
atgtctcggaagcgttacggaagtgcctcggcttggatttttttcacggaaacaatttttctcactaatttcaagagaatcctaaataccagaagggctgaacgaaattactctaccctctttcccctatttataggggaaaagagggaggtggttgcttccaccagtaggcaccaccttctgttggaacatcctggaaggcccaaaactttacggattgcgcgacaatgctccctttcgacttccggcatgtcgcgaaacttcacagattacctaacaatgggtgttaagtacctcaaagcggtcaagcaaaggttgcagaccatcaaacaatggtgccggacgaaataa

SEQ ID NO: 36925 - DNA, 469 bp, Glycine max
  Peptide Sequence Number=SeqID_128610
atgcatagatctcccataggtagtttagttcctctggacttggaaattgaagctaccttaaaaaggaatagagccgagaggagaacaaagttgttgcaagataggacaacaacttccattctagaagaagaagctcaatcttctgactctacatcatctgattcacagtcatcaagggaatccgctacagatctatcggaagcctttttcatggttgaagaacatcaatacagggttacccttgaggattattctagtagttcagtaccgcaattctttacaagagaagccaagaagtggctccattcattcaaaggtaacagtctgaagatgtgggaggaagttgttgagaaattttttgaagaaatactttcccgagtcaaagactgcagaaaggaaaagctgttatttcatcatttcactagttccctgatgagtcctttgagtggagcattggagaggtttcggg

SEQ ID NO: 36926 - DNA, 612 bp, Glycine max
  Peptide Sequence Number=SeqID_128611
atgagaggaagtcaaagaagacaaaacttcaaacctaaaagaagaactgaagagtcatctcaaatcccaaaatgctttgagtgcaatcaacccggacatctgagggctgattgtccaatctttaagagaaagatagagaagtctgaaaagaagactattggagataagaaggcaaatagggcctatatcacatgggatgataacgacttagaatcgtctgatgattctgaaaaagaaatgattaatctatgtctaatgggcaaaaatcatgaaagcaaagaagaggtaacatcttctaacaaatctatttcttttgatgagttacaagatgcatttgctgaattacgtagtgaatcaattaaactagcaaaacttgtttcttcatctaagaaaacaatttcagatttagagaaagaaatttcaaaattaaacaaagaaatagatattcttaaaactgaagtttcaatctctaaatctagtgataaagttcatgtttctactatgactaatgaaaaaggggagaatgtgaatgtatgtatacatgattttgatgatgtcaaagaagaatctaacaaggctgcttcaaatgataagcatttgcttcaagaataa

SEQ ID NO: 36927 - DNA, 846 bp, Glycine max
  Peptide Sequence Number=SeqID_128612
atgcgatgtgctcgccgcccagggcccagcgcacggtaccacggcggcgccattgcagcgcacttcgaaggcgcagtcggcatcgggcgcgtcggcctgccaggcgcagtcggcgccgaacgtgacggtttcggaccagcatccgcgcgcaatcacccggtccagcgcgtcggagtgggcggggcggatgatgcggccggaagccgggatggtgcgtaccaggtggtggaattgggtttcgatggccgccagatccgggaagatgtccgcgtgatcgtattccaggttgttcaggacggcggtgcgcgggcggtagtggacgaacttcgaacgcttgtcgaagaaggccgtgtcgtattcatccgcctcgatcacgaaggggcggcgcgcggggtcgtagcgcgccgatacgtgcaggtccggcgcgacgccgccgatcaggaagttgggggcgagacccgcggcttccaggatccaggccagcatcgaactggtggtggtcttgccgtgggtgccggccaccgccagcacatgggcgccgggcaggatgttgtcgcccagccattgcgggcccgacacgtagcgggcgccggattccaggatggcttccatcagcggattgccgcggctgaccacgttgccgatcacgtacaggtccggcttgagggccatctgtttggggccgaagccctcgatcagctcgatgccctgttcggacaactgggtgctcatgggcggataaacgcccgcgtcgcaacccgtgaccttgtggccggcggcgcgcgcgatcagcgccaggccgcccatgaacgtaccgcagatgccaagaatatgcagatgcattga

SEQ ID NO: 36928 - DNA, 143 bp, Glycine max
  Peptide Sequence Number=SeqID_128613
aggaatgtggaatcatcccacaatacaccatgtcggggtcacctagcatgaatggtgtggctgaaacacgaaacaaaactcttaaggatatgaggcaaggccttataagccaaatgaaaggaaattggactctcgaacagtga

SEQ ID NO: 36929 - DNA, 684 bp, Glycine max
  Peptide Sequence Number=SeqID_128614
atgcagaattttgctgtcaaaataagtgcaacaggattttggcttgcacagaaaaatgcttgtgcgtggttggctgtggaaagagtagtgcagaatgagttctggatgtttgctatgagaaaagctgtgattttggttgatgtgttgagcagagttttctgcctttgctctgttttgcttggctgtgatagcttgtgctgtttgaatgttgttttacttggatgttgtggaagcttgggaggattgatggggacccggggatggtgggtttatgcgcgcattgtggatgtggaaaacttgttgtgcaccatcgcccgaccgccacctagtaccacatgtgatggagtggtacctggagatatgtcgcgggggtcaggagaccttggggacgtcaggcgagctcctggcggtcaaccaataaaagaacaaagaccacaaagcaaggaggcttgtgtggtggttggccagctatggatcttgagtggtatctggaattttgcctctggtaatcgattaccaaggatcgcgatggcagcacaattaatccatgatcgcgtggagatggagtgcctagagggagtttgggagaccctcgaaggcaatgagaggtgccgatttcgtggcacgattcgactcactgctacttcattggtacatccagaggaacccgcacgcacgctttag

SEQ ID NO: 36930 - DNA, 213 bp, Glycine max
  Peptide Sequence Number=SeqID_128615
atggcttcttcaggagtcttaagctttattttaccccctatagaagcatctaagagcttgttagattgtggcctcaacccgtctatgaaaatattcagttgtatgggctcagagaatccatgtgatgtgaacctgactaggagcagacctcttgatacaggctacggagatttggatgatgccacttccaaagaggaagataagtcagggtag

SEQ ID NO: 36931 - DNA, 318 bp, Glycine max
  Peptide Sequence Number=SeqID_128616
atgagtgttaagtgttccaaagtgatcaaccaaggtcacatgccgacaaacaatggtccccagacgaatttagggtatggcaaccctattacagtacccaaaacacaagagacactaagagaaaggcttagaagtcaagattacctcaatgaagctacgaagggaaggattgagggaattttctccatcgaatccttgaggtggattctgaggattccgctccgattaaaacgttcctcttggtgtcggggttcggcggcaagcaatggcggcttgtggtggccaccggtggttgtgggtggtggaagaaggtgttag

SEQ ID NO: 36932 - DNA, 309 bp, Glycine max
  Peptide Sequence Number=SeqID_128617
atgccactgcgggccctagccgatcttggaatgaattctacgagccggctaagtcagaccaaggttactattccggggtacaatgccgactcgcagccatcggcaagattcgtctcttgtgtgtgccaaacatgggatctgaagactgagaacgagaagtaccagatgggggagacccgctacttcaacgaaatatactacctcactaagatggctgtcagcccgagtgcctgtcacgaccacaactaccaagattcaaccgtcttttgttttgctgctgctacgccctttctgacctgtccacattaa

SEQ ID NO: 36933 - DNA, 1175 bp, Glycine max
  Peptide Sequence Number=SeqID_128618
cagaagacttcgatgctgccatcatcttcgtgcgcaccaaaaatgccacgctggaagtggcagagacgctggagcgtaacggctacaacagcgccgcgctgaacggcgacatgaaccaggcactgcgtgagcagacgctggagcgcctgaaagacggtcgtctggacatcctgatcgccaccgacgttgcggcccgtggtctcgacgttgagcgtattagcctggtagttaactacgacatcccgatggatgccgaatcgtatgtgcaccgtattggccgtaccggccgtgcgggtcgtgccggccgtgcgcttctgttcgttgagaaccgcgagcgtcgtctgctgcgcaacatcgaacgcaccatgaagctgactattccggaagttgagctgccaaacgccgagctgctgagccagcgtcgtctggcgcagttcgccgcgaaagtacagcagcagctggaaagcagcgatctggatcagtaccgtgcgctgctggcaaaaatgcagccagaagaagagctggatatggaaacgctggccgctgcactgctgaaaatggcgcagggcgaacgtccactgattctgccaccggatgcaccgcgtccacagcgtcgtgaattccgcgatcgcgacgagcgtggcggcgaccgtccacgtcgtgacagccgtgacagccgcgaaggtggcgatcgtccacgtcgcgaacgtcgtgacgttggcgaaatgcagctgtaccgcattgaagtgggccgtgacgacggtgttgaagtgcgtcacatcgtgggcgcgattgctaacgaaggcgacatcagcagccgttacatcggtaacatcaagctgttcggtactcactccactatcgagctgccaaaaggcatgccgggtgaagtcctgcagcacttcacgcgcacgcgtattctcaacaagccgatgaatatgcagctgctgggcgatgcacagccacacgagcgcaccgagcgtcgtagcggcggtcgtgacttcggtggtgagcgtcgtggtaaccgcgagggtggcaaccgtgaaggtggcgcaccgcgtcgtttctctgagcgtcgcgaaggcggtcgtgaaggcggacgtttcagccgtgaaggtggccgtggcccacgtcgcgacgaaggtgcagctgcaccacgtcgccgtgatgcataa

SEQ ID NO: 36934 - DNA, 498 bp, Glycine max
  Peptide Sequence Number=SeqID_128619
atgcttcagtcaagtattgaaactcaggggatagacagaagaagggacactgttgaagcggaagaatattcccaacaaatggcggagcgtggccatggaatgtattacacgccacaaacatttgctgagtatccgacacagatgtatcagtatccttttcagggtcatcacactgatacttctgcaagccagcaatcgttcggtggtgttgcggaaacacaagctcatttttcatggcccacaatgaccccttcacagcaatatcatggcccaattccaacacctaatgccccgttaggaacacaatggaatgtaccgggacaaatacctaatacgggtgacttattcggtgttgatttgcggcacgcattttctgcggaggctgacgaagaagaagcggggaggcatcggggcagaagaaattctgatcgccaatcacgaagatgggatcgaccatgtggcacatcctcacgacatcacggacaccaaaatgaatga

SEQ ID NO: 36935 - DNA, 258 bp, Glycine max
  Peptide Sequence Number=SeqID_128620
atgggagaaagtaaaaagaaggaagctcctggtcaaagaaaccagaagaaatgtgtagagaggtctttggaccggacaatatctgaacaaatacagaattgtcaccaaatgaacaaaaaaggaaggaaaggaaaccacgacctaaagtggtcttctccctttgattaccaaccaaaatcccgaaataatttgcaaagtcaagtcatgatatatctatggttcggaattaggatgaaacacttacctgtgcgagattga

SEQ ID NO: 36936 - DNA, 315 bp, Glycine max
  Peptide Sequence Number=SeqID_128621
atgttgcgaaactttatggattacgcaacaaggctcttcttgacttccggaatgttacagaactttacggattgtgcaacaatgcttcctttcaacttccggaacattgcagaacttcacggattacctaacgatgggtccgcatccagagaaaaaaggaggctgcagcttttggagttggaagagatgaaatttattgcttatgaatcttcaaatctgtacaaagaaagggtccaaatgtatcatgacaaaaagctgctcaagaaggacttttatccaggacaaccaggtgttgcttttcaactcaagacttaa

SEQ ID NO: 36937 - DNA, 177 bp, Glycine max
  Peptide Sequence Number=SeqID_128622
atggcttgtcttgatttcaggtgttgtcatcatcaaaaagggggagattgtagacaaaagatcaagctgaaagttttgatgatgccaaaggattacatgaatcatatgcttctcaaagatttactcaagacaaagcaattagagttaatcaagatggatgatcaagacagtctatag

SEQ ID NO: 36938 - DNA, 312 bp, Glycine max
  Peptide Sequence Number=SeqID_128623
atgaagtcaggtgacatgcgggggtaccgtatggttatccgcacctttcgtcaaccagacgcaaacgagcctgttgacgcgcagagactaacatcgtcttctgcaccttctgtcatcctgactcgtgaagtgttacttttatcgtccagagacattcaagtccgacaacgcgcaagattcttctctgctaggcaaggacgatcgagttcgatagcttgtggaaacgtcatggttatcccgttttatcgctttcgaggcattgaagttttgctgacgctcctgatgccttttcttttcttttttcctgaatga

SEQ ID NO: 36939 - DNA, 414 bp, Glycine max
  Peptide Sequence Number=SeqID_128624
atggaagggttagtggacctagcagcgattgacgctttcctcgcctttcatcatggcaaggaaagcccggtcgacgccattttggccatgtatgacacattcgaccggggaggtgaaaagagtggcgcaagaattgtttgttgtgcactggctctctatgtgtggctggtttcacacctttttctccaagaaggaaggaagaatcgggattctatcttcatacgaaagatgtccaaaggttcccttgatggaacaaggggttgtattaatcccgtcctcgccataagacagcttggctacctcatgagaggagtgccatcagacgaaagcatcacgcctttcatcgcacggggtttcagtgaccacaacgcgagggtactccaaggagttcgcaaggcatgggatgcggcgtga

SEQ ID NO: 36940 - DNA, 639 bp, Glycine max
  Peptide Sequence Number=SeqID_128625
atggtgatccgcacgttggcgatggccgtctccagcctggtgctggcaggctgtgtcagcgtcggccccaactacaaggcgccggtacaggagcctgtggtgctgcggggtgcgcagcagccggtgttcagcaccacctcgccggtggccagctggtgggcgcagttcgatgatccggtgctggaacagctggtgcatggcgcactgtcggacaacctggatcttcgcgtggccgtggcccgcgtcagccaggcccgcgcggtgttcgtcgaaagccgtttcgaccaggccccgcacatcaccgcaggcggcagctacgaccgccgcaagcaacccgatccgcagctgggtgggcagcgggtgttcagtgaaagctaccagctcggcttcgacgccggctgggagctggatctgttcggccgcaagcgccgtgctgcagaagccgcgcgcgccgacctcgacgccgagcaggccaacctggccgatgcgcaggtgctggtcgccgccgaagtggcgcgcaactacttcgagctgcgcggtacgcagaagcgcattgcggtggcccagcacacgctggtcaacctgcgcgatacgcagaagctgaccgaggcgcgctgggagctgggcgccgggcagtga

SEQ ID NO: 36941 - DNA, 80 bp, Glycine max
  Peptide Sequence Number=SeqID_128626
aaaaggtcaaaacaaaaggtgctcaaaagaaatcgatgaccaaacatcaaaaatcaacaaagcgtgatccatcttactga

SEQ ID NO: 36942 - DNA, 872 bp, Glycine max
  Peptide Sequence Number=SeqID_128627
aagaaggagtgcgggacatgcggtcatgggtgaggggtcagtggattacctttgacgcggatgccctcaaccagttcctgggtgacccgctagtgttaaaggaaggccaggagtgcgagtttagtcagaggaggaacagggtcgattggttcaacgaagaggccattgcccagctattatgcataccgggtcaggatttcgctcggaccgctgcagggaggcgggtgcggatcatgtgcaccagcatgaccaccttgacccagatatggatgacattgctactcagcagtgtcttgcctagtgatcataactccgaccttcctttgccgaagtgtcagctggtgtatgccatcctgacatggatgagcgtccatgtggctcagttgattgctgacaccatctatttatttgtaggtatgccaaccaccaggcaccctctagacccggataagtctaacagggccctggggtttccagcattgatcacgggcctctaccagtcattcggggttcccgtcacacctagtaagacgcaccgccaccgcctcatcaggctgatccctgctgggtcattaggcatggagcggtatctacagcacttggttcgccagcaggcggccaaccaccgggggcaggtgcagatacatgactgtctttaccagctcagcctcagtcagcagggccagggtttcgttcctattgcatgccctactctagatcagtttagggatgaggtcgcatggctcggagattggcctgaggcccaggcaggggaggcgcctgcagaggctcctggcgatgcagaggaggcccgcatggatgaggagatgatgaatttgctcggtttcttgggagggagcgaagccacatga

SEQ ID NO: 36943 - DNA, 825 bp, Glycine max
  Peptide Sequence Number=SeqID_128628
atgaataacaagctcaacgccatttctacttttctctgtgtcgcgcaggcagggtccttttctgcagccgcccgccagagcggaatgaaacaatctgccgttagccagcagatcgccgcccttgagcaggagctcggcgtggtgttactgcaccgtacaacgcgcaccatgaagctgaccgagcagggggagcgttatcgtcgggacatgcaactgctgctggacgccatgcgggaagcggagaggcggctcaatcccgtcgaccaccagtttcagggcagcgtgcacgtccaactgccgagcggcctggggcagattgtgttgccccatttactgacgctgcaacgcctgcatcccgaactgcatctgatgatttctcttgatgaccggattgccgatctggtgacggagggtgtggatgtggcgatacggctgagcagcgagcccccgcaggcgcatgcggctcgcgtgctggcgcgtattgaaacggctctgtttgccgctcccggttttccggcggtggacgacgtcagcgaactcgcgacgctgccgcacgtacggtttagcggcatcccgccggatgttccgctgaggctgattgctgctgaggaaaccctcgaggtgaagcgacgcgctgttacaggcgctggaggcaggcatcgggatcggcggcctgcagcgcccgcttgcggcccgcgcgctgcaggccggcacgctggtaccggtattgcccggctggcggttacccgaccgcgttctttatgccgtttaccccgacgcgcgctttattccacaacgcgtccgcagcgtcgtgggcgtgattga

SEQ ID NO: 36944 - DNA, 588 bp, Glycine max
  Peptide Sequence Number=SeqID_128629
atgacgttgctgctcaacaatgtcttgcctagtgatcataactctgatctccctttgccgaagtgtcagctggtgtatgccatcctgacatggatgagcattcacgtggctcagctgattgctgacgccatctatttgtttgcaggtatgccacccaccaggcaccctctagacccggataagtctaacagggccctggggtttccagcattgatcacgggcctctgccagtcattcggggttcccgtcacccctagtaaggtgatccgaccgtcgatcacccgggctttcattgagaagtattgcacgcctagacaggcgcagggggatgcacctcaggacgcagacgcaccaccgccacctcatcaggccgatcccgctgggtcactaggcatggagcgttatctacaacacttggttcgccagcaggcggccaaccatcgggggcaggtcgcatggctcggagagtggctcgaggcccaggcaggggaggcgcttgcaggatcccttagcgatgcagaggaggcccgcatggatgaggagatgatggatttgctcggtttcttgggagggagcggagccacatga

SEQ ID NO: 36945 - DNA, 168 bp, Glycine max
  Peptide Sequence Number=SeqID_128630
atgggggtgcaaatagctaccaggcccacttgggccttccagaaaattcctccagaaggcggttgcttctggaggaaacaacctagctcgcctggcgagctgggtgggggagaggtgaagggaaaaaatgttcaacccttctggtatttcgagatcactaaaaattag

SEQ ID NO: 36946 - DNA, 582 bp, Glycine max
  Peptide Sequence Number=SeqID_128631
atgtcagctctgaaagatcaaatggcctccatgatagaagccatgctaggtatgaaaagattattagagagtaatgcagccacagctgccgccaccagcaccgccgctaaagcagacccagtccttccgtctacaacaaatctagcgcatcaactcgccccggatatggtgggacgaggaagagatgctttgggaaatgccaatagcccacatttggggtacaaccaaagtgcttacccctaccgtctaccccccaactttacaccacctgtcatgcatgagaacgcgaaccatcctgtagggggtgcctgcgaagagtctcgggagcatgcccaaggggacgtcgactcatacccccctttcaccactgagggactggcacccaatgccttgcctcaacctaatatcgcgggagtctctcaagcccgcccaatgcaaccactgcttttctccgtagagggaccgcctccgacagtggaaggaagagaaaagcttgatctcatcaaagagagattgagagcggttgaagggttcgatgactactccttcgccgatatgaccgacttatgcttggtgccggat

SEQ ID NO: 36947 - DNA, 516 bp, Glycine max
  Peptide Sequence Number=SeqID_128632
atgggcattgaccaatccctattctatgacttgacccaattatccagtgaaggtgtaccatttgaaggtacactgattgatgattggaaatatgatttctctgtgcatgatgcccgccggttggtttgcaccaaccaagcggatatgactggaaggcttcttgccggttcattggcttttgagagccgcatccttcattatctcattgtgcgtatcttgcttccaagatcttcaaaccttgcacaggtttctgaagaagatcttattgttatggtgctcaacccattgatgaagaaggacatttacatggtggagaagattcctctcttcttcaaaagattttggacaggttcgatggtcttcaaacctttgttggtgaaaggtttgatactttggagttacaagtggacagttcgattcaatgagatggagtcaaagatcaccaaggtcgaagaaaatgtttcttacattcgtacaagctttgatctaccaccaccgccgccaccatcatcttag

SEQ ID NO: 36948 - DNA, 413 bp, Glycine max
  Peptide Sequence Number=SeqID_128633
gtttctctatcaaatcacaagagactgagtctgccattaggaatcaagaggtacaagtgggccatttagctaagcaattggctaaaacatccacgaacatttttagggccaacacagagaagaatcccaaggaggagtgcaaggtaattttcattaagagtcggaggagggagaatgcagagagagaaaagagagctaagggagtattggaggatgtgagtaatgaggaaggagagaataataagatagaagagggtgatgaagagaaagaagagagcaaggaaaagggtgaaaaggtcttacccactaagaccaagagtcagttagcaatggaggctagaaaagagatacccttagtcccagtgaaggacatcccatatcccttggtgccatcaaagaaagataaggaatga

SEQ ID NO: 36949 - DNA, 165 bp, Glycine max
  Peptide Sequence Number=SeqID_128634
atgtgtattatcgatataggggatctttcaattgagaagatccatcgacctgagacgaagagaaagaaaggaagatctgtttgggaagtaagaagttcccttgacatctcttcatctgtaaagattgtcgatgtgaaaacacagagacaaaaggctgatctttga

SEQ ID NO: 36950 - DNA, 774 bp, Glycine max
  Peptide Sequence Number=SeqID_128635
atggtttcacacctgttccagcaagacactaggcatccatgtccgctccaaagccatcgctcgtgtgctgaaaagagaagaatagattgggaccaacttttggctggtgtaggaggtagaacaatcaattggttctcccgatggaaggaaggaaaggagggagtccttttctcatgtaaagggtacccaaacattccgctaataggaacgaggggttgtattaactacaatcccgcgctcgctataagacaactagggtaccccatgaggggagcaccgatggaagaaagcaagtctcctttccttgtaagggatttcggcgcgcaaaatttcaaggctatacaaaaaatccataaggcatgggaaaccccgttaaggaaagatcaagaacttaggggcattcgtaacggcatcattggtggttatcatgaatggctgaaagttcatatacgaggtttagattggctcgccaagttaaaagtcgtcagcgaagacagtttcgaagcaccagaagaagacgaagaagtccaagctctcaaaaacgagttaggaaaggcgaaactaccgcaagagaatgctacacacatccggaaggaatgtgccggattacgggaagagaatgcaactaccgcaagagcccttgagcaagagaccaagagggctcgcaaggaagagtatggccgtaacaaattttgcggagctctgtggggtagcaacaatgaactcaagctgcgaagggaagagagggaccagtcgcggagctctgtggggtag

SEQ ID NO: 36951 - DNA, 880 bp, Glycine max
  Peptide Sequence Number=SeqID_128636
atggaacctgaattttgggacaaaaatcccttcaaggcgacggccaaggctttcccaccaggatttcactacaaaccaaccaccatcctgaagacaagaactttttatgaattgattttggtagattcaaactcagtatctatcaaacacttcaaagacccaaaagaccaaaccttaaacacccactcaaccatccaaatactaaaagttcttcaaccgagacactttggttcggacttgaacaaaggaaagagattctcagttccatttgatccggtaggttatacctattgggattacgttgatgcttggactaaggtgttttggcaccaaaatacccgcttcaagcattcatggttgatatatttcaagaccaacacaatttacaattttcccaattggtttttgcaatggtgggacttctttggaccaatcccagagatattcccagaaacggtccaacaaggattttcccaatttaagaaacaatacaattcgcaggaatcacgaattccagcagatcttaaatacttttcaagctttgcactgtcatggatattctcatggcaatatcgttacagcaagactgaaaagacaaaccaatatccatcactacaaagacacgcatttgtaaaatggtggacacaatttgactcatccaaagcggatccagaacaagtaaaactatggttccaatcccatccagaattcctcaaggcagctgatccagagacttctgtgtttttgaaccaaaagtctcatctggcagcatttttagcaggatcgacatcaaaggaggtcttagctaaaaatctgaaggaagttctacaaatgttacaacaggaagaagaagcttcatcctcaaagaaggaagaaacaa

SEQ ID NO: 36952 - DNA, 447 bp, Glycine max
  Peptide Sequence Number=SeqID_128637
gagacgccatccagtagagaataagccatggaaggagaagcttcaccaccaagagagtgccttggataagaagcttagagaggaaccttcaatggaggaagagaatgagagagagtccatctctagaatatttccattggatttaatgatgaaatctatccaatttcaggtgaaaaagaggctaagtcatgaagtgctaaaagtgatagttgagcttagctcatctattgggctaagcgtgtatccaccgctaagcgcagcttcagtgctcatagcacgacagaagaatctagcagagcatcaatgtcaagccaggctcaacgcacgactggtgctaagctcaaatccacttactcgcgctaagcgtgagggtggcgctaaagcacaccataatgcctatttcgggaaaagagctctagaggcagcaagaggagcagcttttgctag

SEQ ID NO: 36953 - DNA, 648 bp, Glycine max
  Peptide Sequence Number=SeqID_128638
atgaatgagcatgatttagaagaagaagatgaggagaaagtgcaacaacgggaacaatgcttacaaacacacactcaacaagaagataatttccaagttaacacatgttctcatcaactgactatcaaagaagaaaggcatgaagatcatgagggttcaatcattctaagacaactctatttgccatttgctagttgtgtttcgacatgggatcaaaagattgcctttgacttaattgaatcaataaaacacccagatgatggtgaagattggtttgaagcaaaaatatcagagcatgagatggaattaacagcctcagccatgatattacagacgcctggggagaaagaatttgaatatgtgacaaaatgtctagtcaatgaagaaggaggaagaatgctagcttgtattgaaagcctgggggatccagacgatgaatctattagtcatgtgatgtttgaagaattggaaaacaatagaccaaaagaaaagcccaaagtggaactaaagacccttccagcgcatctaaagtatgtattcttggaggacaatgagaccaaacctgttataattagcatctccttgcagaagaaagaagaggatcaactagtacagattctaaaaagtcacaaagccgctattggttga

SEQ ID NO: 36954 - DNA, 162 bp, Glycine max
  Peptide Sequence Number=SeqID_128639
atggtttttcaacatcaagcttgtagagagttaaagaatcaagacagtcatgaagggaatcatagctcaaagggctatctcaaacatggaatagatagtcaagatgtcaagcctaaggctattcgtgcaagcaatccaatggggcaaaacaacaccgaataa

SEQ ID NO: 36955 - DNA, 141 bp, Glycine max
  Peptide Sequence Number=SeqID_128640
atgactaaagcacgtcaaaagggggtacggaaagggaaaagagggaggtggttgccacccatctcgcccaggcgagccgggttgcttccaccaaaaggcaccgccttctgttggaagacttggaggcccaagtgggtctga

SEQ ID NO: 36956 - DNA, 186 bp, Glycine max
  Peptide Sequence Number=SeqID_128641
atggatacctcagagccctacactggagcaataagaggcaccatgcatgagcctcaagcaaaccttggggcagatcaaaagttctcacccggagtagagcgcaactcaaaagttgaaatgaataaaagcaaggctctcaaggttcttactcaatataaccctcaaacactctttgaacctctttga

SEQ ID NO: 36957 - DNA, 423 bp, Glycine max
  Peptide Sequence Number=SeqID_128642
atggattctctcatcactaggttgcttcgtgtgccttatgcactgaaagaagaaaattcggctgatgtaatgaaaacgtcagccatggttgcacctcatgggagagggggaggacgtaacaatagagcagatcgcagtggaagaggtggacgtcctcaatgcacatattgcaagagaatggaccacactcaagagaattgctactccttgcatggcttccctgacaaagtaactcaggtagctcagacagaaaaatcagagtctaagttctctgataaagagaatcaagagtatttgaagctgaaatccgagaaatccaacagccaggcttcatcttcctctgtaccatgttattcaacagcatgtatttctcaatctattgacggtctcagtccttggatacttgattcagtgtccctataa

SEQ ID NO: 36958 - DNA, 310 bp, Glycine max
  Peptide Sequence Number=SeqID_128643
gtatgaggaaaaaagccagagtttcaagacctcgggattgaggtcaatccttttcaagggggagggaatgatgcaatcctaccctgcaagggcattggatagaaaactccaagtagattgggccagagatgcaagagaaggccctagggttcttatgagccttagggaatacatcaacatgaaaatcacagaaaaaggggttcccatgaaccctaagagaataaaggtcattcctgagtggctcgctccaccaagtgtaagaaaaatttggggcttccaagacttaacaaacttttacaaaaggtgttaa

SEQ ID NO: 36959 - DNA, 642 bp, Glycine max
  Peptide Sequence Number=SeqID_128644
atgccaatctccccctgcggaaggatcgcgccaacaaggcacccagtggactcagaggtgtccaacagggcccgggggtttccagctttggttacaagcctctgtcattcctatagggtgcccgtcccccccccccccaacaaggatcgcgcccgcaagacacccagtggacctggagaagtccaacagggtcatggggtttccagctctgattacgggcctttgtcagttctacggggtgcccgtcgccgccagcaaggcgtagggcgagacaccacaacagcctggagatggccggcagcgggcaacagatgcaccgccaccacctctaaagcccctcagctcatctacaaaggctggagcgttgcctatgactcgtggtcgaccagcaggcgaccaagtccaaagtcaaaggtagcgaaaataccttttgctatcatgacccgagagttcggtggcatgcggagacacccgacggtaacccgcacacaccctttgccatccagcgacccgagagtccggaagcatgcgggggtaccttatggttatccgcacctttggtcatctagagacggcgagtctgatgacatgcggggggtaccttatggttatccggacatttctgttaatcctgacccgtga

SEQ ID NO: 36960 - DNA, 341 bp, Glycine max
  Peptide Sequence Number=SeqID_128645
cccaaggcaaaggacaaccattagtggttaaagagaagtgtaaggagacacttgctaacattgccacacctcttgggcttgagtttattcttcaagtaaaaaagttgttggatgagggggttcccatgaaccctaaaagaataaaggtcattcttgagtggtccactccaccaacaccactcattgagttggtgagaaaccatgttccttcatgggaagatgcccaggaaatgggtgttgagggaaggagtccagattatgaagaacctcaagatttgaggtcaaatcgtttccaaggtggagggaatgatgcaatcctagcccgcaaaggcattggatag

SEQ ID NO: 36961 - DNA, 630 bp, Glycine max
  Peptide Sequence Number=SeqID_128646
atggctacaccacccagctctcctcctgctcctcctcttactaattcaacatcacattcaccttctaccatgaagaggacaagaaaagtgacccgactgagatcattggctactagaccagttggggcagagaaacccctagtccaagtggatcctgcaactgggaaagctaatggtccccacagaaagaagttaagaacatatttggggatcgtcactcgcgataaggtggatgtgacatacgagaattggaaacaagctggatttgatatccctgaagcatctgatttgaggatgaaaaataaaatacttcagaccatggggaagcagtggagacagttcaagactgattcaacgttgaaatggaaacaagttgatagaggagaagaaaagaaacaactggaggaagctactaaatctggaagtactgacactatcattgatcctccatctcccattagacgacatgtgaagtggaagatggcccgcaccaagaaacctgggcaaatgacttctgaggcagctaagaaaattgctgacaagattgagccggtgtcacgaccaaacaatactttggaccggctccaaggacctcccacacatctttgtccatggctcctgaagacttag

SEQ ID NO: 36962 - DNA, 243 bp, Glycine max
  Peptide Sequence Number=SeqID_128647
atgatggtagacaccttgtcagtgttttactatgagaagttggtaggctacatgccttccagcatcgcggacttggtattcgccggggaaagaatcgaagtagggttgaaaagagggaagttccagggttacgtttcctccacaagtaccaatgctaggagaatcggagcaactggggcaaaaaggaaggaaggagatacccatgccgtcacttcggcgcccacatgggtcaagccaccgtag

SEQ ID NO: 36963 - DNA, 534 bp, Glycine max
  Peptide Sequence Number=SeqID_128648
atgacaccttcgaccgaagatgtgaagaaagcaatgcaaggattgtttgctgtactccagctctctatgtggggctggtttcacacctttttctccaagaaggtaggcccgtctatccgctacaaggaaggaagaatcaggattctatcttcatgcgaaggatgtcccatgagaggagtgccatcagacgaaagcatcacgcctttcatcgcacgaggtttcagtgaccacaacgcgagggacagagagcttaggggaagcagtaatgggatcatcggcggctatcataagtggctgagagtccgaacacaaggattggattggctcccaaatctaaagactgtgagggacgatgaggttaaagcttcggaagaaagtgatgaggtacaagccctaaaggcagagcttgaaagagcccgagtagtcgaagagaagttcaaggcagcaatagtgagctcaagctccgaagaggtgaaaggaatcatcacgggtcaaaggcatgatctggaaggacgagctaaaggcttgccttag

SEQ ID NO: 36964 - DNA, 513 bp, Glycine max
  Peptide Sequence Number=SeqID_128649
atgggcccttgcagcccgattaggacggtgtggatgacactgtctgatgtgcaaagaaaggcacaggccatccagaaacagaacactgtcccccatgttttttcttgtgggggttatgaatatttggagcagaagctcctggctgaaaagacgaagaagaagctggaggaagctgcacagtcaggaagtgttgatggtgtcatcaaccctccatcccccgtcagacgccacgattcctttgaggagcaggcgacacagggatccttcatcccctatggacgtcaggatgttctcactgttgccattggatgtccagagcaccctggacgtgtccgtgctgctggagccggtgtcaccatcaagcaatacttcgaatcggctccacggacgtcccacagctcttcctcgctacctcctgaagaattgcagcagctgacccagcaaatcagggaccagctaaaggagtcgatcatagaaaaaatgactcggcagctcatggcatcattcagctag

SEQ ID NO: 36965 - DNA, 183 bp, Glycine max
  Peptide Sequence Number=SeqID_128650
atgggtgcaaatgatatcatcgttaataaacagctccattggaagcttgtaggtctaggatcttcttcatcaatggattccttttcttcttggaagatgaatggtagcggaatggagaaggaagagagagaggagacgccacttaaaggagaagatgagtctagaagaagctcaccaccatag

SEQ ID NO: 36966 - DNA, 267 bp, Glycine max
  Peptide Sequence Number=SeqID_128651
atggagaagagcaaagtcgatacattgatagcaatttctccaaacacatggcatgcatcaaaacaacaaacaaaggccacatttctccccaagaaaagtgaatatgcgatttatggagacaacaaacaaaggccacttgatcaacaaccccaacaattggaagttggaagtagttattggaagttgaaagttaaaaatggaagttggaagttggaagtggaagttactggaagttggaagttggaaatgaaagttattggaagttga

SEQ ID NO: 36967 - DNA, 519 bp, Glycine max
  Peptide Sequence Number=SeqID_128652
atggtgcagccccaaaaatcagctgctggcctaagggaaatccctatcacaacccatatatgcacaagtcaaatccccaagcaaaaattcacaaacccatgcgcaaatgtcattaaggcatttcaccgagcacttggtgggagcatgtttaggcatgaaaatcaagggaatgggggcaatatggcatgccccattatttcagaacacaacctaggcctaaggccatcccctacaacccctcaattcaacaaaaacaagcaacaattcaaggatagatccctcacgtttttgagcaaatacatgcaacttagagcaccaaaatacatcaatggaaagctcaagttcccaagaatgaggtacctacttattggagtgagtaggagtatcaaaaacgaaagcaaaatgcaacaaaaggtggcttgggggcgcaaaaatggcaagtcccgtagctttagcgtttttgaaagtgggggggggggagttttgggtgaagaaaacgtacccctccctctcttttaa

SEQ ID NO: 36968 - DNA, 171 bp, Glycine max
  Peptide Sequence Number=SeqID_128653
atgaagaatattccagattcgggagttgtatttacgtttgaggaaggtcgacaaaagcggggccctttgctcctacgtaccctctatataagaggaaatcagacctacgtagttctttctaaagggaaaatcaaagcgattctttttacttgggaaggaggtcctttttaa

SEQ ID NO: 36969 - DNA, 489 bp, Glycine max
  Peptide Sequence Number=SeqID_128654
atgaatcagaaatctacacctgttgcaagagtctgtggtctatgttcttctgcagatcaccattcagatctttgtccttctttgcagcaatctggagtcaatgagcaacctgaagcttatgctgcaaacatttataatagacctccacaacagcaaaaccaacaacaacaaaataattatgacctttcaagcaatagatacaatccaggttggaggaatcatccaaatctaagatgggcgagccctccacaacaacaacagtttatccctccttttcagaatgacgctggtccaagcaagccatatgttcctcctccaatgcagcaacaacaacagccccagaaacagcaaacagttgaggctcctccgcaaccttcccttgaagaacttgtgaggcaaatgactattcaaaacatgcagtttcaacaagagactagagcctccattcagatcttaactaatcaaatgggacaattggctacacagtaa

SEQ ID NO: 36970 - DNA, 737 bp, Glycine max
  Peptide Sequence Number=SeqID_128655
cctttgcacaaaaacaggcaaacggaaaatatcaacagtacttgccgattatcgaaaaagggactctcacgcaaaaggattctcttaccaacgtgttgatgagtgaactaaagacttataaatctgaagatgagtaccgcacgactatcaacatcttacgctcgttgggaaaagaagagcagcaatcttcggtagaagcattagcaaagaaaaaatatccaaaaggatcattaactcgagatgcctttataactgatgttttctataatgcaagtaccccggtacagaaagaaaatgcatataatgaactcataaagaaatggccagtcaaaaactttagtgaggagccattgacatatgattatgtattagctaatctagcgcagagttttgccaacgacggaaatgccccaaaagcaatacattatcttggtgagatgaaagaacgattctggcgtggaaacggatatattcccgtaggtcaaatcctattgagcgctggcgatacgattaccgcagcaccgctgttaaaaaccgctatggatgatagttactattatcttacccttcctgagaaccagaaagacaataaagcccgcttcgcagccatggggtacgcaagctccatgtcagcgtatgtaaacatccttgttgctcagaaaaaatacgctgaagcgctcggttatatagagaatgctttaaaggcagctccagagcaggctgatggattagcaaat

SEQ ID NO: 36971 - DNA, 186 bp, Glycine max
  Peptide Sequence Number=SeqID_128656
atgggacaccttagtgatcaaggggttcccatgaaccctaagagaataaaggtcattctggaatggcccactccaccaagtgttgacgaaaaaagcccagagtttcaagaacctcgggatttgaggtcaaatccttttcaagggggagggaatgatgcaatcctaccccgcaagggcattggatag

SEQ ID NO: 36972 - DNA, 324 bp, Glycine max
  Peptide Sequence Number=SeqID_128657
atgatgattggatgtggaattacctggatgttgtggaagcttgggaggattgatggggacccggtgttgagaggaacgaggataagggctacgtgggagtacgtgagctcagttggagactggtacctggagatatgtcgcgggggtcaggagaccttggggacgtcaggtggggtgctattgccccaaaacccaagcttgaccaatcccgaccccaacccgggcatagtcaggcgagctcctagcagtcaaccgataaaaagaacaaagcccacaaagcaaggaggcttgtatggtggctggccagctgtgaatcttgagtga

SEQ ID NO: 36973 - DNA, 407 bp, Glycine max
  Peptide Sequence Number=SeqID_128658
ctctggttacgggcctctatcaatcctacagggtgcccgtaccccccggcaaggtcacgtcatcatagggattgcgcctgcaagacacccaatggacccgaagaagtccaacagggtcttagagttgtcaagctctaattacgggccccctactaatcgagctttcatcaagaagtactgcgtctccaggcagatgcagggcgaaacaccacacagcctagggatggccggtagcgggacaatagacgcaccgccgccacctctagagttcacctctgctcatccacaaaaaaggctaccaagtccaaaagccaaagataagcaaaaagtgctaggcccttgtgaccaacaagtcataaggcgtccagctcaagacgttaaagaaagcgctactaggaggcaaccta

SEQ ID NO: 36974 - DNA, 291 bp, Glycine max
  Peptide Sequence Number=SeqID_128659
atgcagagttcaaaatgcgatgtctatcttggagcctacctaaatggtgctttaaaaggtcttgatgatgctccacagcctaaatcaaaggcttctgctaggtggattgttgtcaagtgtaatagacaaaaaggaagtactaagtgtggctactatgtcatgcactggatgtccaccatcattttaggatcttttaggaataactgggaagcgaccattggagccagagagataaaggcattgcggatccagtgggcacagtattatctccgagttagagatcagacctag

SEQ ID NO: 36975 - DNA, 801 bp, Glycine max
  Peptide Sequence Number=SeqID_128660
atgggtgaagtagacgaggtgcaagagtggacaaaggttgacatagaggccctgaaagagaaaatggccataatgatggaggctgtgatgagcatgaagaagatgatggaggtcaatgcgactgtagttgccgttaccagtgccgttgctgaggtggacccgactcccccatctggcctcaaccaaataagtcatccaacctcggatatggtgggtcagggaggcaaagagttgggaagtacgagtggcccccattttgtgcaagttcagaacaaccatgccttcccgccatatggcttgcctcccaactacacaccacccaatatggtgcacactcttaatgagaatgtcaataactcgaatcccatactcattgagagccaacaacctcaatctgatcatgcacatgtctctcaacccatgagggaggcacatgaaataccccaccacaatctagccgactttgagacttgccttggatatgccattgagggacaagcagttggtggtgtacccctgccaaacactttggagggccctcagtttcacccacaaccacaacccttgcatttggcggcggggagagtccctcctgctatggcggaaaagggaaagttggatcagatagaggaaaggctaagggccgttgaaagaggtggagataatgcctttgctgacatggaagatttttgcctagtacctgacatggggacaacttgccccaagaatcacctaaaggtgtactgcaggaaaatgggggcatacacaaaagatgaaaagttgttgatgcatttcttctag

SEQ ID NO: 36976 - DNA, 111 bp, Glycine max
  Peptide Sequence Number=SeqID_128661
atggcagcggaatggagaaggaggaaaggtgattggagatgccactacaaggagaggatgagtcaagaacaagctcaccaccttaggaagccatggataagagctttaaag

SEQ ID NO: 36977 - DNA, 330 bp, Glycine max
  Peptide Sequence Number=SeqID_128662
atggtggatgggtggggagattcacgaacagcgctaggcaatcaattcgttgggctccagactcaatggtggaggatgcatgaacgtcaatcaattcatggggctccgaataagatggtggagaatgcacgaacagcgctaggcaatcaattcgttgggttccggactcaatggtggaggatacatgaacgacaatcaattcatggggctctgaataagatggtggaggatgcacgaacagcgctaggcaatcaattcgtggggctccagactcaatggttgaggatgcatgaacgacatttaattcatggggttccgaataagatttga

SEQ ID NO: 36978 - DNA, 261 bp, Glycine max
  Peptide Sequence Number=SeqID_128663
atgggtgcgaagtacctcgaagtggtcaaacgtgggtcgcatcccaacaatggatggtccccggacgaaattagggcgcagaatgaccataatttgtctttgcgtgtcattggacgcgatcgagcctgggtggcaaggcgcagaatgaccataatttgtctctgcgtgccaccggacacgatcgcctctggatggcgaaaaggtgtacggaatgaccataatttgtctccacccacctctcgacttactgtccctgaatga

SEQ ID NO: 36979 - DNA, 141 bp, Glycine max
  Peptide Sequence Number=SeqID_128664
atgatgttaaaaacatttcgcacaagaaatgtgaggagatacatggagaaaaatgaagaaacaacaatggaagagaagctagcctgtggagcttctatggaggctggatctttgagcttcaatgaggtccttcaatggtga

SEQ ID NO: 36980 - DNA, 252 bp, Glycine max
  Peptide Sequence Number=SeqID_128665
atggttgagcaagaagaaagggaagtgaagccacaccaagaggaaacagaagttgtaaacttaggtgttggcgaagaaaggaaggaaggcaaggttggcactgatacaaatggcaccggaggatatggaaaagacaaccttcatcaccctatggggaactttatgctacaaggtgatgtcctttgggctcaagaacactggggcaacttaccaacggactatggtggcgctattccacgacatgatgcataa

SEQ ID NO: 36981 - DNA, 201 bp, Glycine max
  Peptide Sequence Number=SeqID_128666
atgcctaaacatgcgcccaccaagtgctcggtgaaatgccccaatgacataagaatatggtttgggacagcattggggattcgaaatgggtgcccaaatgcaattccaagcttaggaacccaagctcttaacttcaacgcaaggaattatgacttatgcctaaaaaatctaaattttggttttaaaagtggaaaggcgtga

SEQ ID NO: 36982 - DNA, 320 bp, Glycine max
  Peptide Sequence Number=SeqID_128667
atgactatctcaactacaagaaaggacttcatgatagtcaatatggggcctccccacccatcaatgcatggtgttcttagacttattgttactctagacggtgaggatgttattgattgtgaacctatattgggttatttacccagaggaatggaaaaaatagcggaaacccgaacaattatacaatatttgccttatgtaacacgttgggactatttagctactatgttcacagaagcaataactgtaaatggaccagaccagttgggaaatattcaagatcaagcttatcgataccgtcgacctcgagggggggcccg

SEQ ID NO: 36983 - DNA, 471 bp, Glycine max
  Peptide Sequence Number=SeqID_128668
atggcatccttcagccacatgcagtcccagcttcagtcgcagatgcaatctcagggacttgcagtgcctcctgagcctctggttggtccctccggttctcgagtgagcataaaggggagttgtgttgatccctcaggaaatgatcctgagaccagtgactctgacaggtgcggcttgtacatagaagcagatcctgcccgcctggttgccatggggagagtttatgagggatccactattgttcataacactcctttgttgcctggccaagtaaaggtgagtgtggaggaggttacacatgcagatgctccagttcctgtaccccctgatgaggtttccttagtggggcaggcacttctcaccttccttgcttggccgacacatctggtcaagtctttatcacagcagttgtgtctccggcaaaacaacctccgaagcccgattcggaggtcgatgatccgctttatctga

SEQ ID NO: 36984 - DNA, 372 bp, Glycine max
  Peptide Sequence Number=SeqID_128669
atgtcgttcacagagggaaagataggtataaatgaaatggctccaaagaaattctccacgaaaaggtctataagagacgccacaggagaaggatccaatgtcgccttagagtttgatagtcatcgtttccggagtgccgagcaccagcagcgcttcgaggccattaggggatggtcgttccataaggagaggcgtgtccagctcagggaggatgagtatacgaacttccaggaagagatagctcgcagacgttggacaccgctagtgactcccatggccaagttcgaccctgagatagtcctagagttctatgctaatgcctggcccacggaggagggggttcaggacatgcgctcgtgggtaaggggttag

SEQ ID NO: 36985 - DNA, 285 bp, Glycine max
  Peptide Sequence Number=SeqID_128670
atgtcaaaatcttatggctctcactcttatccaaagaaagaccaaggtcaaggcatcttaggggtgacaccttctaagcccaaagatgatcaggggaagacaatagaaaagcaagcccctaaggctagacacattacttctcaataccccaccacaaaaaccatgattatgaggggccaagacatttatagtagccaagataaggctactacttcaccttcctctagtgaaagtgaagaagcaaaagtgaagaaatctacccccaagaagaaggacaaccattag

SEQ ID NO: 36986 - DNA, 421 bp, Glycine max
  Peptide Sequence Number=SeqID_128671
atggcggaaccatcaaagaagcgaaagggttcttcgagttggagtcaatggcattccgagactcaggaaacgctgattccttcctctatttcctcttcatcattgttctcatccaaagaacaacggatacagtacacaaatcttttctcttctcgttccattattgatccaaaattcattgatatggatttcttttcaaatgagagttttgcatgcattcaagcatttgaaaactccaatcttattcctttcatgtctttaaaattgcctgtttactctgatttagttaaagccttctattcaaacctagaaatccaagaaggcactttaatttctgaagtttatgggattaaaatggtcattgaccaattcctattctatgatttaacccaattatccagtgaaggtgtaccatttgaag

SEQ ID NO: 36987 - DNA, 174 bp, Glycine max
  Peptide Sequence Number=SeqID_128672
atgtggaaattcttcatcgttcttcgtcgttcttcaccgttcttcatccgttcttcgttcgttcttcgttcttcaacgggtctgatttcctcatcgcaattgaggatacgtaggagcaaaagccccgcttttgtcgaccaccccaagagatcgttaatggtccaaatgccttaa

SEQ ID NO: 36988 - DNA, 348 bp, Glycine max
  Peptide Sequence Number=SeqID_128673
atgagcgtcgagaagtttctacagaaggtggcctggccaggagtccatccttctcctttgggagggggtgaggcctccgcagcccaggagcctcagcaggaccaggaggatgacattctagaggccttagagcccactccacctaagcctttcatttttgagactggtccagtagcagctaccccacaggtgacactagagccttccactatagtgctagacatgtcttcttctcaacctgagccatctgcaccagtgttagacttgccccttcctcaggattcatcagcaggcactactgcactggacctgaatgagcaagccatggactctgcacaggatcattga

SEQ ID NO: 36989 - DNA, 459 bp, Glycine max
  Peptide Sequence Number=SeqID_128674
atgtatccttcactagaactgatccacaagagatgtaccctctccctgttctcagtcaaaacccaagtagatgtaccatctacttgtaccacaaaggatgtatcctccaatgtgttaagacaaagatctcaggcggttaaacctttgatactttgtgaatggggatacaaaagaattctcaggcgggttagtccctttgaacacttttgcattagggaaagggaagaatcaaaagaattcttagactgtgtcattttgaattctttgacaagggagaagggagacacaagaattcaggcgagggagaagagaatgaaaaagatgaatagcacaagttttcaaggtttagaaaaccagaaaactttgggaaagctttttggtacaaagaagaagaagaaagttcaaagagattcaaggcttgtaaaggattgtatggataagtgtttcaagattgaatga

SEQ ID NO: 36990 - DNA, 195 bp, Glycine max
  Peptide Sequence Number=SeqID_128675
atgaccacagattcacctccactcccttatgttcccatggacccgggggagtcgccaactatcgcaaccctacccttcggcggggaggggcgacgcgagactcatgggtgcgtctttccaagaaaaggaaaaatgcatggagtccgccacccaacgttcggggagttgtattttacgcacgggggaaggtattag

SEQ ID NO: 36991 - DNA, 516 bp, Glycine max
  Peptide Sequence Number=SeqID_128676
atgggggatttcatcagcagactctccttccccgcatgtttgcattttagcgaagaaaacaccgagactttttcaagtctcacaagttatccagaactacgtaggtctgagttcctcattggaggatacgtaggagcaagagcctcgcttttgtcgaccacaccaccttttgttatccagaactacgtagaactacgtaggtctgagttcctcattggaggatacgtaggagcaagagcctcgcttttgtcgaccataccgccttttgctgccatgacccaagagttggtagcccgcggagacgccttacgattatccgcacctcgtcattcagccaccccaagtgtgattgacgagcagaggccaatatggtcatctgcgccctttccggagatgtcagcattttccgatggagacttttcaagtcccacaaattatctagaactacgtaggtctgagttcctcattggaggatacgtaggagcaagagccttgcctttgtcggccgccccataa

SEQ ID NO: 36992 - DNA, 132 bp, Glycine max
  Peptide Sequence Number=SeqID_128677
atggaggaacacaaaaaagaagcggaaaggatccacgagtcggagtcaacgacattccgggtcacaggaaacaccaattcctctctccattccctctggatcattgttctcatcagaggaacagcgtatacg

SEQ ID NO: 36993 - DNA, 246 bp, Glycine max
  Peptide Sequence Number=SeqID_128678
atgttcttcctgcgttatcccctgattctgtggataaccgtattaccgcctttgagtgagctgataccgctcgccgcagccgaacgaccgagcgcagcgagaaacagctatgaccatgattacgaattcgagctcggtaccggagtggcagcagctacctgtctcacctgtgtctcctctgcctcttctcctatatcaaatggctctgggatggtggcctcaaatgactcatcctccacatgctga

SEQ ID NO: 36994 - DNA, 179 bp, Glycine max
  Peptide Sequence Number=SeqID_128679
cgctagtcacactcgctcagcctgaaggtgaagacagtgcgcttagcgagttggctttcgctcaacacctctatacagctcatccttctcccagaattgtccatgagcttagccatcagatggggcgcttagcggatgatgcgcttagccagaagatgagtggcttagcgagttcatga

SEQ ID NO: 36995 - DNA, 420 bp, Glycine max
  Peptide Sequence Number=SeqID_128680
atggaagcagtactcccatttgaggtagaggttccttctcaaaggataatagtggaaaccaaaaacaccaaccaagaaatgaattttgcagcgagaaagcctgtagaattcaccccaattccagtgtcctatgctgacttgctcccatatctacttgataattcaatggtagccataaccccaaccaaggttcatcaacctccatttcttcgagaatacgactcgaacgcaacgtgtgcttgtcacggagaagccccggggcgttccattgagcattgtagggctctgaagcgtaaggtgcaagtgcaagccattggtctgtttgctcaagcgacctgtgctcttgagtttggacttccaagaccgttcaatcagagattactcgtcttgcacgttggtgggggtgccgtaaaacaatga

SEQ ID NO: 36996 - DNA, 243 bp, Glycine max
  Peptide Sequence Number=SeqID_128681
atgtccttgatgaagactctgaagcatggattcaaagcgctgagagtcttgagcagatggacctggaggagatggtgtaggagtagtagaagtggaagaagttggtggagtagaagaagaaagaacatcaactggtcaatcccttgccttccgtgcccctctgaagttaactgccaagttaatggccgggctcaggctctcataagtcagactatcagaggtaactcctctagctctacatag

SEQ ID NO: 36997 - DNA, 199 bp, Glycine max
  Peptide Sequence Number=SeqID_128682
gtttgtcatcatcaaaaagggggagattgtagaagcaagcttcatgatgatgaaccaagaaattttgatgattccaaaagcccaagtgattgattcaagacttcaagatcaagcatcaagaatccaatccaagaatccaatccaagattcaagattcaagagaagaaatcaagaagtaacaagtcaagacttcatatag

SEQ ID NO: 36998 - DNA, 153 bp, Glycine max
  Peptide Sequence Number=SeqID_128683
atggtgttaagtatccaatacttcaagcaattgctaaggataagctattccggttctatgagctataaagttgttgttgaatgtgctactgtaatgaatgaaatggtttcagatgatgaaggtgaaatgatgggtgctggtgtcactaattag

SEQ ID NO: 36999 - DNA, 798 bp, Glycine max
  Peptide Sequence Number=SeqID_128684
atggccaagttcgatccagaagtagtccttgagttttatgccaatgcttggccaacagaggagggcgtgcgtgacatgaggtcctgggtgaggggtcagtggatcccgtttgatgcagatgctatcggccagctcctgcgatatccgttagtgctagaagagggccaggagtgcgagtatggccagaggaggaaccggtctgatgggttcgatgaggaggctatcgctcagttgctatgtataccagggcaggattttgcccggactgcagccggaaggcgggtgcggatcatgcgcaccaacatgaccaccctgacccagatatggatgacgttgctgctcagcaacatcctgcccagcgatcataattccgacctccccctgccgaagtgtcagctggtgtacgccatcctgacgcggatgagcatccatgtggctcagttaatcgctgatgccatctatatttttgcaggtatgacgcctaccaggcaccctttggatccagataagtccaacagggccctgggatttcccgcactgatcacaggactctgccagtcgttcggagtccccgtggcacctaccaagatgagccttagcatgcagagccagggcttcgcttctttttcatgccctactccagaccagttcagggcagaggtagcatggcccggagattggcccgaggcccaagcaggagaggcacccccagaagctcccggcgatggagaagaagcccatgaggatgaggagatggccgatttgcttgacttcttgggagggagtggagacacgtga

SEQ ID NO: 37000 - DNA, 222 bp, Glycine max
  Peptide Sequence Number=SeqID_128685
atgtttgcacattcgattaaaggctgccgtcccttgggacggacgtgtggggtgaatgagcatattacacaggttcccaatgatgaagtggagacaaaagctaacacagaggttgaggacacccaatttgagctaacaacggagtttgcagaggttatggatcatattcccctcacacaacaatctcaacctttttctacgagacttgagtaccttccctga

SEQ ID NO: 37001 - DNA, 69 bp, Glycine max
  Peptide Sequence Number=SeqID_128686
atggccaccataaacatcttgggtatatgtagccaaatgtgcaatggaattatcaccatatacatctaa

SEQ ID NO: 37002 - DNA, 388 bp, Glycine max
  Peptide Sequence Number=SeqID_128687
gccaaatttgacatacctgaaggtttaactgcgaagaagaaggttatgtccaccgttgggaccagatggaggcaatttaagtcctccctgacgaccaaatatgtatatgctgagaatgacgatgaacaaaacaaggatccatatgctaagtatggtattgatcgaaatacatgggaagaatttgcaaagactcgacagacccctactttggaaggctacgatgtgcttgaaaaaaaattaatggccgagaaaacaaagtcaagactgaatgaaggtgacaatagtcaaaatgcagatatggtcgtcgaccctccatcccttattgcgagacatgagaagtggaaaaaggctaggacaaacaaatttgggcaaatgacatctgcagcag

SEQ ID NO: 37003 - DNA, 575 bp, Glycine max
  Peptide Sequence Number=SeqID_128688
atggcggaaccatcaaagaagcgcaaaggttattcgagtagaagccaatggcactccgaggctcaggatactccaattctttccttcatttcctcctcctcatttttctcatcggaagaacaacgtacacggtacacaaacctcttctcctctcgttctatcattgaccctaagttcatagatatggatttcttttctgacgagagtttcgaatgcattcaagcctttcataactcaaatctcattccctttatgtctttaaaactgcctgtgtattctgaattggtaaaagtcttttattctaaccttgaaattcaagaaagtgcactagatgatgattggaaattcaatttttctgtgcatgatgcccgacgggtggtttgcaccaaccaagcggatatgactggaaggctgcttgccagttcattggctcttgaaagccgcatcctccattatctaattgctcgtatcttactccgcagatcttcaaaccttgcacaagtttctgaagaagatctaatagtcatgtgggcctttcataccagtcgacaaattgattgggcacatctagtccg

SEQ ID NO: 37004 - DNA, 537 bp, Glycine max
  Peptide Sequence Number=SeqID_128689
atgacccaagagctggtagcccgcggagacaccttacggttatccgcacctcgtcattcagtgaccccaagtgtgattgatgagcaaaggccagtgtggtcatttgcaccctttccggggatgtcaacatcttccggtggagactttttcaagtctcacaagttatctagaactacaggtggcgggcccgatgacacgtggagataccttacggttatccgcacccttttgtcatccagaggcggcgggcccgatgacacgcggagataccttacggttatccgcacccttttgtcatccagaggcggcgggcccgatgacacgcggagataccttacggttatccgcacccttttgaggtcatgtgacatgcacccctttgccattcagacacagtcgtgtccgatggcacgcagagacaaaatttggtcattctgcacccttgtgtcatccagaggcggcgggcccgatgacacgcagagacaaaatttggtcattctgcacccttgtgtcatccagaggcggcgggcccgatga

SEQ ID NO: 37005 - DNA, 213 bp, Glycine max
  Peptide Sequence Number=SeqID_128690
atggcacgcaacgtgtttgctccgtgcccctatttaagggacctatatgggagggagctaacaaggcttttagtgataattcccaaggtggtcatatctctcttgaaggtctctagaggtatcatccccttcgaagaacaaattgcagcagtagggactactagcaacgatatattttcaaagaggaaaactctagatgagggttcactgtaa

SEQ ID NO: 37006 - DNA, 366 bp, Glycine max
  Peptide Sequence Number=SeqID_128691
atgaatatgaagggccaagacatttatagtagccaagatgaggctactacttcaccttcctttagtgaaagtgaagaagcaaaaggggaagaatctagtgaagaaatctacccccaagaagaaggacaacctttaatggttaaggaggagtgtaaggaggtaagtgtctcctccaagaggttagctaagaaggaaagtcattttgcaataaagacaaacattaaagaaacttcccatcttagacaacctccacatcttctcctttgtaaaatgacacttgttagcaccgccacacctcttgggcttgagattattcctcaagtgttgagggaagaagcccaaagttttaagaacctctggatttga

SEQ ID NO: 37007 - DNA, 324 bp, Glycine max
  Peptide Sequence Number=SeqID_128692
atgcacacacgaagtttcacaaatccacaattccttaaaacaggcctaactcacaaaaagatccctagtggagtcgccaactgtcgcaacgtgcccttcacgggcgagcgagggcgaggctcacgggtgcgctttccaaaggaggaaagatgcgcggagtcgccaccaccatttatttgtggaaaacgtcggaaaaaccgaaggaaaccggtcaaaatgaaagttctaagttcgggagttatatttacgcttgaggaaggtcgacaaaagcggggcttttgctcctacgtaccctcctttggagaggaaattagacctacgtag

SEQ ID NO: 37008 - DNA, 270 bp, Glycine max
  Peptide Sequence Number=SeqID_128693
atgcggggttacgttatggttacccgcacctttcgtcaaccaggggaaaacgagccccttgacgctcgaagacgaacatcgttttctgcaccttttgtcatcctgacccgtcaagtcagtcaaccaggggcaaacgagcccgttgacgtaaggagactaacatcgtcttctgcaccttttgtcgtcctgacccatgaagtcaggggacatacggggttaccttattgttacccacaccgttcgtcaaccatgggcaaacgagccaaatga

SEQ ID NO: 37009 - DNA, 228 bp, Glycine max
  Peptide Sequence Number=SeqID_128694
atgattgtcttaccagatgagcctcagctgcaagagccagaatttacttctttttcgtgccctactccagaccagttcagggcagaggtcgcatggcctggagattggcctgaggcccgggcaggagaggacgccagcagaggctccccgacgaggcagatgaggcccgcgaggacgagaaaaatgaccgatctacttgatttcttaggaggaagcggggccacatga

SEQ ID NO: 37010 - DNA, 784 bp, Glycine max
  Peptide Sequence Number=SeqID_128695
atgagcatctgctcgttggaagacgtggccgcggccaccggcaagccgttctggttccagctgtacgtgatgcgcgaccgcgaattcgtcggcgacctgatcgaccgcgccaaggccgctggctgctcggcaactggtgctgacgctggacctgcagatcctggggcagcgccacaaggacatcaagaacgggctgtcgacgccgcccaagccgacgatccgcaacctgatcaacctggcgaccaagccgcgctggtgcctgggcatgctgggcaccaagcgccgcactttcggcaacatcgtcggccacgccaagggcgtgagcgacctgtcgtcgctgtcgtcgtggacggccgagcagttcgatccgcggttgagctgggacgatgtggaatggatcaagcagcgttggggcggcaagctgatcatcaagggcatcctggatgtcgaggatgcgcagctggcggccaacagcggcgcggatgcgctgatcgtcagcaaccacggcgggcgccagctcgatggcgcgatgtcctcgatcgcggcgctgccgtcgatcgcggatgcggtggggtcgaagatcgaagtgtggatggatgggggcgtgcgctcggggcaggacatcctcaaggcggtggcgctgggcgcgcgcggcgcgatgatcgggcgggcgttcctttacggcctgggcgcatatgggcaggcgggcgtcaagcgcgtgctggagatcctgtacaaggaaatggatacgacgatggcgctttgcgggcggcgcaatatcgaa

SEQ ID NO: 37011 - DNA, 1018 bp, Glycine max
  Peptide Sequence Number=SeqID_128696
atgattttaagactgaattggagaggtgtaatttccataaacgcctcaccaatttggttgatgggagcatagacttggctttggtgaaagagttctatgcaaacttatacagctctgagggccgttcaccaaagcaagccagagtcagaggccatttagtgaagattgatgttgacagtctcaacacattcctggagacacctatggtattggcagaggattatagagagattgaggttgccttgtgcataccgggccgagggttcattttgaatgctgatggccatcctgggaggattctcaagaaagatttgactaatttagcccagatgacttctatagcccagtctagaacttctagacttgagtttcctgctctgatcaccaccctatgtagagccagaggggttgtctctaacagccttacatttgaatgcctgagcccggtcattaacttggcctacatcaggaagaactgttggaatcccgaggatctaacagtttctatccgagggactaggagggcgagagcgaggccaactgagcttccatccacatctacaactcctactccagcatccacttcagcagctccttctgtcccagctcagacagattctcaacgctttaaagccatgcttcaaagaattcatcagggacaaatcattttattacagagtttactggtggtggtgcctccaggatctattccttcagatgagtcatctaaggccaccattccagagccaatcgttataggggaggaggtaggtgagacacaggtgagacaggtagctgctgccactcctgagagatctcttgaggccacttcagagcctcttgcaccagtggaggacctaccctcacctcagcatgcaacagacccttccactcctatcctagagataactgaggacccgaccactccagtcctgactctggacacttttcctccagctactccagtacttcatctgacagatgaggaggatgttcagacacaggatacacaagacca

SEQ ID NO: 37012 - DNA, 372 bp, Glycine max
  Peptide Sequence Number=SeqID_128697
atgggagaaacatactcttcttccccggtagacgcattgtttttcactcaaaaagcatatgctgctctgatcagttggaatatttgtctctttgctaaagcatgtttgcattttagtggagaaaacaccaagactttttcaagtctcacaagttatccagaactacgtaggtctgagttcctcattggaggatacgtaggagcaagagcctcgcttttgtcgaccacaccaccttttgttgccatgacccaagagctggtaacccgcggagacaaaatttggtcattccgcacccttttgtcatccagaggcggcgggcccgatgacatgcggagacaaaatttggtcattcagcacccctgtgccgtttag

SEQ ID NO: 37013 - DNA, 438 bp, Glycine max
  Peptide Sequence Number=SeqID_128698
atgagaaccctaaggccttcttcagcagctctagcccaatcctcttggagcctcttgctcatggctctagttactggtcccttcctagggagaattgcatcaggacagcaagccaaagaggttccatcgtgccacatcagtagaagctttgtgagtgcgggtttaagacgcgaaggacaagtcgtcgcgatatgcgatgaggactccctgaggaggtcgaatttggtacagccatgccctcccagcttccaactagggaattggcgggtggaggaacgcccggaggtttacacgacaagcataatatccgacgacgagtctcgcaaaggtactaataccggggacctggccgtcaatttcgagcaagaagcaagtcggacggaggatgaagaggacgaggatgtagggcttcccccagacgtaggaagaaggaagtaa

SEQ ID NO: 37014 - DNA, 255 bp, Glycine max
  Peptide Sequence Number=SeqID_128699
atggcatggaagaaaaaacacaggcgagttatggataacctgactttgtttggcaagatgtctcgtatagccacggctaacaattgttgcatgagcacagtatccttgtggaaccttcacccgacaaagacactgacaaaaactgatgcaatcctccctaggaagggaccagtcactagagccatgagcaagaggctccaagaggattgggctagagctgctgaagaaggccctagggttctcatgaacctcagg

SEQ ID NO: 37015 - DNA, 531 bp, Glycine max
  Peptide Sequence Number=SeqID_128700
atgaggtgggaagttgcacctatggctagcttacagcctcaagatgcagacatagagtcacaaagcaacctctccctccctccctccctccctgtaagggtcttatacaagacctcttttccattagttacttgtgaattgatcatggcttctccacctgcctcgcctcctcctcctcctccttcagacgcatcagcttcgtcgtttgctgtgaagcggacacgcaaagcctcattggtccacgttgatcctactaccggcaaggccgacgatccccacaagaagaaattaagaacatatttagggactgtggcgcgtgataaggtggacgtcacgtacgagaactggaaggaggtccctattgctcagaaggacaagatttgggaggatattcaggatgtgcgcaaaaaggcacaggccatccagaaacagaacattgccccccacattttgtctcgtgggggttatgaatatttggagcacaagctcctggctgagaagatcaagaagaagctagaggaagcttcatag

SEQ ID NO: 37016 - DNA, 273 bp, Glycine max
  Peptide Sequence Number=SeqID_128701
atggcggtcacgaaccccagcgacgacgatggtgtggaggagaccacaatgataggtcttcacggtgagggagaaagagataatgctggcacaaataaagcagcatctatcagcacttcattgaacactaagagcctggatgatgatactaacagtctagctcaactagctgaagcagaaacaggagtagcagaacatgcaacacaggtgcaaaaagtagaaaggcccaagagggcaataacaaagccatcttacctcaaagactttgtctga

SEQ ID NO: 37017 - DNA, 306 bp, Glycine max
  Peptide Sequence Number=SeqID_128702
atgtaccctctcttgttctcagttacaacaacccaagtagatgtaccttctacttgtaccataaaggatgtaccctccaatgtgttaagacaaagttctcaggcggttaatcctttgaaactttgtgaaggggaaaaaaagatatctcaggcgggagaagggagacacaaaagaattcaggcggttagttctttgttcttttggaaaagggagaagacagacacaaaaagaattcaggcggttagtccttggcgaattctttttggcaaagggagaagagagacacaaaagaatttaggtggttag

SEQ ID NO: 37018 - DNA, 138 bp, Glycine max
  Peptide Sequence Number=SeqID_128703
atgtatgatagcacgggattcccttttgaatgcaaaaatggccccgaggaagcttgcctcaagagatctaggaaggataaagcggttgaaggaaccagttccgctcccgaatatgacagccactgtttagagtgctga

SEQ ID NO: 37019 - DNA, 282 bp, Glycine max
  Peptide Sequence Number=SeqID_128704
atggccccgaggaagtttgcctcaaagaggtccaggaaggacaaggcggccgaaggaactagttccgctccggaggcgccggcggtgggcatcactggttactcccatggccaatggatcccgtttgatgccgacgctatcgggccagcttctgggatatctgttggtgttggaagagggccaggaatgaaggcgagtgcgaatcatgcgcaccaacatgaccaccctgacccagatatggatgacgttgctcctcagcaacatcctgcccagcgatcataa

SEQ ID NO: 37020 - DNA, 294 bp, Glycine max
  Peptide Sequence Number=SeqID_128705
atgacccaagagctggtagctcgcggagacaccttacggttatccgcacctcgtcattcagtgaccccaagagcaaaagccttgcttttgtcgaccacaccgctttttgttaccatgacccaagagctggtagcccgcggagacaccttacggttatccacacctcgtcattcagtgaccccaagtgtgattgatgagcagaggccaatgtggtcatctgcgccctttccggagatgtcagcatcttccggtggagactttttcaagtctcacaagttatcaagaactacgtag

SEQ ID NO: 37021 - DNA, 415 bp, Glycine max
  Peptide Sequence Number=SeqID_128706
agctatggcggggcagagcttggagcacttagtcgaagcatcttcaccacgcggcgctcaaccaagaggtgatgacgctgatgtgagagatgttgtggtagatagggaatttggtttggataaccaagatccattatatacgatgaatgagattccaatgagagagtcgagagccaaagaagaccttcgacttgacgggaaaggcaaaccccggaccgatacaaaagcctgcaaagaacccgccgagcttaaaggtcaatatatcggcccagcacttcccctgcaacacaaaataacaacggagagaaagggtctccttgtcgaactcctcgcgaacaggtatgacggaaagacatttgacaaccgtagcttctgtggttacgagtcggggtacggtagtgattcgctattctag

SEQ ID NO: 37022 - DNA, 177 bp, Glycine max
  Peptide Sequence Number=SeqID_128707
atggccatccacatcatggaactcaaagtagcaacagcagaaagaagattgatgtgggttccaaaacacaagaatgaagttaaagaattcctggtgaaattgagccctgctccactagactatgtgacatttggagatggctctaaaggagaagattcattgcaatgggaaagctag

SEQ ID NO: 37023 - DNA, 480 bp, Glycine max
  Peptide Sequence Number=SeqID_128708
atgaaatgctccatttccctgttggccggcgcgctgctggccgtcagtttcagcgcttcagccatggcgctggattcgcaggaggttggttacaatatcgaagcgcgcggcgcgcggccggtcgtggctcagttaggcaaggccgggcagttcaacgccgtggaaaacagcatccggctgggggacgacaattggattgccctggcgcccaagctggccggcggcggcaatgccggctttaccgccggcatcaaatcggccctctccgccgccctgatctacaatccggcggcggtgttgcaggcgctcaacaaaggcaacgatctgccgctcaatgacatttgcaccgcgccgccggaagtgcaaggcgacaccgccgtcaccagtttccgccagcgcgcaacccgcgccttgtccaccgtgcgcgtaggcgatctcagcgcgccgcgcgatgcctgcattgccgccttgaaaggctga

SEQ ID NO: 37024 - DNA, 255 bp, Glycine max
  Peptide Sequence Number=SeqID_128709
atggcaatttcaacatgctttcaacaagtttcttcacaaataactatcatgaagcagaaaactagcaaaactacacatcatatctcccaaaaccccatacccacgaaaatcaaaggagaaagaagtccacccaaacctgaaatttcgaagtcccacacaaatgggcaccaaaggttgaagctttgttgggcaacaatggtggatgaagaagaaggagaaaagcaacgtgagggagagggagagagagctgtctga

SEQ ID NO: 37025 - DNA, 357 bp, Glycine max
  Peptide Sequence Number=SeqID_128710
atgaaaagatggtgggctgcgcaccctcaaagctttgcagatttggtcttcgccagtgaaaggatcgatgtgggtctgaaaaaaggcaaatttgatcatcctactaggacgactgagaaaactggggcaaataaagagggtgaggatgagggagaaacccatgctgtgactgccattcctgtacggccaagtttcccaccaacccaacaatatctttactcagccaataacaaaccttctccttacccaccacccagccataaccctagccaaggttcatcaacctccacttttctgaggatacgactcgaacgcaacgtgtgcttatcgtggaggagccctggggcattccattga

SEQ ID NO: 37026 - DNA, 294 bp, Glycine max
  Peptide Sequence Number=SeqID_128711
atgagtcatcattcatctagtgttaatagtgaggatactagtcataaggaccctctatctagaatattagatgagttgagttccctcaagttatggaaagaaaaactagaaagaaaagaaaaaggaaaagagagggtagaaacaagtcaagatgagtgggaacaaatatgggaaaaagaaaaaaggaaaatactaaaagagttaagaaaagaaaaacatgcctcctataatagtcatgactcctacaagagcctaagtgaagaacttagtgactattatggaggaaggcattga

SEQ ID NO: 37027 - DNA, 248 bp, Glycine max
  Peptide Sequence Number=SeqID_128712
tgcgaagcttctggtgactgggaagcacgttattctgttgttttccagatcggttccttcgccaagtatgaaaaagaagaattagagatgggagtcatcatcacggaaagggcaggacggacgaaatcagtgtcctatctttgctttcctcttatctccgatgagagtcccgagacgtctcagaaatcaaaaggaagcaggcttgcgcgatccgtgaaattccgtaatgtggcggaagtcgaaaagag

SEQ ID NO: 37028 - DNA, 183 bp, Glycine max
  Peptide Sequence Number=SeqID_128713
atggtgctggtagtggctattgcaaccacattgacctccattatctcttttatgctcatcatggcctccatcattgtggccatttgctctttcaaggcctccgtgtcggccttcacctgctcttgcacctcctctacttcacccattactctagctctagcacgggttcggacatggggttga

SEQ ID NO: 37029 - DNA, 135 bp, Glycine max
  Peptide Sequence Number=SeqID_128714
atgggggtgcaaacagttgaaagtaacctagctcgcctgggcgaagctagatgggccaccacacccccctcgttttgtttgaaagaatgggatttccgggggcttccggggacacccggtattgctttcccgtaa

SEQ ID NO: 37030 - DNA, 273 bp, Glycine max
  Peptide Sequence Number=SeqID_128715
atggcgagaaataggctaagggtagtcaaaaatctcgggcgcaagatttggattgaagtaaaaaaaatagaaaatgggaatagtcggaaatcccaaggaggcatttgggaggaaaaggacgaaggcgttggcagatcaagttgtcctcttttccaaatatgggatgggctagtggacttagcggcgatcgatgcccttcctttacttgtcacccatagcaaggagagtccagtcattgctgtcttggccaatgcctatgacacctttgactga

SEQ ID NO: 37031 - DNA, 86 bp, Glycine max
  Peptide Sequence Number=SeqID_128716
gaccggttttcagaggcttttggagccaaactcaggttcctggaattgctccttatagagttgtccttgaatatataaaagataag

SEQ ID NO: 37032 - DNA, 453 bp, Glycine max
  Peptide Sequence Number=SeqID_128717
atggaaaattctggaaaatggaaagttgaaaaatcgttatataataatccaaaaattgcaatagaaaaagaatccagaaattgcaatagaaaagaaaaagagaggtttgagatgatttttcaatcttttatactggataatctagtattcttatgcatgaagataattaattcgatagttgtggtcggactctattatggatttctgaccacattttccatagggccctcttatctcttccttcttcgagctaggcttgtggaagaagggacgagaagaaaattcagcaacaactggggtttattacggacagctcataatgttcatgatcgatggctattatgcgcacttccccggactgtggaacaaaggagtatcccgaacctacaccgaggtattgacggcgattctcaaatatcgcagaacagaacagaatgggatacgatgagatag

SEQ ID NO: 37033 - DNA, 456 bp, Glycine max
  Peptide Sequence Number=SeqID_128718
tgtagccgtagttaggccaccactcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaat

SEQ ID NO: 37034 - DNA, 249 bp, Glycine max
  Peptide Sequence Number=SeqID_128719
gcgaggctcacgggtgcgctttccaaaggaggaaagatgcgcgaagtcgccaccaacgtttatttgtggaaaaagtcgggaaaacccaaggaaaccggtcaaaatgaaaattctaagttcgggagttgtatttacgtcgacaaaagcggggcttttgctcctacgtaccctccatcaaagaggaaatcagacctacgtagttcttccttatgcatgaatcaagtgattgattttttacttgaggggtga

SEQ ID NO: 37035 - DNA, 369 bp, Glycine max
  Peptide Sequence Number=SeqID_128720
atgagcatccacgtggcccaggtgttccgaccgccgatcactcaggccttcatcgagaagtattgcacgcctaggcaggcacagggtaatgcacctaaggccgcagacataccgccaccacctcatcaggttgatcccactggatcactaggcatggagtgttatctacagcacttggttcgccagcaggcagtcatccaccaggggcagcctcagtcagcaggggcagggtttggggctgaggtcgcatggcccgaggcccaggcaggggaggcgcctgcaagatcccccggcgatgcagaggaggcccgtatggatgaggagatgacggatttgctcggtttcttgggaggaagcggagccacgtga

SEQ ID NO: 37036 - DNA, 492 bp, Glycine max
  Peptide Sequence Number=SeqID_128721
atgacctcgggccagcagccgccactgcccggtgacgacgccgacacgggaccggttccggtgccgacccaacgcgcgatgaggcacgaaacgcacaaacatccagccgccgcacgctggcttcgtgtactggcgattccggtggtgcttttttgggtcattgccgccgctgtcctgaacatcttcgtgccctccctggaagaaacgaccgccgctaacgccaaggccatgattccgcgtgatgcaccgtcctcggcggccgcgatcacccagggccaggacttccaggagtctgcctacaccagcgctgcggtcatcgtgctcgagacccagggccgcacgctcggcgagcaggaccgccagtactacaacaaattggtccgtggactgctcgacgacaaagagcatgtgcagtcgctgatggacctgtggggtgatccggtaacgaggtcgggccagcagagcgcggacgcacgggccgcaaccttgacg

SEQ ID NO: 37037 - DNA, 117 bp, Glycine max
  Peptide Sequence Number=SeqID_128722
atgtggaccactacgggggaggtggttgccgcccagctcgcccaagcgagctcagctcgcccaggcgagccaggttacttcctccagaagcaacagccttctggaggaatattctag

SEQ ID NO: 37038 - DNA, 393 bp, Glycine max
  Peptide Sequence Number=SeqID_128723
atgtggatggatcggtttgctcttaccttgaacgggagtcaagaacttccccgattgttagccaaggccaaggcgatggtggacacctactccacccccgaagaaattcatgggcttctcggctattggaaaaacaccataactaaacgcgccacaaggcatccctatcgcaccagatccaaatctagaacgatgggtgatcaagaggagacacaggaacagatgaaagccgacatgtcggctctgaaagaacagatggcttccatgatggaggccatgttaggaatgaggcagctcatggagaaaaacgtggccatcgctgccgccgtcagttcggctgccgaagcagacccaactttcttggcaactgcgcaccatcttccctcaaacata

SEQ ID NO: 37039 - DNA, 282 bp, Glycine max
  Peptide Sequence Number=SeqID_128724
atggatttcttttctgatgagagtttcaaatgcattcaagcatttcataactcaaatctcattacctttatgtctttaaaacagcctgtgtattctgaattggtaaaagccttttattctaaccttgaaattcaagaaagtaccttgatttctgaggtctatgggataaagatgccggttggtttgcaccaaccaagcgaatatgaccagaaggctgcttgccggttcattggtgttggatcgagtggcctcagaataattaagaaaggggggttgaattaa

SEQ ID NO: 37040 - DNA, 440 bp, Glycine max
  Peptide Sequence Number=SeqID_128725
cgtgcgctgagaaggaagcaagagggagggtgattgatgcattgcatcaagaagcaaccatgtggatggataggttcgccttgaccttaaatggaagtcaagacctcccgcgtctactagccaaagcaaaggccatcgccgaaggaagtggaaccggtgctacagctcgtagtaacttgggccgagacaaaaacgcgacgggttttaatcggaggtatagtcctcaagcctacccttatggtttgcctccagacttcactccccgcaccgcgccagacgatttgagccaagcccttaccttcgaggggcagctccctcctcacgccggctatcctctgcaagaagatgatgaaggagatgcccatttaggtcctctacttcccctcaaggaaccagcccctaatgagatgccccaaccaaacatagtccgccacgtccca

SEQ ID NO: 37041 - DNA, 759 bp, Glycine max
  Peptide Sequence Number=SeqID_128726
atgttgctgcgcggggtgtatgctgacctcccgcgagcacccgcctcgtggttggttgaaatctgggttcatggccgacttcgccgtgataaaatggtggatgagccacgctcgagaccaatcacgtgcgagccggtcagttctggacccatcgacgaccctttgcgtgcacgcacgctcccaacgagacctcagtctggagaagcgtcctcagtggcggaccgggcccaagtcccctggaagggggcgccagagagggtgagagccccgtcgtgcccggaccctgtcgcaccacgaggcgctgtcggcgagtcgggttgtttgggaatgcagccccaatcgggcggtaaattccgtccaaggctaaatactggcgagagaccgatagcgaacaagtacccgcgagggaaagatgaaaaggactttgaaaagagagtcaaagagtgcttgaattgtcgggagggaagcggatgggggccggcgatgtgtcccggtcggatgtggaacggtgagagccgggtccgccgatcgactcgggacattgaccgacgcggattgcgatggtggcccaagcccgggctgttgatatgctcgtggagacgtcatcatcgcgattgtggatggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccgtaa

SEQ ID NO: 37042 - DNA, 216 bp, Glycine max
  Peptide Sequence Number=SeqID_128727
atggagtggagaaggaagagagagaggagacgccacttcaaggagatgagtctagaagaagctcaccaccataggaggccatggataagagcttggaggaagaaggagatgaatgaaggcagaggaagagaagagcatgaaattttgtgctctaaaagagctctgaaatctgaacccactaacccaagatcaattccaagattcttcactaagtga

SEQ ID NO: 37043 - DNA, 138 bp, Glycine max
  Peptide Sequence Number=SeqID_128728
atggttggctcatggtaccgaacatatgcaactaagaatgcaaggaaaatgcaaggatcatgcatgagtaaacatgaaaataaaaaggaacgatacgtccattacgatgccatggagagatgcttatgcgatgcatga

SEQ ID NO: 37044 - DNA, 549 bp, Glycine max
  Peptide Sequence Number=SeqID_128729
atgggcccttccggcagcggtaaatcaacccttttcgcctggatgatcggcgcgcttgccgacacctttcgcgccgaaggtgaattatggctcaacaaacgccgctgcgacgggctcgccactgaagcgcgacgcattggcatcctgtttcaggatgcgctactgtttgaccacttcagcgtggggcacaatttacagctcgccctgcccgctgagatccgcggcgcggcgcgccagagcgaagttgagcaagcgctggcgcgcgctggcatgccggggttcgcctcgcgcgatccggccacgctctccggcggacagcgcgcgcgcgtcagcctgctgcgcgccctgctggcgaggccgcaagcgctgctgctggatgagccttttaatcgcctggatgcagaacttcgcgccgattttcgccagtgggtgtttgcggaaattgaccggctggcaatcccggcggtgctggtgactcacgacagccaggatctcccaccgggcggacgctgtattaatattgccgcctggcaggcaaattccgcctaa

SEQ ID NO: 37045 - DNA, 174 bp, Glycine max
  Peptide Sequence Number=SeqID_128730
atgccgacacctccggaaagggcgcagatgaccacattggcctctgctcgtcaatcacacttggggtcactgaatgacgagctcttgggtcattgcaacaaaaggtggtgtggtcgacaaaagcgaggctcttgctcctacgtatcctccaatgaggaactcagacctacgtag

SEQ ID NO: 37046 - DNA, 486 bp, Glycine max
  Peptide Sequence Number=SeqID_128731
atggtgattcaagtagaggaaagtagagcttatcagaaggtggagggatttaaacaacagctggctgatcaattggcattggaaccggttgatgatttagttgaacttaaagaaattgttgaggaagcagaaggtgatgaagaaggggagacaccaataagagactgtcaagagaaaataaagaagaaggaagaaaaagaaaaagaagaagaaacaaaagaaaaagaagaaaaaagttttgatgataacaaagatgatgacaaaaaagctcaaaagtcaagaacatttcatgataacaaagatgatgatctcaagaaatcgaagaacgagttcaagattgaatcaagtacacttcaaggttcaagaggaaatttgatttcaagaatcaagattcaaggtacaagcttccaagaatcaagattcaaggtacaagcttccaagaatcaagatcaagattcaagattcaagaatcaagagaagacttaa

SEQ ID NO: 37047 - DNA, 429 bp, Glycine max
  Peptide Sequence Number=SeqID_128732
atggacggggaaccggcacgaagagtcacactagaggacttctctaataccgccactccccagttcttcacaagtattgcaagactggaggttcaagcagccaatatctcctacccgcactcccttattcagttaatccaagggaacctcttccatggtcttccgagcgaagatccatatgctcacctagcctcatacatagaaatatgcaacaccataaaaatagtcggagtcccagaagatgcgaaaaacaccgacacacggctacagcgagccagtataattgaacatattcatcgatggcttgcggcctcaatcgaaacagctactagatgcatccgcaggagggaagatcaaactgaagactcccgaggaagcgatggaactcatcaagaacatggtggccagcgatcaagcaatccttcatga

SEQ ID NO: 37048 - DNA, 360 bp, Glycine max
  Peptide Sequence Number=SeqID_128733
atgagtgaaatagaggagatgcaagagcagatgaaggtcgacatgaaggccatgaaagagcaaatggccataatgatggaagccatgatgagtatggaaaaaatgatggaggtcaatgcggctatagttgttgccgcaagtaccgccacaaaagtggaccccgctcacccatctggcctcaatcaagttcagaacaagcattccttcccaccatatggcttgcctcctaactatacaccgcctaatgttgcacacactcccaatgagaatgtcaacaactttgcacccatacccattgagagccaacaaccccaatctgatcatgcacatgtctctcaacccatggggggagacacatga

SEQ ID NO: 37049 - DNA, 411 bp, Glycine max
  Peptide Sequence Number=SeqID_128734
atgggtaaagtagaggaggcgcaagagcagatcaaggctgacatggaggccatgaaagagaaaatggccacaatgatggaggccaatatgagcatgaagaagacaatggagacacatgaaatgccccaccacaatctagcggactttgagtcttgcctcggatatgccactgaagggcaagcagttggtggtatacccatgccaaacactttgaagggccctcagttttgcccacaaccacaacccttgcattttgcggtgggaagagcccctcctgctatggatgaaaagggaaagttggaaaggctcaaggacattgaaggaggtgaagattgtgcctttgctaacctagaagagttgttcctagtacccaaacatgttcattcccaagttcaaggtgtcggactttga

SEQ ID NO: 37050 - DNA, 492 bp, Glycine max
  Peptide Sequence Number=SeqID_128735
atggttaaggacgagtgtaagcaggtaagtgtctcctccaagaggttagctaagaaggaaagtcattttgtaatgaagacaaaaattaaagaaacttcctctcttagacaacctctacatattcttctttgtaaaaagacacttgttagcattgtcacacctcttgggcttgaggttattcctcaagtaaagaagttgttggatgagggtttggttcgtaagagcttaaatccttgtgctttgttggtgccaaaaataggtattattaggcaccaaatccctaaaataagtgatatgatgaatgtgttgagtgttgcaaccctcttttgtaaaatcactcatgcacccaacatcttcatgattcatgcacataggaactcattgggtgtcaagggaaggagcctagagtatcaagaacctcaggatttgaggtcaaatcctttccaagggggagaggatgatgcaatcctacctcccaagggtaatggatag

SEQ ID NO: 37051 - DNA, 528 bp, Glycine max
  Peptide Sequence Number=SeqID_128736
atggcatcgagaaaaagggccagagcagatgacatcccttcaccatctactcccgctcctccagcagcaacaataggaccggatgttcagagctcccaaaccttagtccctatgctacagagcttattccaaggattcgttattatcatgcacagtatgcgagaattggctcaccaaaggccaattataactatggagcagttccttgagcaagtagcatggcctggagctctaccttcaatggtgagacccaacgaggcttctcctcctgagcccacacctgcacgagttggtccagtgccagctgatccacaatctccaatggtgaatccaccttctcctaagcttgaagcagtgcccccatctccaccaattattatcatctctgattccctatttggagaagcagctgctccccctgattcgccagttggaaaagctgctattctctctgattcccaatctggagaggctattgctctctctgctttcccagttttccatctgatagatgaggaggaggcttag

SEQ ID NO: 37052 - DNA, 705 bp, Glycine max
  Peptide Sequence Number=SeqID_128737
gagagcagatggttcaaggcaatttgccccaaatttgggggagttaaccaggatgtaaagtggaagacctatgggaagatttgggacctagccacagtagaagtctccgtggaagcaattgcctcccttactcagtattatgacctagccatgggttgtatccattacaatcttgtcctctccataagacagcttagctaccccatgaggagagtgccatcggaggaaagcatcacgcctttcatcacacggggtttcggtgaccccaatgtgaaaatacttcaaggagtttggaaggcatgtggtgcaatgcaaaggaatgataaggagcttagggaaagcagcaacgggatcaccaacggctatcacaagtggctgagagtccaaacgaaagagttggattggctcccaaagctaaaagctgcaagagaggaacaggctgaaactccagagaagagtaaggaagtgcaaaccctaaaggcagaactcgaaagagcccaagtagtcaaagagaagttcaagtcaacggccatcaatgttcgaaaagacaacaatgagcttaagcttcgaagagccaaaagggatcagttgtgggtcgaaggcatgatcttgaaagatgagttaaaggcttgtgaaaggttgaaaagaagcttgtccgagcagttgagcaagaccgaagaaaatatgtgggccatcaccgactag

SEQ ID NO: 37053 - DNA, 947 bp, Glycine max
  Peptide Sequence Number=SeqID_128738
ccgatcaggatggtgtcgaggacactgtctgtgacaaatacagcatcagcaaggaaaagtgggcccagtttttccagacccgcagagaccttttttgggaggatgtgcgcagcaaggcacaggccatccagaagcagaatactgccccccacgttttgtctcgtgggggttatgattatttggagcagaagctcctggttgagaagaccaagaagaagctgcaggaagctgcacagtcaggaaacgttgatggcgtcatcgaccctccatccccagtcagacgccacgtgaagtggaagatggcccgcaccaagaagacagaggagatgacgactgaggccacaaaggaaatcgctgagaagattggatcgttcgtcccccatggacgtcaggatgttctggccgctgctattggatgtccagagcaccctggacgtgtccgtgctgctggagccgacaatcagggaccaactagaggagtccatcacagagaaagtgacgaggcaggtcatggcatccttcagttgcagatgcaatctcagggacttgcagtgcctcctgagcctctggttggtcctggtccctccggtcctcgagtaagcacaaaggggagttgtgttgatccctcaggaaacgatcctgagacgggtgactctgacaggtgcggcttgtacaaagaagcagatcctgcccgcctggttgccatggggagagtttatgagggatccactgttgttcataacactcctttgttgcctggccaagtaaaggtgagtgtggaagaggttgcagatgcagatgctccagttcctgtacccactgatgaggtttccttagtggggcagacacttcacaccttccttgcttggctgacacatctggtagctgtgtctccgccaaaaccacctccgaagcccgatccggaggtcaatgatccgcttatctga

SEQ ID NO: 37054 - DNA, 225 bp, Glycine max
  Peptide Sequence Number=SeqID_128739
atggtagaagaagatgcactttctcttgacaacattgaatgtggtgtatgtgctgagtacactgatgccggtgtatatggaagacgaaactctggatcaaacaaggaagcgttcgaaatgggagaacgacgattacatttgtcgtggacacattctgaacggaattatgggactctcttgaatccaagtatatggcagaagatgcctcaagtaacaaattcttag

SEQ ID NO: 37055 - DNA, 518 bp, Glycine max
  Peptide Sequence Number=SeqID_128740
atgatggtagacaccttgccggtgttttactatgagaagttaatgggctacatgccctccagcttcgcaaacttggtattcgccggggaaagaattgaagtaggtttgaagagagggaagttcgattacgtctcctccacaagtaccaacgctaggaggatcagagcaactagggcaaaaaggaaggaaggagataaccatgctgtcacttcagcgcccgcatggatcaagccaccgcagacctctcacggaacccatcagtacgcgcaacatcacccgaacttcttggctcgcgccggggactcttccaattcagcacccggaggccccccaactcgcccggccgacaacgcccactttggcgctggtttcaacgcgataaggaactttcccccgaggccaactccagaattcaccccgatcccaatgacgtacgaagagcttttgtcatccctcatcgctaaccagatgactgtgatatctcccaggaagatctaccagcctcctttcccaaagtg

SEQ ID NO: 37056 - DNA, 327 bp, Glycine max
  Peptide Sequence Number=SeqID_128741
atggacatccttgtctctctcatcctctcacgaaccccccccccccctattcaacttccaccggaatgtgagaaaaaaccaatgagaagtgagttatcaagaataggatgttgggcaaatggcctcagttatcttaatgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggtccgggagttgtatttacgcacggggaaggtattag

SEQ ID NO: 37057 - DNA, 635 bp, Glycine max
  Peptide Sequence Number=SeqID_128742
atgacggggacaaatcaaaatggaaaaagattctatcaagtcaagattaagggcctagatgttactagccttaaagagttgggatggttgatgggagccctccaaaggcaagccttccacaaaatgttcggaaagattttagatttgaccacagcggaggtatttacggaagccgttgtatccctcgcccaatactatgaccagccgttgagatgcttcacgtttggggacttccaaatagtaccgactgttgaagaatttgaggagattttaggatgccctcttgggggaagaaaatcgtatcttttctcctggtttcttccctccttgagcaagattgtagctatggtcggagattcagcgagagagttggattgtaggaagcaaactcgaaacggcgtagtgggcctacggcggaaatacttggaaggcaaggcaagggatatggcgaatcaagaggagtgggtcacgtttgcggatatactagctttgctaatctttggggttgtcctctttccaaacgtggacggtttggtggacctagccgcaattgatgcttctcttgcatatcaccatagcaaggagagtccggtggtagctatcttggcggacttatttgatacatttgaccgaag

SEQ ID NO: 37058 - DNA, 339 bp, Glycine max
  Peptide Sequence Number=SeqID_128743
atggagatcgattttgacaagattcagtcagtaccaacaaggaaagaaggacagattagctctaaaaccttaacttgcttgaatcttcggagatctgagtatcggcaactccctcaacagcttcactcgcttaaaggactacagcataaagtccttgcattgctgagcattcctctttcttttgttgactcgcttgctagctttccaactggaactaccgattatacgttaacaaaaaaacgggctgccttcccaaacttggcaggaatatctcctactcgcaggaaagggaagaaagacaagagatctgatctttcgaagaaaacgagtactggctag

SEQ ID NO: 37059 - DNA, 210 bp, Glycine max
  Peptide Sequence Number=SeqID_128744
atggctcatcacattgtagtagggatgcacaagttttacaaggttgtcagcggtgttaggtttagtcaagttgaaggcaagattttgaaaatgcttcctgaaaacaacacattgtcgaagaatcactatgagaactgcgtaagtgccccacatgtggggtatgacggtacaaagtcaaggatgacgactgcattgatgatgcaaccataa

SEQ ID NO: 37060 - DNA, 183 bp, Glycine max
  Peptide Sequence Number=SeqID_128745
atgaagctttatatggcatacttagcaaggcctaagtggagaaggaaaaaagcccaaatggagaaggacgaaggccgaagtggaaaaggacgaagccccaagtggagaaggatgaaggcccaagtggagaggggacgaaggcccaagtggagaaggacgaaagacccaagtggagaaggatga

SEQ ID NO: 37061 - DNA, 1056 bp, Glycine max
  Peptide Sequence Number=SeqID_128746
atgccgtctaatatgattaatttcacactctttatgaaccgaataatctgcaccaggattgctttgtcgttctttgtagcgctgctgactgcctgtcagggtccacagtctatcaaacccaaagaactcgttgccaatatcgtgtcgcaagaccagtcattgcaatcaaagcaacatgagcaacttaatgaaacagatgagtttctttctgagtatgctgcggtcatactcgccttgcgtaacaatcctacttttcaagcgcaattaacagaactggagattgcgcaggcagacttgcaactcgccacaaaatgcaagctcaatcaaaacagacgcaactacaaattaatgcaaactggattctcactggtgcgcgacgcgcgtgtcgcttacgcacaagccgttattagccaggaaaaagttaaaagactggaggaggctttaagtattaacaacacgatcacccgattagctaaaactcgtgagaatttaggggataccagcgctcaagattcgctgattgcagaaaacgaaatgttattagtcaagcgagacttgcaatctgcaaggattgaagcacgaattgctaatactcaactcatgcatatgcttaatcacgcaaatgagacacggaagttatcactaagcgatacactgttaccctcctgttctgcggaagacattagccaattaaaaactgctgctatctctagcagagcagatgtccttgctgctgaagctgcgatcatggccgtcaaagagaaacgccgtttgaacgggctaaactggttggcgcctgctgctattgcagatgcgaccagtggccaaaccaatggtcatgttctggcaccggctctaagattcaatttgccaatcttcaatcaaaatcagggacaggtcgaacgtattgatgctgagctactaaaaaccatgcacgaggctgaggcgaccaaactgaaggcctcccttgatattcaagtcagtcaattcaaataccagcgtgattgccaagagtggcaacagttgcagacagcgttacttcccaactcagtgcaa

SEQ ID NO: 37062 - DNA, 162 bp, Glycine max
  Peptide Sequence Number=SeqID_128747
atgcaagatccctcatgcaagatgtcgcaacgtgcccttttgtgggcgagtgagggcgaggctcacgggtgcgctttccaaaggaggaaagatgcgcggagtcgccaccaacgtttatttgtggaaaacattggaaaaaccgaaggaaactggtcaaaataa

SEQ ID NO: 37063 - DNA, 528 bp, Glycine max
  Peptide Sequence Number=SeqID_128748
caagtgcagctggatttgatctacgcgtactacaaaaatgccgatctgccactggcgcaagccgccatttcccgctttatgcgcgtgaacccgacgcaccctaacattgattacgtgatctatatgaagggcctgacggacatggcactggatgattccgcgctgcagggcttcttcgggatcgatcgttccgaccgcgatcctacccatgcgcgtgatgcattccgtgacttctctcagctactgcgcggctatccgaacagccagtacgcggcagatgcgcagaaacgtctgacgttcctgaaagatcgcctggcgaaatatgagctctccgtggcgcaattctataccaagcgcggtgcctatgtcgccgttgttaatcgggttgaaggtatgatgcgcgattatccggacacccaggccacgcgtgacgcgctgccgttgatggaaaatgcctatcgccagctgcagctgacgacggaagccgacaaagtcgcgaaaatcattgcggcgaacagcgcgtcctga

SEQ ID NO: 37064 - DNA, 144 bp, Glycine max
  Peptide Sequence Number=SeqID_128749
atgaaaattctaagttcgggagttatatttacgcttgaggaaggggaggagcttgccacccagctcgcccaggcgagcaaggttgcttcctccagaagcaacagccttttggaggaaggatctggaaggcctaagtgggtctga

SEQ ID NO: 37065 - DNA, 281 bp, Glycine max
  Peptide Sequence Number=SeqID_128750
atggtggcgcgtgttatgctcaggaacggatttgagcccggaatgggtctaggcaaggactgcctcgggaatgccgacgtggtagacatcaagggaaatccctacaagtatggattagggtatgaactcgggatgccggggaggaggaacgtgccgtcaagatttcgggcggataggttccctcaagatccaccaagttttgtgcaaccatgccaccccgattcccaagtggggaactggcgtgtgataagccagtcagaagtctataccgctgattcaat

SEQ ID NO: 37066 - DNA, 321 bp, Glycine max
  Peptide Sequence Number=SeqID_128751
atgaatgaagaatgtcgaagaacggtcgaaactttcgcgaaattcctcacggaaacaaaattgggggagaagcttgccacccaactcgcccaggtgagcagggttgcttcctccagaagcaacagccttctgaaggaatcttctggagggcccaagtgggcctggttgctatttgcacccccatttttactaagtacaccccctgccttttttttgcatgtcttggaatttcacaaattgcctaatgatgggtgccaagcacctcacaaggaccaaacaaaagtcgcatgtcatcaagcaaaggtccccggacgaaattag

SEQ ID NO: 37067 - DNA, 768 bp, Glycine max
  Peptide Sequence Number=SeqID_128752
atgctgggtgcacaagcaatagagctggtaagaaagattaccagtaccgctcgagatgattgcgaacccaaattaaatgacccagatctggcccctttgtcacgggccccagcagaatcactagcagaatgggctggactgagaggtccactagcagaatggccccatatactgatccttcgagagtggaggaacctacgccatgagaatttcaaatgcctcgacgtactcatcgatagtggttgtttggtggaggagctaaagttgagaaaaaggattacccatttggtggttgccgtaacgctcgagcagcacgcatttgaaagaggcccaatagtcgcaccaggagaatcggaacaacacaacaaagtgtcctacatctctgtgcacatagcagtcactaattgggagagttcattgacgctggttgagaccaggactcttgaggaagtggaagaagttttacattattcatctcaaacaaagacttctttgactcgaataatgttggacaatatggttgtacctctaccaaatggggatgtggacatatctatgctaaaagaagctgtgcagttgataaatgggagatatgagactgaggcatcaggcaatgtcacactagatactgtacataaaattgggcaaagcggagtgacctacatttctagtggttcgttgactcattctgtgaaagcactagacgtctccctcaaaattgataccgaattagcactcaaagttggaaggcgcactggacgagcttga

SEQ ID NO: 37068 - DNA, 237 bp, Glycine max
  Peptide Sequence Number=SeqID_128753
atggaggttcaccgacaacacctcgcatgtccactaactttttgtgttgtgctccagccatttcattcagaagatctgttacaactagggatgtcaatggggtggggcagggagtacttctcggcttcttattcctactcccaattagtccttgttcttgttcccggtctctgtcgtggggattttttttttccgttcccatccctacgggttcccacagtctatgtgaggccttga

SEQ ID NO: 37069 - DNA, 1098 bp, Glycine max
  Peptide Sequence Number=SeqID_128754
atggttagaacacgaggtttaggtcgtgctataggtagggttataggcagagatagacaggatgaggatgatgcagttgatgttccacagaggcgtaagcctactgcatcagcccgtaggcaacaggttcaacaaatgactgaggatgtttctcacatgactgaggatgtccctcatatggctgaggatgcacctgagatgactacggacatacaggcgattgttgcagaggacttaggtcgtgatggtgctgaggggtcacatgctgatgatgctgagggattccgaggtgggccacgtgacccatcagtgctgacttcatttgtagaccatgttgcaaatgccatttggagtggacaagaacgtcctaagttgaagttggtgtcccacgggaggaaggtgatgttaattgggagtccattgatcgggtgttcagttgtaaccggcgatcctagacttatatccgcatttgtggagaggtggcacagggagaccagtaccttccacctttcagtaggagagttgacgatcacactggatgatgttttgtcactcctccatctgcctatcagtggcgccttccacagctttcatgctctttcagtggacgaggcgttagatgaagcttctaggaccacaacacgacagattgaggggtacctgactttattacagtgctggatctatgagcactttccaagtgtgcatcagtgcgtcacagatgatgcgtacgaggagacgtccccacgtgcttcccggtggctgacgacaaaggcgcatatgaaaggaattacaggagcgtcgtaccaggcatgttgtgatgctttgacggtcacagatgtgtgttggttgccttacagtgagcatcgaggggttagggggtttgagctgatttcatcgttccagggtcagctgagatgggatcctatggtggtcacagttcgaccgaagagggtgctacgacagtttggttacattcagagcatcccttcgccgcctgttagcgctttgttgtcatatgatgatatagatgacatgtggatgcatttcgcagaccacgtactagctgtgggtgagctttgtgtagtgcctgggtag

SEQ ID NO: 37070 - DNA, 126 bp, Glycine max
  Peptide Sequence Number=SeqID_128755
atggacgaagatcactggatgtatgactacatcatgtctgaagaagttaatatgaatgaagaaaatggagagaaacctaatgtgaatgaagaaaatggagaggaagttggtgtttgctacctgtaa

SEQ ID NO: 37071 - DNA, 663 bp, Glycine max
  Peptide Sequence Number=SeqID_128756
atgtaccccctaggttaccaatatagtcaaaatagacaatattcattcacctatgaggcaaagatcaagttgaagaaaggcacgaatgagataagtctacttagtggcactattggtttacctaactatggtgcccacttctccaatgtgtcagttggtgtttatggtccagttcaattagtagcactaaagaataacactgaggtagtcaaggatatcaccaataatacattgaattataaggtgggattacatggtgagattgtgaaactatacaatccagaaaacaataaaggatggaacacaaatggtcttccaacttatagagtatttgtttggtataaggccttattcaagagtcctaagggaattgatcttgtcgtggtgaatttgaaagggtatcatttaccatgctcattcattcgtgaagataatcaaaacacattggtattgtttgaagagtttgaaggtcaccccaatgaggttaaatttgtcacggtaactgttgacaaaatttgtgcaaattcatatgaaggaaacatgctagaattatcatgctatgaagagcaagtcatctctaaaattaaatttgcaagctttgctgtgcccgaagatgaatgtggatctcccaatgctttatccatccagagcaagttttcatga

SEQ ID NO: 37072 - DNA, 621 bp, Glycine max
  Peptide Sequence Number=SeqID_128757
atgggaaggtctttcttcttgacaattttcatggcctttctttgtggaggatgcaggcgtgggtacataggggcacccagcaatattgttggtgcacccagcaatttattgaaaggtcaattttgcccttcatttaaaaacataaaaagctttttccctcttcggaagcattctgtcttctcttccgcgaaaaagtttttctcctctcttctctcttccgcgaaagcaagcttccttggtggtcttcttctccgccttcatcttctctgcaaggcttctctcttccatttgcattcgagggtagaggacgccgaaaaaaatggcggaagcttagtgacggtgaaccttccggaagacccgttaggggttcttcctgaacttccgaaagaagatcttccagaagatttccggaagaagggtttttccggaagtaatgaaatgacttccggaagaacaggtcttccggaaagctctcgcaacatctcttccggaatgttttcggaagatgtacttcttccggaaacattccggaaaagcgttcttccggatgacctttcagtggttccggaagcactttccggaagacccttcttccggaatgtttccgaaagaattgactaa

SEQ ID NO: 37073 - DNA, 408 bp, Glycine max
  Peptide Sequence Number=SeqID_128758
atgttagaattcacaagcgattgtcctcctcaaatctcagccagcctgcatcaatcagactttgcaccttatgcttcaaggtcatatagtgctcaatggaatgtcttggaactccccaatgataagcacatgtcacattcgagttgtatcctcaaagaaatgaaggtaatggacaggactaagattggctcggtagtgatattgctagggaggatattagtacatggggttataaagggctactggaaagtttggccacgcggaaattgcaaccacaacatgaggttctcccttcttcttccttttgtcactcctctcaggtcccctattaccaggatttacaaaagcaacataattaaatttccctctcctcagagctgcttcaattctctcgccaggaaacactag

SEQ ID NO: 37074 - DNA, 234 bp, Glycine max
  Peptide Sequence Number=SeqID_128759
atgaaggccaatatgacggccatgaaggagcaggtgacaacaatgatggaagcaatgatgagcatgaggaagatggtggaggtcaacattgttatagttgttgctactagtactgctactaagagggacttaattcactcgtctaggttcaatcaagagagtcatccagtcttagatgtagtaggtcaaggaggtgaggcaatgacaaatgcatatgggcttcattatgtctag

SEQ ID NO: 37075 - DNA, 423 bp, Glycine max
  Peptide Sequence Number=SeqID_128760
atgccgaagaggctttacttcctcgtggaacttcccaaggaagtgacggtggcgccgaggcgggtccggtcggggatcaacatgagcgccaaggagaggctcgagagcctcgttttggctcgacggtcggcttcagatctcacgatcatgaaaccgccgtcgagccagaaggaggtgatggagagtggtggcggggtgaggcttaagatgaggctgcccaaggccgaggtggagaggctgatgagagggtgcgagactgaggctgaggctgcggagaagattatgggactttgcatggcgaataatggtggtggggttgaagctagaaatggagatggggaggtgaaaggcagagttggggaaagtacaaaggcacgtgagccagtttatgacaaattattacgtggtttggaactatcatga

SEQ ID NO: 37076 - DNA, 1632 bp, Glycine max
  Peptide Sequence Number=SeqID_128761
atggagggaagtgggtcagaatgcagtgaagcagaggctagttcttggacaagaaagctggaactacccacctttgatggaatcatagaaggggaaactgattcaaagggtaacagttttgagtgtgatgatgacccattgcaattcttgaaattagaaaacacaagtaaagaaggttcagtaatcaagaatcatgcaccttgttgtggagaagaaaccaaaaatgaagcaaaattagcaagagaaacagcaaatggaaaagttatgatggaggaagaagttgatcctttgatcaagaaggagaaacacaaagaaaacagagtgaagaatgtggactgtgaagaccattttcttgataacccaataccaaagttgatcaagaaggaagttgaaactggtgatgcagccaagcctcattcttttcaagattcagatttccataaaaagattgtgatgatgaaacataaatcattgttggacccaaattcaatcatgaaggtggttggaacatcaatggtgctggaatcttttaatgtcaacttgttggctgagcctttggcattaaactttgttgtgcctatggatgacagatcgacaatggagccaaggccaaaggaatgtacagaggcagtcatgatggttcaagttatacggagtccaccctcatcccctccaccaccgaagctgccggacctgagtttgtatgaagtggccagtgggtttacaaaagtgttgcaaatagcggctatcgtggcactatcacgctatagcatagtgggttttaaggaaaatgcaatcgcgatggtgtcgcattgcggactccacgaaaatcgcaatcgtgggcgccttacgcatcatggaatctcattgtgccgtggctgttgcatcgtcggtttccgaaaaggtcaggtgcagactgcagattcgggtcgtgtctgcacggcaattcagagttgttttgggcttgtggacaagagggacaccaaagaggcacatcttgttagagtaaatgattccgttctgaaggatgagaaagaggaaggggaatttttggaattctacaatccctgtgtagctgatgacattataagagcagagatggaaagagattgcagcaccacgcatggaagtccagattattcagaatttgcttccatcacaacctccactagagccacagaacacaaccccgcatgcaggggcagtgggtcattcctagttaagctacaactacagtgggtgcagttgtcttccagcaatcatagaaaacttgaggaagtttcaaggtctttggtagagatgatgtgcagtttctttgttgcatcttggactggggttgttaagtatcatggacccaggcctagcaggagaccaaagcaggtttttgtagccaaccatacttccatgattgatttcattatcttagaacagatgactgcttttgctgttattatgcagaagcatcctggatgggttgagtaccattttggagagtctaggatgcatctggttcaaccgtacagaggcaaaggatcgggaaatagtagcaaggaaggagctgataacaacccccttctcatatttcctgaaggaacttgtgtaaataatcactatacagtcatgttcaagaag

SEQ ID NO: 37077 - DNA, 1209 bp, Glycine max
  Peptide Sequence Number=SeqID_128762
atgagtgtcaagcatcctggacgtgttcgtgtcggtggacatggtgtgaccataaccagctactttggacatgcttcctgtgggtcccacagttcttcgcctgcgatcaccgccgaaagattggttgaaatcatacaaactataaagcaagaggtgaagaaagaggtagaagacgagaacaaagaccgtatggacaagatgaaaatggagttggatgcgatcaagagtgaattatcccaaattcatacgcaacagtcagctcccccaagaccgtctaaccctgacatatttgttgcacatgttagcacgaaagagagttgtgctgaagctgctaataatgttgttggtaacgagcggtctacatttgatacatgtagtatgggcttctacattgtttgtggtgacagtacacagctggtggcagggggaaaggtctttggagtaggtggcacgatacacactgttgcttatggagatgatgtagtaagggtgtgtgttgacactgtatacgatgctgaagccattgtcccgttacccacttcagagattcagtatgtcagggacgccgtgaactcattcattggatggcccagacatctagtgaaacctttatcttatgattctgaccttaatgtgtggaagccagttgaacatagtagtgatgcaaagcttgcagtggaagtgccgtgggaggctcaccaatttggacttcctgagattggggcaaaattttacatcacacatgcagatctagcaaaaataatatcaggtgacaagtgtttaaacatagcgatactacaattgtggaccatatttatgaatgagtgcggtagaagcaaagctgatcagtcactatatggtttgttggagcctcaatctatacaaaatgctaaggaaagacgtcaacaatacattgaaacatgggtcaaggaatcacaaagtgcaatgaagacaataaccagttcttttgaaggcatgtctaatcaaggtgcacctcggtgggttgaacccaagactaatgtgcaaagtggagggtttgagtgcggatattatgtcatgcactggatgtggtgcatcgtgactgccggtttgaaggatgactggcacaagtggttttctgatggctcatcgttagatgtggaggccatcacaacagttcgacagaaatgggcaacttactttttatcttttaggaaaagcagttgctaa

SEQ ID NO: 37078 - DNA, 133 bp, Glycine max
  Peptide Sequence Number=SeqID_128763
atggaggattgccttgagggtccgcatttaggcaatcatgaaacacagctccaaactcgaaagtggaggacgcatgaacgaaaacgcaattcatgggctccgaaagagggggcaggaccgaacggtccaccgg

SEQ ID NO: 37079 - DNA, 522 bp, Glycine max
  Peptide Sequence Number=SeqID_128764
atggaagtcaatgaaaaatgtgatgtgtatagctttggggtattagcaattcaaacaccttttggagagtaccatgaagattttataacttcattgttgacatcttcatcaaatttcattgactcaacacttgatattccttcgttgatgggtaagttagaccaacgtctcccttaccctccaaatcctattgcaaaggagatagttttaactgtgagaatagcaaatgcttgcttgattgaaaaccccattctcgccctaccatggagcaagttaccaaagaacttgcaatatgtcgcaacgtgcccttcgcgggcgagcgagggcgaggctcacgggtgcgctttcccaaaggaggaaaggtgcgcggagtcgccaccaacatttatttgtggaaaacgtcggaaaaaccgaaggaaatcggtcaaaatgaaaattctaagttcgggagttgtatttacgtttgaggaaggtattagcacctctcacgtttgtctcaaaggacaacaacctattttttag

SEQ ID NO: 37080 - DNA, 327 bp, Glycine max
  Peptide Sequence Number=SeqID_128765
atgggtcttcgtaaacttatgacgaccgatgagaacagagaccagacgcccgaaattggcaggaaaagagctgcgcggcacgtgatagcaacactatggcgtgctattaactactctggcagtgagcataggttttacagggagaagctcagtgtaatggagaagcaaacagagttggattattttgatgagaagaaactgatgattgctaaattgttgaggagaaagagtactgagacactgactaaagttagattggctgccaagaaggctgaactaccaaatcttgatggtacagaccaagtggggattgttggtgtatgctga

SEQ ID NO: 37081 - DNA, 1263 bp, Glycine max
  Peptide Sequence Number=SeqID_128766
atgcttactgagaatacaccacaaattgatgactcttccacatctcccattgaaagacatgttaagtggaagttggcccgcacaaagcgatatgggcagatgacatctaaggcagcacaagaaatatctgataaaattaagaacaaacaacacagggttcctctattctccaaggtcgtgcgacatactgaacactgccattgggtgatcgaatcatggaggtcgtgctcgtgcaacgggatatgtcttaaggaagagtggaggaatgagattatagtcaaccttaaagaagaaatgaggaatgaaattgaggaagaaaacaagcggactctagagaaaatgaaacaggagttgaaggagaccatcaagatagacacaaagggtagtaatgctaaaaatgttgtcaacccattaggggaagaacatgaagctaatgctataccgactatagggttgcatgtgcaaggtgatacttgtacacgcttggtggccttgggaaacatatatgatgcggggtctaccatacacatcgtcgcttatgcaggtgatgtggcccttcacatattcattgcatggccagcaaatcttgtcaaagttgtatcacatgaggattcacatgttactcctaagaaagcggctaaacatgttcaaaggtcgaatgatgttggtattgaggatcctttgcgtcagttgattaggaccctgtatgacatttacgactcgtttgttgagttgttgtgggatggaagtaaatttgggattccaaatgcagatgcatcattcttcttaacatattctgatgatgttgtcctttggttatgttcgctgcgtaagaagcttgacattcatatcaaagtaccagttaacaacagtgtaatgaagacgttaaagagtagtttggatggtcatattgataaagttgcaatgcagtggattgaaataaagagtcatgttcaaactggtgggtatgggtgtggctattatgtcatgtattggatgtggaacatagtaggcggggagttgaagaatgattggagcatgggtacatcctttgtggtacaagtagagggtacatctacttgggttgttgtaactgacaacaagagagggtacatctcttgtggatcagttcaagtggagggtacatccacttggttgttcaaagagaacaagggagggtacatcccttgtggatctttgcttgtaaaggcttttacaaaattgaaaagaaatctcaaggaccacaggtcgcttggggactag

SEQ ID NO: 37082 - DNA, 480 bp, Glycine max
  Peptide Sequence Number=SeqID_128767
atggcatatgtcagggccaggccaccgtggcctcgaactgctcgagagtgggccaagggaaaggactggggtcctgactttactggtgcaggcgatctgggatggacctcagagacggtacctcctcttgagccggcggtggcatatctgcagctggttattggtcctcctttggctgctatggcacctgaccctgtgcttgtctgggatgcagtatttcttgatgaaggccctattaatatgcggccggatgaccttgctgggggcgacgggcactccgtaggactggtagagacccgtgatcagagcgggaaacgtcatccatatatgtgtaagggtggtcatgctggtgcgcatgattcgcacccatctccctgcggcggtccgggcgaagtcttgccccgacatgtctcctcctctggatgtactcgcacttttggccctctgccaagatcagtaggtgccccaggaactggctga

SEQ ID NO: 37083 - DNA, 516 bp, Glycine max
  Peptide Sequence Number=SeqID_128768
atgtatcctaaggctcatgagaacccaaaggccttctcttgcatctctagcccaatcttgttggagtcttctatccaatgcctttgcgggttgtcttttgggccgaccttggattcactcggttggggtggtcccttcaacgctccaccaaaaattgaagttcgtggtggaagggcgtttggtcattgtgtcgggggaggaggatattctactgcggaagaatccttggagacggctttccagtcctttaaggtagtgagcaatgcttttgtggaatccctcccgacgcaaccccgcatatttgacgctgcgatgatggtagcccgtgttatgttagggcacggatatgagcccgaaataggcttaggaaagaacaacgatggtgtggccagcttcgtggaattcaaggaaaaccgcaaggggtttgggctaggctataggtccacgcgtgcggatgtaagaagaagcaccctagagaagagaagtagggggatgagccaacagccaaggccgtga

SEQ ID NO: 37084 - DNA, 258 bp, Glycine max
  Peptide Sequence Number=SeqID_128769
atgaggctaaagaaaggaacatccaagggttttcgtggcaatcttcgacagagcgttcatggcggggcggctaagagcgcaacaaagaagaaacccactccatccagtggagctgctgcgaaagttgcagtgaagaagacaatcgcgcctaggaccaccaactccggcatacagaaggtggttctggtgtctttcgagctcagagacttcctcgacgctccacaagtgtcccgattcgaagccgtcaagaaagtctag

SEQ ID NO: 37085 - DNA, 441 bp, Glycine max
  Peptide Sequence Number=SeqID_128770
atgattatgaggggccaagacatttatagtagccaagatgaaggaatctacccccaagaagaaggacaacctttaatggttaaggaggagtgtaaagaggtgagtgtctcctctaagaggaataatcaacatgaaaatacagaaaagctaagctctaacttctcaaggaagcttctcaaggaggtacaacaagcaaaaaggagcagaaataaagaaaaagaagaagaaaatcagaagaagcccaagtccagcaaggcgctaagcgcaggatgcgcccagcgtgcaagaaggcaaggcgctaagcgcacgacacgcgctgagcgtgaggcttcacgctcagcgagcttacgaaggcccaaacccaagtttgcacctataaataagagggtcagcctaggaaaacgaacacacttcctcagagctcagttttcaaacttctga

SEQ ID NO: 37086 - DNA, 405 bp, Glycine max
  Peptide Sequence Number=SeqID_128771
atggtgagtgagggcgttgactctgtcacgcgccgccttggccaaccatatttgggttttgggattttgacaaggtcatctctgtcgtgcatcgccactgccacgcccaaggagaggacattggatttgatagaagaaaatggtgaatgtggtgagggaactggagtaagggaacaaatgaacggtggtcttcagaattttctgtcgtgttctcaagtcttgacggcgtcatggcttcaagagcggaactacccatcaatgcattcaagtggagaatggcatggtggtacaaatgttgggaattttgttgctgcaataaaggtggaagaaccgcaaaatgttaaagaagaacctaaagcaatagttattagctttgatgatgaacttgaagctcttaagggataa

SEQ ID NO: 37087 - DNA, 507 bp, Glycine max
  Peptide Sequence Number=SeqID_128772
atgggcttttgtttggagaagaaactttcagattgggaggtgaatttagtgtcagattttttggctgaattgaataattatagtattcggccaagtgaacaggataggtggatgtgggtggccgggagcgaaaatatatacactgttagaggggcttatgcatggttctgtgaaagggttagggagatttggctggagtgttactcgtggattgggttttcttcaggggttcaggtggtgccaagggaacattttctgcagcattggtactgtgaaagcggcagaattgatgggcagaggcagatggtgttgtgggctgctgtaacatggtgtatttggcgtcataggaacaagtacatttttaacaaccaggaattccgaggggaaacagtattggatgatgcaatgttcttcatctggtcgtggctgaatgcattggaaaagggttttaatgtcccattccaagtatggagtagtaatattaggatgaattttgtaaggggatga

SEQ ID NO: 37088 - DNA, 348 bp, Glycine max
  Peptide Sequence Number=SeqID_128773
atggcacaacgacagctgatggggagcttccccaaggaggagtcgagtggcttatcgaggaaaatagtgaggatgatattgatgagggcatgtgtgatgtttcctcatgggagtttcactattaaggatcttctaattgtcgacctcgtgtctcacccttttgtgcatagtttctccctcaggtttaggttaatggtaactgctttgacactagatttatatcaaggcattgatgtgttaccaaatttagcatgggagaggcaatccattattcgatgcaatgatgctattatcagacactggatgacccagacatctcttaaggttttgatgaaatcaaagacataa

SEQ ID NO: 37089 - DNA, 705 bp, Glycine max
  Peptide Sequence Number=SeqID_128774
atggccacctctcctcctactaagatgacccctgtcatcattattagtggcagaaaagtcggcaagaccttgcaagacatgggtaccggccaagacctagtggtccaacgaagggagtctatggctctcaattttgagggactcgtccttgtgtgcacctggattgatgatcttgaatttgtggttcaatctactcctccttccagatggcccggcttgaatgatgcaaaccaggtaatggcgtatttcgctgtgacaaaacttggagaagcccccatagatggtaccactgatacctttccaaaaggacttacctctgtatatggcaagtgggtttctgatgtagctaaaagattggtgttgctaggtacatcgatggtggatggtttggttgttaacggaagtactttggagatggatgaagatcaatggatgtatgatagtataatgtctgaagaagttgatatgaatgaacgaaatgaagacgacgctggtgtgaatgaagaacatgttgattattctgatgtgttcaatacttctcgggtgtttgctacccgagatgatgttctacattgggctcgatcggttgcttatgaaattggatttgcagtggtgattatgaggtcagacacaaacacgggaaatatgggtgtccctttaagcttcatgggaaaccagtggttggaggccaagcatggatggtga

SEQ ID NO: 37090 - DNA, 207 bp, Glycine max
  Peptide Sequence Number=SeqID_128775
atggcgatcccagtaatgaatcatggatcagatgaggatacggaacatgggttttccaaagatgatgttgatctattatatgatggagattttgatgaatctggatgggcattggatagaagactccaagtagattgggccagagatgcaagagaaggccctagggttcttatgagccttagggtagacttcgggctcatgaactaa

SEQ ID NO: 37091 - DNA, 144 bp, Glycine max
  Peptide Sequence Number=SeqID_128776
atggaaagagaagaagataaaggaggatggagattgagggaagtggaatggagaaggaagaaagatgattggagatgccacttcaaggagaagatgagtcaagaagaagtgcaccaccataggaagctatggataagagcttga

SEQ ID NO: 37092 - DNA, 273 bp, Glycine max
  Peptide Sequence Number=SeqID_128777
atgaagaatggagaaaagagggaggtggttgccgcccagctcccccaggcgagctgggttgattccaccagaaggcaccgccttttgttggaaccccctggaaggcccaaattacgtaacgacacccattttctttccggaatgttgcgaaactttacggattatgcaaaaatgccatttttgacttccgaatgtttcagaactttacaaggattgcgcaacaatgcttcctttcgacttctagaatgttgcggaacttcacggattacctaa

SEQ ID NO: 37093 - DNA, 303 bp, Glycine max
  misc_feature (10)..(10): n is a, c, g, or t
  Peptide Sequence Number=SeqID_128778
atgagttgtnacaaaggaagaaaaccaaacatttatcatcttcatgtctttgggtgcaagtgttttgtgttaaacaatgagaaagacaacttagctaagtttgatgtaaaatcagatgaagattctttagaaaacatgcacattcatgaggaagggcacaaaggcaaaggagatgaaaatgatgaagactctcaaattgataaaactaaaacaaatacagatattcctaaagagtggagaacttcaagataccatcctcttgataatatcatcagtgacatctcaaaaggggtaacaacttga

SEQ ID NO: 37094 - DNA, 423 bp, Glycine max
  Peptide Sequence Number=SeqID_128779
atggataataatgaaaagggattcagacatggggaagacattgatggatttgttcttggggcaagccatggaaggggaggtgcagaagaagacgagggagacaggagagtggctctccgcactccaccaatgctgagcctagaattacctcttcgagaaaagaaaggatacgttgaggaagaatctaaggtagataggttagtagtgatgcagaagaagcctttcagtgtcaagaatgtggataatcttgttgacgaggttcatgaaaagcctcaccatccagatacaaatcatgtaggtactgatatagagagttttccaagcgggcttgaagatacatcagtgttgacagattatggttatcatgtggctgctagagtttgggaatatactgagttgagtttgacctctcatgggaggaag

SEQ ID NO: 37095 - DNA, 636 bp, Glycine max
  Peptide Sequence Number=SeqID_128780
atggcatcatcaaagcatcaaaggcaaagtctttgcttctacactctcttcctggaccttcatggcaattgggctaaatggcctccagaaaaagaagagcgtccacctcccgacctcaggagccctacgataccactagagttccatcaggagctcgagagacgcagatggcacagggccttgaccaggcagtcggataaccacattgatgtggccttgttcaaggaattctacgcaaacttatatgatccaaaggataagtccccaaggcagtgcagattacggggaaaattgattaaatttgatgctgcgactcttaatgagttctggagacccctgtggttttggagccaggggagtagtactccacatactctagggagcccccgagaagctcctgaggaaggatctcacgacactggctcagacctgaagtgtcttatcttactccaacctcaccccctcttctcacacgttcgatctaaatatggacagggcgaggttggtatatggattggtgatgaagatggacatggacgtgggctccatcatttctggtcagatatcacagatggcccaattcaactcctttcggcttggattccttgcgctcatcacggctttatgtatcgctag

SEQ ID NO: 37096 - DNA, 346 bp, Glycine max
  Peptide Sequence Number=SeqID_128781
atgactaagggcaatccaggtgatttacaaccctttgatcctgaaaaagatagaacttttcatagattagttaagcatagtgtgcatcctgatcattctgtgcattttgagcattctgagtattttgttgctggtgattctaaacattctgattttgagcattcgactactaattttcataccgagaacatggctcaacctctacctcgtgagaggactcttagggagatggttgcacctgatttcacttatgaaagcttgtgcattcaatatcctgatgaggatgtttcatatgttctcaagactggactaatacatttgttgcccaagtttcatggtcttacag

SEQ ID NO: 37097 - DNA, 249 bp, Glycine max
  Peptide Sequence Number=SeqID_128782
atgaataagagcttgaagttaggaaaagatgagatgagggagagggagagaaggagcacggaatttggtgcctcaaatgagctatggttcagcccactaatccaagatcaagtccaagattctccaatgcgacttgatgcaatcctcccaaataggggacccatcaccagagccatggctaggagactccaggaacattggcttagggatgcaggagaaggccctagggttctcatgagtcttaggtag

SEQ ID NO: 37098 - DNA, 1323 bp, Glycine max
  Peptide Sequence Number=SeqID_128783
atgcctcatcattctaatagaaaggtaaattttatcagtttaaacttctgggaaagttggtccttgacaagttccttattgctatcattagaaatttctaatgaaagactcgaatgtttccaggttctgaactatgatattgaagctgagcgtctagctaagcctgttgctggggaggacaaggggtacagcaggaccagggatttgaatagtgagaagctattggagcaattgcctgctttgcagcagctgctctatcgtcttgttggttgtcgtccagaaggagcagctattagcaattatgtgatacaatatgccctggctctggttctgaaagagagctttaaaatttattgtgctattaatgatggcattatcaatcttgttgataagttttttgagatgcccagacatgaagctatcaaagcctttgatgtctataagcgtgcgggtcagcaggcggaaagtctctctgatttctatgaaatatgcaaaagactggaacttgctaggaattttcagtttcctgttttaagagagcctccacaatcatttcttgtaaccatggaagaattcataaaggaggcaccacgagtggttatagttccaaatgagccattgttattgttgacttacagaccagaaggtgttcccacgatagaagacaataaatcttctgaagaacaggagccatcagtgcctgttgatgatattgtctcaaattctgagcctgctcctccacagtctcgcaacaattttgaaaccggagacttactggggttgaatgacagtacacctgatgcatccttgatagaagaaagaaatgctcttgccctagccatagtctccactgaaactggaagtactgctttagattcaagtggtgctcaggcaagagattttgatccaactgaatgggagattgccctggtctccactccaagtaccaatatttcttcagtcaatgagagacagttggcgggtgggttgaattctctcacccttagcagcttatatgatgaaggagcatatagatctgcgcagcaaccagtatatgtagtgccagccccaaatccatttgaagtgcaagatccttttgctttatcaagtagcatccctcccacgtcaaccgtacaaatggcagcaattgctcaacagcatataaatccattccttcattaccaaccatatcagccactgcagcagcatatgctgatgaacccagcaaatccctttggggatgcaggatacggggcatttcctgtgaatcctgtttctcaccctcataataaaaatccatttggaagcactggcttgatgtag

SEQ ID NO: 37099 - DNA, 606 bp, Glycine max
  Peptide Sequence Number=SeqID_128784
atggctagaacacgaggtttaggtcgtgtcataggtagagttataggcagagatagacaggatgaccatgatgatgttcctgagaggtgtaggtctactgcatcagcccgtaggcaacaggatgctcttgatatggctgaggaagcacctgagatgactgcggacgtacagggtgctgatggtgctgaggggtcacatgccgatgatgctgagggattcccaggtgggccacgtgacctgtcagtgctgacatcatttgcggaccatgttgcacacgccgtttggagtgaacaggaacgtcctgatttgaagttagtgtcacatgggaggaaggtgacattgattgggaggccagtgcctgagattgaaggaatggtaggtgctacaggattaagtccactgatcgattgttcagttgttactggcgatcctggacttgtatccgcatttgtggagaggtggcatagtgagaccagcaccttccaccttccagtaggagagttgacgatcacattggatgatgtgtcgtcactcctccatttgcctttcactggcgcgctgcacaattttcatgctctttctacagaggaggcaatctattgctga

SEQ ID NO: 37100 - DNA, 213 bp, Glycine max
  Peptide Sequence Number=SeqID_128785
atggccaactattttgacggaatggtagaaaaaatggatggcaaagtcgatgatgaaaatattcaagaagtgttacgtgaggcagctttgataccagattttaatagacaacaatgggctaaagctattaaatggttattatcaacaaggaatagagaggagttgcgttcttacaaagcaagaaaaaaagttgattcttctaacattgtttga

SEQ ID NO: 37101 - DNA, 582 bp, Glycine max
  Peptide Sequence Number=SeqID_128786
atggatgatgacatacttgacaaactagggaaagacaaaccttttaaggtggaggcaaacattgcatgtgatagagtaacaataaattttgaatctattctgcaagatctacttgtgaagtggcatcaaaagtggatgctagcagctggtgtctcgctaagcgaggcttgtgcgcttagcgagagtcatgcactaagcgaggcactcagcccgcttagcgagttgggagaatctggaggagaatttgagaagcatctgcgcgctcagtgcatcatcaactcgctctgcgagacatttgtctctttttgcgctaagcgcaaaaatggcactaagcaagccttcgaggacagaaagtcctttttaaggctgaagttagaaaaatcaagcatagagcatggattagaacatagagagcataacagaggcaaaaaacagagcaaggaagccaaaaaccttagctttcaagaggatcttagctggaaggtgttgccttatgatggaagactaagtatctctgttgggaaattctgctggaacatgatgctaagttcgacgagacatccgagaacgaggtttaattag

SEQ ID NO: 37102 - DNA, 231 bp, Glycine max
  Peptide Sequence Number=SeqID_128787
atggggaatgagtattgtaaccaaatcattttcagccttaacacaacaacattgcactacatcattccatatgctattggagcttctgcaagtggtgaaatattcacccttggattggatgggccctattgctcttttgatgattatgattttctcaacaaaatgcccaattccacacgtgtggctgtgtccaagcctcactgtgctctgcagaagtggaactttgcatga

SEQ ID NO: 37103 - DNA, 282 bp, Glycine max
  Peptide Sequence Number=SeqID_128788
atggaaaagggtcgtcccgtttcaactcgcattcctaatgagatggacgaagaagaaaaacgtgaatgcgagttgaaacgaaacgaccctttgcagtcatctttctccttggatcaggaccccattgatctccttcatattcttgccacattgattggtgtggaagtaaaccaaataaggtggtcaaagttcaagtctactggacacctaggttggcgatattgcaatggaggtgacggaggtgtcattggtctgccaacaccctcgtcatcgctttggtaa

SEQ ID NO: 37104 - DNA, 336 bp, Glycine max
  Peptide Sequence Number=SeqID_128789
atggtcgaagaatttgtgaaagactctgttcatcaagacagcgtcgctgtcataaccctcgatcaccccaaagcttggtatctaatttttttcaataaatttcaaacttccttttctctgcgagcattttccactatggccgaagaatttgtgaagggctctgttcatcaaaacaatgtcgctgtcataaccctcgatcccccccccccaaagactgcattacgtgctcctgatgatggtatcatgacagctgaacttcttgaaagggtgtatttggagataatgaacaaggacaccgatagtgcgactgatatgaagtcaccgaccgcgctgtga

SEQ ID NO: 37105 - DNA, 858 bp, Glycine max
  Peptide Sequence Number=SeqID_128790
atggggaagaagcagaacgagatccaaaaaacggggctaggtcgagccctgctgtctcgcttctacaggaagaagttccttgaatccttcaccgaagtctccgacatcgacgccgtcgtcgagcaatccctagaacccctccccaaactcgccgctgccgcttcaaccactcttatcagcctggaacttattgagaggatcatcgtgttcgggttttattatagggagatggagcggttttcaggaaagtgcagggatttaagttggataaggtctgcaaatgcgaaccctttggagaaaaaggagaagggaagtgtttatcgtagggcacttgccaatggcattgttgaaatactctcagtttataggtctgcggttctgcatattgagcagaagttgttgtctgaaaacatgcctatcttggccacagttactcagggccttaacaagtttctttgccttttgcctcctctgtatgagctcatcctagagattgagcgtgatgatattcgtggaggtcagcttcttaatcttctacataagagatgccactgtggagtgcctgaattacagacttgcatgcaaaggtatgcagttcttttcacgtgtagtattcttggtaatgttaagatgcaggagaagcaagttgatcttctttcgaagttgaaaaagaatgtaagcactccagagggggttccacgcctttttgatttagtgaaagttcaagatgaaagaatgaagcttgctttctttgcggcacttagaaacactgtggttgctaaagatcttgaccaggtcagttgcactttcgtagcaggatgcttcattctgatgataaatattaaggatccatcataa

SEQ ID NO: 37106 - DNA, 654 bp, Glycine max
  Peptide Sequence Number=SeqID_128791
atggtgtcaccacaagggaggaacacaatgttagttgatgatctcgtgccttacgtggaaaagttagcaattttaggtgaagaacaagagagaatcactaagccagtgtcacatggtccagcatcagagcgtgaattcccagcacaagagtttcacattcttcaatcaagtgttgaaactcggggcataggtagacgaagggagcctgttgaagcagaacaatattcccaacaaatgatggagcgtggtcatggaatgtattacacgctagcaacattttcccaatatccttcacagatgtatcagtatccttttgaaggtcatcacactgatacttctacgagtgaacattcgtacggtggtgttgcgaaaacacaacctcatttttcatggcccactatgactccttcacatcaacacgatgccccaattgcaacacctaatgccccatttgctccgcaatggaatgtacccgaagcaatacctgatatgggcgacttattaggtgttgatttgcgtcaggagttttctgctgaggctgagcaagcagaagcggggagacaacacggcagaagaaatcctgatcgtcaagcgcgaagatgggatcgaccatgtggcacatcctcacgacatcacggacaccataatgactga

SEQ ID NO: 37107 - DNA, 654 bp, Glycine max
  Peptide Sequence Number=SeqID_128792
atgaattcggttataacagtgttgtatttcaatggaagggtctatgaagataatgatgatgtaatatttgaaggtagtaaaaaagcgattcagattaaacatggaattagtttcaatgctttgaagaaaaaaattggagataagaaaaatatattgccttgcaaatttgtgatgacgaagacgttgaaacgatgctggaaagttttaaacaacaagaccaaatgtcagttctggaattgtacatataaaaggatgtggctggtggttcaatgtttcattctgcaaattcgcttacatcatgtggaaattatttatctaatgctgagacaaccaccaacaaatatgagcaatttacatattgacaaagatgatgatgatgatgattatgttgtgtctaactcatacgttgaagagtctttagacgaagatgacagtgttgacggtatatctgatacagacgatgatgtcaccgacatgattcaaccagtgcacaacgaattgaaaatccattttggaatgatgctttacattataacaatatcaactggagttatcctgatgaggaggacatttgtggtttggagatgccatcgacctttaatgttggccaagaattatatgttggcatggaatttgatagtaaagatgcggtaa

SEQ ID NO: 37108 - DNA, 204 bp, Glycine max
  Peptide Sequence Number=SeqID_128793
atggggagaattccgcttgctgggaacaatgaacttctggcagattgggcagcagaatatgtaaggtgggggaaatccttaagacatgttgtggatccaaggcagaagtctttgcaggaagaagagattgaggaatggtctgaagtgataagaaactgtgtacaaccagatccggagagaaggcaagcatcaccactttggtga

SEQ ID NO: 37109 - DNA, 816 bp, Glycine max
  Peptide Sequence Number=SeqID_128794
atggcccaagccctccgcgtcggagagcacctctgccgcgtgataggcagcgacgactgctcccttgactggcaggtgcagttctatgtgtccccctcatgcccgcacttgatcgacactccgcgagctcagacaatatttcttgaagaagatgatcatcggtgtgaagcaagaatcgcaagttcgagaacaggatttcgaaaactttcagtgagggtgaacctcggttgtggagtacccgtggtttttttgagatggaaagatgaaaagagattgaaacccaaattaggtgaccttgtcatcctaccttttctgggtccaaatcatgatttaccgataggggcaagaacggaaaaggtggctaagtttataaggaacttagtgggcacttatgccaaatgggatggtggaggtgagatttgttttggcagaaggatgtgcatcaaagtgtctatagatgtgaggaaacctccgaggaaggaccatgtcataagggagtgcgatgaacataacagagaagaaacgatagagggagatgagggtaaggcctatgggacctggttacaatcttcaagttctaataagacgatgattacaaggattaaaaaggaaaggaacttgggtagaaaaggggtcaacgagaatccagtgagtattgatgaagtagatacatcttcacaaactaaacaccagatgctattctcaaaatccccatgtgcatcttccttgactgcgactgagtctcgtgatcccatttgtccatgttgtggagaggaggaagaaactgttggacatctctttttggaggagcaatga

SEQ ID NO: 37110 - DNA, 300 bp, Glycine max
  Peptide Sequence Number=SeqID_128795
atgaataataatctagatttcaacctctcctttaggtacaacaaaagcttcaaccttagtcaaatggaatcctcctctcctcctatgcaagacatcaagatccatactgacagaagctccttcagaaatcctgggttcatggaattatgcggttttactactaacatggaaacaaggttgtttggcatcttcaatggtcttaaggttgcaaaggctgctggatttcacattgttaattgtgagtcaaattctcaaattacgttaaagatgatcttccaaggtgtagctctccagaattaa

SEQ ID NO: 37111 - DNA, 1302 bp, Glycine max
  Peptide Sequence Number=SeqID_128796
atgacaagagttctcgatctcaccaaattatcagactggtgcacaattgaaagttctgccagagaattcatgggtaaaagcagctcaaccaccttagctgctagtgtgaattttgttgatttggcagggagtgagcgtgcatctcaagcattatcagctgagtccagattgaaagaaggctgtcatataaatcggagtttactcactcttggaacagttattcgtaaacttaggttgtccccttctttcttagcctatggtgtctaccttctttattcagcttctaatattgttagcaaacctacatctggattgtttaattcaactccttccttaggtggcaattctagaacatccatcatttgcactttgagccctgcgcggagccatgttgagcaaactagaaacactcttctttttgcttgttgtgcaaaacaagtgactactaaagcacaggttaatgtagtgatgtctgataaggtattggtcaagcagctgcaaaaagaggtagccagattagagagtgagttgagaactccttgtcctccttccaccaattgtgattgtgcagcaatgttgagaaagaaaaatctccagatacaaaagatggagagggagattagggagcttattgagcaacgtcatcttgctcaatctcagattgaggatttgatgtgcatggttggaaatggtcagaaatctagaaaagaagatgatgattcaatatcagagtcatcaagcacttatccttttgatttacgcattagagaattcaacaatcctcactacaacaatgaaaatagtgaaagtagtcctgatagtaagttttttcttttcttccctttgccagtaaacacccgatgctgcaaagaaattcaaagtgttgaattggaggaatcaagtagagatgaccttgaatatgctgatccatcagtaagtaacaacggggtgttggcattaacattgtatggagaggaaaatgtaataagccaggagataccgacccctgtgaatgaagatagggaagagaaacagaaccaattaacatatggtgtgttggagcagagactcgatgattcacaattgagtaatgattctcctatgactatgtcagagacagtgccaaattgtaggaatcttaaattactaaggagctggagttgtagggaatattacacaagtagttctcctgagaaagcgggagtaatggagaggactccagccagtagttttgaaaaatgcttccctggaagattatgtctttcctcttgtgacttatattatcctaagaaagctgcctag

SEQ ID NO: 37112 - DNA, 441 bp, Glycine max
  Peptide Sequence Number=SeqID_128797
atgagtcatcattcatctagtgttaatggcgagggtactagtcataaggaccctctatctagaatcttagatgagttgagttccctcaagttatgcaaagaaaaaatagaaagaaaaggaaaaggaaaaggaaaagagaggacctcacttccagaggagaaaaaaaaggaaagaaagcctcaagaggctaacattaacctctcatacttccatgggaaggacaatgtagaggcttacttagattgggaaataagggtagagcaacaacttaaaaggaagtttacttcaaaatcttatggctctcactcttatccaaagaaagaccaaggccaaggcatcttaggggcgacaccttctaagcccaaagatgataagggaaagacaatagaaaagcaaccccccaaggctagtatgcaagagaagactaactctataaagtga

SEQ ID NO: 37113 - DNA, 645 bp, Glycine max
  Peptide Sequence Number=SeqID_128798
atggtaccaagcatcagattttgggttcatgcagagggctcatacttttgcacaacaagacgaggtgtacacaaacggttatccaatttgaaatttgattcaacagagtattattttctatatggttttgggtatgacccatccacagatgactacttaatagttcttgttggatttttggatgaattcgatgaagagccttatggtgtgcctaatgtccacattttctccttcaaaaccaattcgtgggaagaagatagtgtccgtgttccaaatgagattttccacggtaaattcagatcagggtctctcttgaatgagactcttcattgtgtttgctgctcagtcatcatagactgtgcgaagactgaaatatgggtgatgaaagaatataaagtgcagtcgtcctggactaggatcattgatatccctgcttatggcatttccctgatatgcaccaccaaagatggtggaatgtatgtatcacaaaaccgtccattacggaaaattaatcgcaacggagagccgcctgagtgcctcgcattcgatggagatagaggattgttctgtgccaatctaccatctgggatgattgtgcaaacattggaccctggagaattgtgccgtggccttgttggtatatga

SEQ ID NO: 37114 - DNA, 186 bp, Glycine max
  Peptide Sequence Number=SeqID_128799
atgggcacttgcagccgacaaggacagtgtgtagacactgtttgtgaaaaatacgacattagtaatgagaaatgggcccagttttgtcagacccgtagagaccccttgtgggaggatgtgtggaaaaaggcacaggccatccagaagcaaaacaccgccccacgtgttgtctcatgggggttatga

SEQ ID NO: 37115 - DNA, 180 bp, Glycine max
  Peptide Sequence Number=SeqID_128800
atggcaccatctcaagcgccccctccattgcaccttcagagccctctccgacaacgcgttaaggggaggaggatggagggtggcagaggagaaggaggaggaaaaggtggaggcttcgaagtagcagcgcgaaaaaccgttctagaaattgcgccgctctgccccgcgccgccgcgatag

SEQ ID NO: 37116 - DNA, 642 bp, Glycine max
  Peptide Sequence Number=SeqID_128801
atgttgttatcaaacaacattgagagaccaaatcatgtatggtctaaaacatgggaatgcctaattgatggtatccttcatcagcagagaaggataagaaacatacctaatttgcagctagaaataaaagagttacagactttggcattgcttgagattaaagatatattacaatgcaacaaaaaatcattgaaggattatccagccatgccttttgcaagacatgtgaggcactggtggaatgtttttcctgtatgggtatggaggtactgggaagacctttatgtggaagacattagcttctgcattacgttcaaaagctacactgatcctattgaagcaattataaaccatacttgcccagatatccagaagaagtataaagataaggaatttctcaaatccaaagttatacttgctgcaacaaatgaggttgtagaccaaatcaatgaccatatcttaaacattatcccaagtgaagaaaaggagtatttcagtcatgactcaattgacaagacaaatgttgcaacaactgaatcttttgaagcaattacaccagagtttctgcattcattgaagacctcaggaataccaaatcataaaattaggatgaaagcaggcacacctgttatgttgatttga

SEQ ID NO: 37117 - DNA, 699 bp, Glycine max
  Peptide Sequence Number=SeqID_128802
gaacgtcctgagctgaagctatcttcccatggaaggaagatggctaagttcgggaggcctgctacagagattgaaggccttgtggctaccaatggactaagtcctttgattgcatgttccctagatatgggcgatcggggactaattagtttccatttgcccgttggagaggtgactatcaccttggatgacgtcgcgtcattactacatgtgcctattgtaggagtgttccacaacttcgagcaacttcatgtcaacgacgttgttgacatgttggtagaattactcaaggtcagtgttgcagaggcgagagctgagacgattcagtgtcatggctcttatgttcgactatcatggctacgagacgtgtatcatatgaagatcgaggcatgtcacaggattgtagcagtgcaagcgtatttgttgcatctttttggatgcacactctttgctaaaaagagtgtcacacacatgcaagtggtattcttggatgcactacgtgacttgacgcagagtgggacttacgcttgggccgctgctgcaatctacgagcatttcaagtccgttggttcagccctagctactgaggattatgatgagaggagaccgtgtgcgtgcagatggacctttggcaaggcactgcccgtgtccacgtatcgcaggcgtctagacagactgacccttgacgtagtgtgctga

SEQ ID NO: 37118 - DNA, 579 bp, Glycine max
  Peptide Sequence Number=SeqID_128803
atggatagattcgctctcactctaaatgggagtcaagagcttccaaggttgttagccagagccaaggcaatggcggatgtatactcagctcccgaggaagccgacatgaaggctatgaaggaccaaatgacctccatgatggaggccatgttgagtatgagaaggatgatggaggacaatgaggccgctgttgcctccaccagtgctgccatcgaggcggatccgatccacccatccggcataaaccaaacaagccatccagccccagacatggtaggtcagggaagagaagtgttgggcagtatgggcggtccccatatggtgcaaaataagaattctttcccatcgtacgactttccacctaactatacaccacccaatgcggtgcatgtgcccaatgagaatgcctaccactctgttctcgttctccttgaaggtcagcaaccccagttggggcatgcacccttcgctcaacctgtgggggaagcccgtgaggagccccgggatcacactttgggtgagttcgaaccataccctacatatgccgctgagggaccagcatttagtggcatgccttag

SEQ ID NO: 37119 - DNA, 246 bp, Glycine max
  Peptide Sequence Number=SeqID_128804
atgtttttgccagccggtaacaggcgcaaaataaaaccgccatggcctggaggggacggccatggcggtcatattggaggacaaaggcccggagagggggaaaggcctttgtccggtctgacgcggcgggggacgagccagctatcagactacggcgtgatcaggcgccgtcctctaagaaatgtgtctgcaaatgcggcttttcaagggaaagatggattacaaatcggtaacgttcgggtgtaa

SEQ ID NO: 37120 - DNA, 102 bp, Glycine max
  Peptide Sequence Number=SeqID_128805
atgggtggacaggcacgttgcagttttactaattctgttgctatccatgtggtgggttatcatttactactgctaattggcgttgctgtggaagcgctttga

SEQ ID NO: 37121 - DNA, 135 bp, Glycine max
  Peptide Sequence Number=SeqID_128806
atggatgaatttggcatccttgactctctcatcctttcgcaagcacatcattgcttattcaacttccaccgggaatggacaacccttcccttgtgttcaagaatcccctacaacaacagacctacgatctcttaa

SEQ ID NO: 37122 - DNA, 210 bp, Glycine max
  Peptide Sequence Number=SeqID_128807
aggtgtcatcctcctggagaggatcttgaagaggacctagaggagttacctcctgaacctgctatggacgcccttgacttacctaaggatgatgaagacccattccctaatgttgattctccagaggatgttatgtcagtatctgaggcagactctacagaggagagtggccctggagggacaacgattagtgacgactcttcatcgtag

SEQ ID NO: 37123 - DNA, 391 bp, Glycine max
  Peptide Sequence Number=SeqID_128808
gtcgactctagaggatcccactgttcccgggggaacaaaaggtgcagaagacgatcgtgactcaaaagtcagtatggcagatcttgtaagtgcggaagatgatgtaaatctccgcgtgtcaatgggcttgttggccgcgattgacgaagggcgtagaatgaccataatttgtctctgcgtgccatcggacatgactgtgtctgaatggccaaagggggcgcagaatgaccataacttgtctctgcgtgccatcggacacattgtgtctgaatggcaaaaagggtgcggaatgaccataatttgtctccgcatgtcacatgcctcaggcagtatgacagagattgtgggcgccgacaaaagcaaggctcttgctcctacgtatcctcaatga

SEQ ID NO: 37124 - DNA, 189 bp, Glycine max
  Peptide Sequence Number=SeqID_128809
gtccccagtggagtcgccaactgtcgcaacatgcccttttgcgggcgagcgaaggcgaggctcacgggtgcgctttccaaaggaggaaagatgcgcggagtcaccaccaacgtcgacaaaagcggggctcttgctcctacgtaccctccatcgaagaggaaatcagacctacgtagttctttcttaaag

SEQ ID NO: 37125 - DNA, 351 bp, Glycine max
  Peptide Sequence Number=SeqID_128810
atgggggtacaaatagaaattttcaaattttcaaatttgggccttttcagaacattttggaagctgggcttcttaaggaggaagcagcccagctcgggcaagctgggcggcaacctcctccccccttttcctataaataagcgaagggaggctgttccaaatatctctaacccccttggctacgcatttcagctgttttgggtgaaaaaatttgtttccatgaatggagctggtgacaatggtggtgtatatcatcaactggatggatctcagctcttattactagacgcgatgactacacaaatgcaacatttgttgaaccgtaacaaagaagagctctacagcgaatag

SEQ ID NO: 37126 - DNA, 143 bp, Glycine max
  Peptide Sequence Number=SeqID_128811
caaggagcagaatcgtctcaggccatggtcagaagtcaagacaagtcaatggcagaaatcaaccaaggatagggtcacgaccgaccaatcgtcaccccttcccggctctgggccagcggagaacgtcgctgcaaggcagccca

SEQ ID NO: 37127 - DNA, 285 bp, Glycine max
  Peptide Sequence Number=SeqID_128812
atgaggctaaatcttgaagtgctaaaagtggtagttgcgctcagctcaccatttgggctcagcgcgcatccattgctaagcgtagcttcattgagcttagctcatcagtgggctaagcgcgcatccatcgctaagcacagctacagtgcaacagaagaatctggcagggcatcaatatcaaggccatgcactaagcacgagatcaatgcactaagtgcaatagttgtcttcagccaggctcagcgcacgactggcgctaagctcaaatccacttactcgcactaa

SEQ ID NO: 37128 - DNA, 222 bp, Glycine max
  Peptide Sequence Number=SeqID_128813
atgtacatcagtatggcccaaaaatacatcatgaagcatagccaacaaaacatgttatccaacaaaaccccccacacttattcccaaaacaattccaaagctccaaaattccttaaggttaaggaagcatcaacaagaatcaagccaaggctatggtgcaagcaatcaatggggcaaaacacaccaaatgattatgaggatggatggctcaattctcacaag

SEQ ID NO: 37129 - DNA, 375 bp, Glycine max
  Peptide Sequence Number=SeqID_128814
atgacagatcttgtgagcgcggaagatgatgtaaatctccgcgtgtcaaagggcttgtcggacgcgattgacgaaggtcgcagaagacgaaatcttgtgagcgcggaagatgacgtaaatctccgcgtgtcaacgggattgtcggacgcgattgacgaagggcagaagacgacattagtctcatgcgtgctatcaggcttttcgtcttacagacagcaaaaagtttatacggataaccactcgggtatttccgcccgtcagcgtgactcaaaagtcagtatgacagatcttgtgagcgcggaagatgacgtaaatctccgcgtgtcaacgggcttgtcggacgcgattgacgaagggcggagaagacgacattag

SEQ ID NO: 37130 - DNA, 355 bp, Glycine max
  Peptide Sequence Number=SeqID_128815
gtcgactctagaggatcccacccatcatagtcacccaacgcatcatcaagaagcttccaatagggacaaacttcaggctcacaaattgcaagtccacccccgcaaagcctccaccctacactctcacagatctggttgtcgatgtagaggcatccatcggaggaagaggcagtggtgcacagtgtcagggttgagccaacagaggaggtggaagggccgacttgatgaggaggaagtcatcgtcggagtcctagatttggagggagagagaaagaggggaaggcgaaccacttgtcatcgaggttgtcatggaggtgagaggaggagggacaagggcaataaggcttcggagtag

SEQ ID NO: 37131 - DNA, 324 bp, Glycine max
  Peptide Sequence Number=SeqID_128816
atgattggcgagcggggtcataccactttgggaaaggaggttggtagatctttcccaggagatatcacaaccatctggttggtgatgagggacgacaagaggtcttcgtacgtcattggggatcggggtgaattctggaattggcctcgggggaaaagttccttgtcgcgttggaaccggcgaccaaagtgggcattgccggctgggcaagtcgtggttggagccggagcttggggggcctccctctggatgggggcgggagctctaggctgtacgggtgctgaattggaagagttcccgacgcgagctgagaagctcgggtga

SEQ ID NO: 37132 - DNA, 240 bp, Glycine max
  Peptide Sequence Number=SeqID_128817
atgaaccctaagagaataaaggtcattcctgagtggcccactccaccaagtgttgagggaaggagcccagagtatgaagaacctcgggatttgaggtcaaatcctttccaatgtggaactgatgcaatcctacccgcaagggcattggatacaagactccaagtagattgggccagagatccaagagaaggccctagggttctcatgagccttagggtagatttcgggctcatgggctaa

SEQ ID NO: 37133 - DNA, 279 bp, Glycine max
  Peptide Sequence Number=SeqID_128818
atggcctttgtggataactgggcggtgggtaaggaggaggtttgttattggctgagtaatgacattgttggtcgtcctagtaggatgatcaaatttgcctcttttcggacccacatcgatcctttcactggcaaagaccaaatccggaaagctttgaggttgcatcctatcccgaaccatatcaaaattgtactgatactgcctaacaaaggcaccattagtccttcccagaatggactcgggaagttccaagttagtgtaccagtaacagctacccca

SEQ ID NO: 37134 - DNA, 480 bp, Glycine max
  Peptide Sequence Number=SeqID_128819
atgtttgcacattcgattaaaggctgccgtcccttgggacggacgtatgggatgacatctaagaaaaggaaggctccttctacaccttcccaagttagatttgatcggtcttggttcacatctcaagaagcttgggtgaggtatactgatattgtggtgcctaggaaactactaccagagaggaatgcggtagtttattacacagagttcgatgagttcaaggaggaactcaagagaagacactgggatgaggatgagctcacccctcttgagcccttttattttgatgcaaatgtacacatggctcaagaggaagagacttccacatatcagatacctgagccattgcctaaacctattcctgaggagacccagccatttgcaccagtcatggagctagagcagcctatccaggattcatcagcagctctagcactggatcttaatgaagatcagccacaggatgagcaggatgtttaa

SEQ ID NO: 37135 - DNA, 486 bp, Glycine max
  Peptide Sequence Number=SeqID_128820
atggacaggttcaatcgaattgtcgtccaaattaggaatctcaatcctaaggtggctttacaccccatgctattggccttgcgacttgacaagtccgctgatagtttgtgcaagaaatcccctagcaacatgaatgagctacgcgagcgagccaaaaggaccgacacacacaagtcggacaagcggcacaaaccagataaacatcagcccattccaataagaccaaagtatgaacgttacacacctttaataacaaatcaagccaccattcttgaagaagtcttcaatgtagagatacccatacagctgccccctataccccctcctagaccagggctggacaaaaccaaaaactataggtaccatcacaattatggccacaatactgaagactgttgggccctcaaagacaaaatggagaagcttatacaagtcgggcgcaagcatcaacctcagcaagagcaagagggccaacccgctcggtag

SEQ ID NO: 37136 - DNA, 357 bp, Glycine max
  Peptide Sequence Number=SeqID_128821
gtcgactctagaggatcccacctgtttgaggggacacatgtcccagacattgtctcgacatcagggaaagctgctgcttcaggtgctgtgtccaaggatgccttgattgctgaactcaaggacacatgcaaggtgctggaagcaaccattaaagccaacacagagaagaagatggagctagaacggctgatcaaaaggctctcagaaagtggcattgatgatggtgaagcagctgaggaagaagaagcagctgagcaagaagaagaagaagctgaggaagaagaagaagaagccgatgaggaagatgcagcagaggatacagaatccgatgatgatgattctgaagccaccccatga

SEQ ID NO: 37137 - DNA, 342 bp, Glycine max
  Peptide Sequence Number=SeqID_128822
atggtggcccgggtgatgttggggaatggctacgagcccggaatgggtataggcaagaacaacagtggcagaactagcctggtaagcaccagaggaaactgcgggaagtttggattaggctataaacccatgcaagcgaacataaggaaaagtgttgcggaaaggaagagcagaggccaaagttcgcaattgggacgacaagtcaaaggggccctgccctgccacatcagtagaacctttataagtgcgggtctaagacacgagggccaagtcctcgcaagatgcgaggatgaccccccgaggggatcggttttggtacgaccatgtcctcctggcttctga

SEQ ID NO: 37138 - DNA, 402 bp, Glycine max
  Peptide Sequence Number=SeqID_128823
atgaagcaattcctccacaaggaaacagaagaagatctcgtgaccactcccaagaacgtattgacccaatggcttcgtgtggaagcaatgtcttccaaggttattttgatgatgccaaagaatcaagagttaagcaaagtttcaagcaaagattcaagaatcaggtttcaagtttcaagattcaagaaaaatcaagatcaagattcaagactcaagattcaagaatcaagagaagactcaatcaagggggtacatctacttggggattgttatactgagaacaagagagggtacatctcttgtggatcagttcaagtggagggtacatccacttgggttttcaaagagaacaagggaagggacatcccttgtggatctttggcttgtaaaggattttacaag

SEQ ID NO: 37139 - DNA, 256 bp, Glycine max
  Peptide Sequence Number=SeqID_128824
tgggagtcttctcagtttagaggaggcagtgggagcaatggcattagaagaggggaagatagaggatttatctatatcagcgccaaagaagctgtatcagcccttatcagtcttagatagtcctgttgattcatggatcatggactcagatggaaaagtctacttgacattgtcggaagaggtgatatcaacatcaagacctccagtggatccctatggacatctgcacaatgtcaacgacatattcctgccttaa

SEQ ID NO: 37140 - DNA, 213 bp, Glycine max
  Peptide Sequence Number=SeqID_128825
atgagagcaggtttagcatatgacaccggaatttggggtgaattctacaggctttttgctgcaaaattcccttttggttgtgatgcaagctccattggagcttgtaggcctaggatcttcttcatcaatggattcctttgcttcttggaagatgaatggcagcggaatggagaaggaagagagagaggagacgccacttcaaggagaagatga

SEQ ID NO: 37141 - DNA, 963 bp, Glycine max
  Peptide Sequence Number=SeqID_128826
gaattaaattgtcatcatcaaaaaggggaagactgtagaagcaaagactttgactttgatgttttgaagatgccatatgatcatgatgttttgatgccttatgaaaatgcgcttctcaagtttaattcaagacaaaaatccaagaatacaagatacaacatcaagaacatctctagtgatttagaaagagaattccaaattgaaacagcaaaaggtttggccaagaaatttaaactaaaatgtctttttcaagagatttactctctggtattaagagaccgagggtctcttgttgtaaagaaatttgaacacaaaggaagggttgtccttgtgtggttcaaaacttgtaaagagatttttcaagatagtgaaactctcaagcggggtgcttggggactggacgtaggcacaagggaaggcataggtcacatcttagacctcactcccataggagagaaaatgaaaaaaaaccaaggtcttgacatcttaggggcagcaccttctaagcccaaagatgataagggaaagataatagaaaagcaaccccctaaggctagtatgcaagaaaagactagctctataaagtgctttaaatgtcttggaaaaggacacattacttctcaatgccccaccaagaaaatcatgattatgaggagccaagacatttatagtagccaagatgaggctactacttcacattcctctagtgaaagtgaagtagcaaaaggggaagaatctagtgaagaaatctacccccaagaagaaggacaatctttaatgtttaaggaagagtgtaaggaggtaagtgtctcctccaagagcttagctaagaagaaaaggcattttgaaataaagaaaaatactaaaaaggtttcccctcttagacaacctccacattttctcctttgtaaaaagacacttgttagcattgccacacctcttgggcttgagtttattcctcaa

SEQ ID NO: 37142 - DNA, 510 bp, Glycine max
  Peptide Sequence Number=SeqID_128827
atgatacgcggagataccttacggttatccgcacccttttgtcatccagaggcggcgggcccgatgacaagcagagacaaaatttggtcattctgcacccttgtatcatccagaggcggcgggcccgatgatacgcggagataccttacggttatccgcacccttttgtcatccagaggcggtgggcccgatgatacgcggagataccttacggttatctgcacccttgtatcatccagaggcggcgggcccgatgatacgcggagataccttacggcagcgggcccgatgacaagcagagacaaaatttggtcattctgcacccttgtgtcatccagaggcggcgggcccgatgatacgcggagataccttacggttatccgcactcttgtgtcatccagaggcggcgggcccgatgatacgcggaaatacccgagtggttatccgtataaacattcttttgctatctgtaagacagaacgctttgatagcatgcagaggctgacatag

SEQ ID NO: 37143 - DNA, 165 bp, Glycine max
  Peptide Sequence Number=SeqID_128828
atgaagaaaagtggaaaaccttcgcgaaatcgcccacggaaacgtctcggaagcgggaaaaagagggtggtggttgtcgcccagctcgcccaggcgagctgggttgcttccaccagaaggcatcgccttctgttggaagatcctggaaggcccaagtgggcctga

SEQ ID NO: 37144 - DNA, 345 bp, Glycine max
  Peptide Sequence Number=SeqID_128829
atggatggcgaagagctaccttcgcctgtgaattctgatgtcgtcaagcgatactatgctttagaatctggggcaattaaggatgtcactgcatgttctttatctttacgtgttttctggatttcccccagggattccccgtctactatatctctcgttacaatctttcaaagaaatgaacgtggattcgaggctttagtcctcacgttggggcaggatcatcttgagctaccttctggggtggggataaaacatgaacagcgaaaaccaaccaaggtactagggaacggatgcaaatggggatggggtcacgaccgactgatcgtcgccccttctctgcgctaa

SEQ ID NO: 37145 - DNA, 168 bp, Glycine max
  Peptide Sequence Number=SeqID_128830
atgggtgaccaagaggaaaaaatggcgtccatgatggatgccatgctaggaatgagacaactaatggaaagtaatgcggccaccgccaccgctgttagttcggctgccgaagcaaacccaacactcccaactaccgcgcaccaccctatcccgaacgtggtgggatga

SEQ ID NO: 37146 - DNA, 303 bp, Glycine max
  Peptide Sequence Number=SeqID_128831
atgcagaatctgaaaaatgtgagtgccatcaccttgaggtctagcaaccaaattccagtgcctccaccagtagcagcacctgcacctgaacctgtcaagcttcattctacacctgaaaaagaggatgagatagttgcacaaaagagaaagcttcctaacaaaaattttcatcaacctcctatcgctcttccattcccacctagagcaattccaaacaaaaagatggaagaagcggaaaaggagatcttggagaccttcagaaaagtagaggtgaacatacctctgctagatgccatcaagtag

SEQ ID NO: 37147 - DNA, 822 bp, Glycine max
  Peptide Sequence Number=SeqID_128832
taccaaggaagtgtttggaggaaagggcaaaagccttggaaaatcaaggcaaatgggctttcttttattgatatattggaacttttgatctttggagttgtcctctttccgaatatggaagggttagtggacctagcagtgattgacgctttcctcgcctttcatcatggcgaggaaagcccgatcgtcgccattttggccatgtatgacacgcccgtctatccgctacaaggtcaccgctcgtgcgtcgaaaaaggaaaggcgaattgggaccaactcttggctagcatggatgggcgtctgggttgtattaattataatcccgtcctcgccataagacaacttggctaccccatgagaggagtgccatcagacaaaagcatcacgcctttcatcgcacggggtttcagtgaccacaacgcgagggtactccaaggagttcgcaaggcatgggatgcggcctatcataagtggctgagagtccgaacacaaggactggattggctcccaaatctaaagactgtgagagacgatgaggttaaagcttcggaagaaagtgatgaggtacaagccctaaaggcagagcttgaaagagcctgggtagtcgaagagaagttcaatgcagcaatagtgagctcaagctccgaagaggtgaaaggaatcatcacgggtcaaaggcatgatcttgaaggacgagctaaagggaatatgtgggccatcatcgataagtgcaaagagaagctaaatctagcggcgactcacgagcaaaggctagaggatgagtacgccaagatatcagcagaaagggaagcaagggaaagg

SEQ ID NO: 37148 - DNA, 365 bp, Glycine max
  Peptide Sequence Number=SeqID_128833
atggacacattagctcaattaaaatccgaacttgatagtgagtatcaaaccaccagaaaattttttgacctctatcccgatgacaaaaatgagtatgctcctcacgaaaaaagcatgaaaatgaaatcgcttgccaaccatcttgctgatgtttttgagtggcccaacaccatgctgaaaacatctgaactggattttggaaccgcacaacatccaaccacgtctgctacgaaagaagatttattaaaaaaactggatgagaactataaatcgggtatcgacgcattggaaaatgcaaaagaagatgacctgaattctacctgggctttaaaacataatgggcatgaattggcaaaatggaccaa

SEQ ID NO: 37149 - DNA, 176 bp, Glycine max
  Peptide Sequence Number=SeqID_128834
gatcaatgacatcttcgtcgttatgcttatcaagtatacaaactaggtctggtccaattgatggtgacgtgttgtggatgcaacccaagcatgtttcagaacatgtttggaatggggaaccagacagaaaactacacatcaaacgagcagtcccgacgtatcaaggtgaagaataa

SEQ ID NO: 37150 - DNA, 674 bp, Glycine max
  Peptide Sequence Number=SeqID_128835
atggcctcctatggtgaagcaaaggaatccattgatgaagaagatcctaggcctacaagctccaatggagcttgcatcaaccacgaatggctgaaagttcgcatacgaggtttagattggctcgccaagttaaaagtcgtcagcgaagagaattttgaagcaccggaagaggacgaggaagtccaagctctcaaaagcgagttaggaaaggcaaaactcgccaaggagaagttcaagttggctgctacacacgttcggaaggagtgcgccgggttacgggaagagaatgcaattaccgcaagagcccttgaacaagagaccaagagggctcgcaaggaagagtatggccggaacaaatttcacggagctctatggggtagcaataatgaactcaagttgcgaagggaagaaagggaccagtcgcgagcacatagcatggttctgaaagaggaattgattgcttgttcaaggtccaaaagaagcttgtctcagcgtctatgcgagacagaaaccaacatgctagctatcatcgccaagtaccaagaagagttgggtctagccacggcccacgagcatagaatcgcggatgagtatgcccaagtatatgcggaaaaagaggctagaggaagggtgatcgactctttacaccaagaggcaaccatgtggatggatcg

SEQ ID NO: 37151 - DNA, 102 bp, Glycine max
  Peptide Sequence Number=SeqID_128836
atgaggttaattgacagatactggaaggacttcttgaactactacagaataaagaatgtgctcactggaaagctaagtatgtatctggctggatctaaatga

SEQ ID NO: 37152 - DNA, 330 bp, Glycine max
  Peptide Sequence Number=SeqID_128837
atgtgcacatcataccaactggataaggctcctctaaagtatgtttgtcatcaaagcaagcaatggttcctatatcaatatccttttgggttgagtaggtggctaccttaccctctggttgacttggttcctataaattctactggtttgatcagatataggtggtgccaccccttttttggtaaaattatcgtccatgtcatgaatatgataatatacagctcatgctgcagatgtgaaagattggagatactggaaggacttcttgaactactacagaataaagaatgtgctcactggaaagctaagtatgtatctggctggatctaa

SEQ ID NO: 37153 - DNA, 126 bp, Glycine max
  Peptide Sequence Number=SeqID_128838
atgcatctacgtgatcaaggtacctacaaggaaaatccaacagaggatttagctttccataccaggaagccttctttacaacaaagagaagaacaagatgaaagattgcaaaaatacaagtggtga

SEQ ID NO: 37154 - DNA, 621 bp, Glycine max
  Peptide Sequence Number=SeqID_128839
atgacattgaccatcccagagcttttcttgaggccttaccaggttacatgggatgccactgtgtttggggtctttaatccagacttcccgctctacataaagcatgaagacctctccaaaatcgcacacgatggtcaatgtctcagcatatcagtgttacagttgtggattctgaatctgattgaaacaagtatgcgagcggggaattctgatatctatggattcctcgagccacagtccattcagaggtctgggcaagtgcagtttgagactggaagttacataaagagttggatgcgttcaaaaagcaatgtctatcttggagcctacctgaatggtggacactggcatatggtggtcattgtgcccaaggaacacctagttgtcggattttgttcattgcataacaggccagacaactaccttaagggaataattaacagcctaaatcaaaggctcttgctaggtggattgtcgtcaagacaaaaaggaagtacggagtgcggctattatgtcatgcactggatgtccaccatcattttaggaagtttcaggaataactgggaagcgtattttaacgatgctagaccattggagccagagagattaaaggcactgtga

SEQ ID NO: 37155 - DNA, 312 bp, Glycine max
  Peptide Sequence Number=SeqID_128840
atggtgaataggcgtgttctagggtcccaaacgagttcaaaatcggtgacagagacaatgagtggttcccacgagtttgtgatcaagggttactcactaacgaagggaatgggcattgggaaatacatcgcgagtgagactttcatagtgggagggttccaatgggccatatactttttccctgatggtagggacccgaaagataatgccgcttatgtctctgtctttgttacactccattccgagagcaccaacgttcgtgtgttgttcgatctcacgttgctcgacctatgcaagaaaggagagcacaag

SEQ ID NO: 37156 - DNA, 350 bp, Glycine max
  Peptide Sequence Number=SeqID_128841
atggctgagaagacaaagaaaaaactagaggaagttgttcaatccagaagcactgaggtcgttattgaccctccatctcccatcagacgacacgattctttggagaagcaagcgtcacagggttcctttgtcccccatggacgtcaggatatcctgactgctgccattgggcgaccagaacaccctggccgtgtgcgtgctgctggagctgatgcagtcccaatttttagtcacaaatacaatcacagggacttgcactgcctccgaagccctgaggttggtccttcagctgctcgtgtcagcacaaaggagaattgtgttgatccttcagggaacgatcccagacacgg

SEQ ID NO: 37157 - DNA, 756 bp, Glycine max
  Peptide Sequence Number=SeqID_128842
atgacgcatcaaatgaagttaactacatgggcagtcataatcatcaaggattccatcaaagaggaccaccaggattctatcatagcgataattttttgcaagaccacaattgaagatattatccaaaatcctatccagggtccgagtcatcaagagaagccgcctatcagtataaaggaaatgctattaagcttcatccaagaaacaagggcaaacactcaagagacaaaagcattcatccaggagacgagatcacatcaaaagagcacagatgcaaccatcagaaacctggagatacaaataggccaactagctgagtcaattgctgaaaagccgactgaaacctttgcggtaaatgctgagatgaagcccaaaaaggattgcaaggtaattttcactgagagagaagaggaagaaaagaaaacagaggaagatgtgtgtgatgaggaaggagaaaagaagaaagaaacaaaaagaaatgaggagaaagcacaacaatgggagaagtactcacaagtagaaattcagcaagaaagtattctccaagtcaatacccctcctcatcaactgattgtcaaggaagaaaggcatggaaaacatgagaaagccttaagtgtcattctttccttgatcgctaccacttctcttgcaataatgtggaaggtgcttccagaatacacgagtttcatggcgtctctaactaagaggcgaaaatgcaaggaagatgtgttctacgtgaccttcatgccaccttga

SEQ ID NO: 37158 - DNA, 420 bp, Glycine max
  Peptide Sequence Number=SeqID_128843
atgttgagtcagcatcccaatatgttaaactacactgactctgtgataaagagagaatctcctctatccctgcattacaaactgtttgaggggacacatgtcccagacattgtctcgacatcagggaaagctgctgcttcaggtgctgtgtccaaggatgctctgattgctgaactcaaggacacatgcaaggtgctggaagcaaccatcaaagccaacacagagaagaagatggagctagaacggctgatcacaaggctctcagaaagtggcattgatgatgaagaagcagctgaagaagaggaagaggcagctgaggaagacaaagaagcagctgaagaagaagaagaagctgctgaggaagaggaagatgcagcagaagagacagaatcagatgatgattctgaagccaccccatga

SEQ ID NO: 37159 - DNA, 596 bp, Glycine max
  Peptide Sequence Number=SeqID_128844
gcctggttggataccagcctaatttggtttcaagacaatttggcctctcgcaaatccgtcctaaaagcttgttcgaagatcctcgagatgttataagaggagccaatctttcagaaaaaactttcaagaagtttttgaagatttctctagatgaaaactataacctgcatccttttgagttcaaccattcccacttctgcaccatagggtttgttacctggtgggagaaatattattcgggccgttcagttggagacactactatcatgatctccagacttgagagtggttttacacaaccaacggtcgagaatatccgctcaaaccttcaagctcgaggcaaaacaatcatgacaaagaaaattgctgaaacgtctcgagctgatgtgagacccaagaaacccactggggtgaagatccaagaatggaaacaagaagaaaagagtcaaaagaaagatgatagcactgatactaccacgacctcaaaacgctcgaagcgtgtggtcatcgaattagacgaagagaaagatgcaatctatattctgacatttctttaccatcataacacagggaagaagaggaaagacctctcataa

SEQ ID NO: 37160 - DNA, 318 bp, Glycine max
  Peptide Sequence Number=SeqID_128845
atgacttcccggcttatgggacgttgtcaggttggacaactgttggcagacttggttgtcccatatgtatggaacgatcaaaggcattcacaacttaaaatttttacaagagagaaatgtgtttattttaacattgtgatggacatcaatggaaaaagtaaggatagacacaatgctcgaatagatttagaagaaatatgtaattggaaggagcttgagctagtagatgttggtcatggcaagttctctaaaccaaaggcagcttatgcaatgaccaaatccgagagactcgttgttcttaatgggttaaagaactaa

SEQ ID NO: 37161 - DNA, 171 bp, Glycine max
  Peptide Sequence Number=SeqID_128846
atgggtggtggtgcatggccgttcttagttggtggagcgatttgtctggttaattccgttaacgaacgagacctcagcctgctaaatagctatgtggaggaattcctagtaagcgcgagtcatcagctcgcgttgactacgtccctgccctttgtacgtgggatcctctag

SEQ ID NO: 37162 - DNA, 246 bp, Glycine max
  Peptide Sequence Number=SeqID_128847
atgagtttcttccttaagaatggacgctactgtcctattgtcgcaacctacccttcggcgggagggcgacgcgtgactcgcgggatgcgtgttccaccaaaggaatacacgcggagtcgccaccaacgtttatttgaggaaaacgtcggaaaaaccggaaaagacgtgatctacgaacttttaagtgaaaggttcgagagttgtatttacgcacggggaagggtgtttccctttgctcctacgtag

SEQ ID NO: 37163 - DNA, 678 bp, Glycine max
  Peptide Sequence Number=SeqID_128848
atgtttacgcacatgcgcattgccagacccgtcacccagcttgaacgatcgatgctgatgtttagtcagggactggatctgcaaaaaattgccgaattccacgatcacgacggtttcaatggcgtgatgctggggcgaaaagacctcgactggcacctcgaattcacctgctgcccgggacatcccgttataccctcgccaaccgaagacgatctcctcgtcctctattatccggatgaaaatgcatggaagctggcatgcgaaaccatgatcgaagcggggcgtggggataacggagaaagcctcgtgcaatggttcagtcaggaaaaatttgcggttcgtcttgagtggggcctgcctgcggtagagcatcttgccggggaggtcgactgcgttgtcattgttgacgttatgtcgttctcaacttgcgtcagtatggctgtcaataatggtgcctgtgtctatccgtacccctggaaagatgcttctgctattgaatatggtttgaaaatgggagccagcacagcgagtccggacagacgattcagcggtgaaggttacagcctatcgccggcttcgctaagaaacatcagcgagggtgaaaaactggtcctcccatcgcctaacggttcagccgtttcatcccccaccaagggatgcaggaatagcagtttttag

SEQ ID NO: 37164 - DNA, 621 bp, Glycine max
  Peptide Sequence Number=SeqID_128849
atgaatgtgcttcttgccatgaaagcgggagatctcaattttggttttcacccggaatacctgccaaagcagcgcctcggtcaggatatcctgcggcgtgccggttgcgataatttgaccgttctgcatcacgatcagcgaatcacagaacatcgatgcgtggttgagatcgtgaatggcgacaatgctgatggttggtcggttcgtccagcagaatttcgctcggcgtttgcgccagtgcgcgggcaatgtgcacacgctgacgttcgccaccggagagactcagccatccctgctcacttttctccagcatgtccacgcgctgcagagcggccgtcacggtctcgtcatcgtgcgcgctccagttggaaaacggggaatgatgcggaatgcgccccagtttcaccacatcgcgcacacgcatgttggcgtcagtcatgccgtgctgctcgacgaatgccacccggcggccaagctgtttgcgggcgatgcgggcgatattttgcccgtccagcgtcacacagccggcatccgggcgccgcagccggcaaggatgcgcaggagggaagatttaccacagccgtttggaccaatcagccctaccgtttcaccacgggaaat

SEQ ID NO: 37165 - DNA, 1014 bp, Glycine max
  Peptide Sequence Number=SeqID_128850
atgggcttcgtgccgtgggcaacctcgagcatcatggtgatgttcgtgctgctgtttctgtgtggctggttccagggcatgggctggccaccgtgtggacgcaccatggtgcactggtggtcgcagaaagagcgcggcggcattgtgtcggtatggaactgcgcgcacaacgtgggtggcggcattcctccgctgctgttcctgctcggcatggcgtggtttaacgactggaaagccgcgctctatatgccggcgtttggtgccatcctcgtcgccatcatcgcttttgcgctgatgcgcgatacgccgcagtcgtgcgggctgccgccgattgaggcatggaagaatgactatccgccggattacagcgagaaccacgaacaggagctgacggcgaagcagattttcatgcagtacgtgctgccgaataagctgctgtggtacatcgcgctggccaacgtgttcgtttatctgctgcgctacggcatcctcgactggtcaccaacctatctgaaagaggtgaagcacttcacgctggataaatcctcgtgggcctatttcctgtacgaatacgccgggattccgggcacgctgctgtgcggctggatgtctgacaaggtattccgcggcaatcgcggcgccaccggggtgtttttcatgacgctggtgaccatcgccaccatcatttactggctgaacccgccgggcaatccgggcatagatatgatctgcatgatcgtcattggcttcctgatctacggtccggtgatgctgattggtctgcacgcgctggagctggcaccgaaaaaagcggccggcactgcggcaggctttaccggtctgttcggctatctcggcggatcggtggcggccagtgcgattgtcggttacaccgtggatttcttcggctgggacggcggtttcttagtgatgattgtcggatcggtgctggcggtggtgttactgctgctgaccatggtcagcgagcatcgccacaagcagcagcaggcataa

SEQ ID NO: 37166 - DNA, 933 bp, Glycine max
  Peptide Sequence Number=SeqID_128851
atgatcgaactcaaacacctgcggacgctgcaggcgttacggcacaccggctcgctggctgccgccgccgcccagcttcatcagacgcaatcggcgttgtctcaccagttcagcgacctggaacagcggctgggcttccggctgttcgtgcgtaagagccagccgctccgtttcacgccgcagggagagattctgttacagctggcggagcagattctgccgcagatccagcaggcgctgcaggcctgtcatgagccgcatcagaccacgttgcgcatcgctatcgaatgccacagctgcatccagtggctgacgccggccctgaacaatttccgtcagagctggccgcaggtagtgatggacttcaaatccggcgtgacctttgatccgcaaccggcgctgcagcagggcgaactggacgtggtgctgacgtccgatattctgccgcgcagcggtttgttctatgcgccgatgtttgattttgaggtgcggctggtgctggcgccggatcaccgtctggcgcaactggctcacatcacgccggaagatttggccgatgaggtgctgatgatctatccggtacagcgtcagcggctggacgtgtggcgtaactttttacagccagccggcgtcagcccggcgctgaagagcgtggataatacgctgctgctgatccagatggtgtcggccggcatgggcattgccgcgctgccgcactgggtggtagagagctttgagcaccaggggctggtggtgacacgcacgctgggcgacggattgtggagccgtttatacgcggcgatgcgcgacggcgagcagcggcagccggtgctggaggcctttgtgcgctttgcccgtcagcacgcctgcgagcacctgccttacgtgcgcgatgcctcgcgccccggctccctgcagccggtctcgtcctga

SEQ ID NO: 37167 - DNA, 801 bp, Glycine max
  Peptide Sequence Number=SeqID_128852
atggtggagtacttcggcgaaaacctcgacggctttgttttcacgcagaacggctgggtacagagctacggctcgcgctgtgttaagccgccggtaatcattggtgacgtcagccgtccgcagccaattaccgtcgagtgggcaaagtatgcgcagtcgctgaccgacaaaccggtgaagggcatgctgaccggaccggtcaccatcctgtgctggtcgttcccgcgggaagacgtgacgcgcgaaaccatcgctaaacagattgcgctggcgctgcgcgacgaagtgcaggacctggaaaaagccggtatcggcatcattcagattgacgaaccggcgctgcgtgaaggcttgccgctgcatcagtctgactgggcagcctacctgcgctgggcggtggacgcgttccgcctcaacgccgcggtggcgcaggacgagacgcagattcacacccacatgtgttattgcgagttcaacgacatcatggattcgatcgccgcgctggacgccgacgtgatcactatcgaaacctcacgttctgatatggatctgctggatgcgtttaaagcgtttgaatatcccaatgaaatcgggccgggcgtgtatgacatccactctcccaacgtaccgagcgtggagtggatggaagatctgctgcgcaaagcggcgcagagtattccgcagcagcgcctgtgggtgaacccggactgtggcctgaaaacgcgcggctggagtgaaacgcgtcaggcgctggccaacatggtgaaagcggcgcagaagctgcgcgccgaaaccgtttga

SEQ ID NO: 37168 - DNA, 1002 bp, Glycine max
  Peptide Sequence Number=SeqID_128853
atggccgcgtcagattatcctctggcgcgccagtgctgcgaagaagtgctgcgcgtcatgcctaaccagatgcaggtgctcagcgactacgcgctgacgctgatgcgcgtcggcgaacataaaaaatcctacaagatttaccagaaaatctatcaggcaccggcggcgcagcgcgcgcaggcgtcggaaacctggctggatggcctgacggaagtgtgtggctggctggataagacagatgaagtggcgcgttatggcctcgaatcgctcacccaatccgacatgcgtttcagtcagggcgcgaaagcgacttttcccgcaccggcgcctgcgccgattaaccgcagcaatccggcagaaaatatcatctccttcagcctgtacggcggccagccgcgctactgtgaaaccctgattaaaaacgttgaggtggcgcgcgagctctatccggactggatgtgccgcatctatctcgacgatagcgtaccgcagcacgtgtggcagcgcctgacccagccaaacacccagctggtggatatgtcgcaggagaaaaccattttccctacgctgtggcgttttctggtgatggacgatgccagcgtaaaacgctacatcgtgcgggatgcggattcgctgctgtcagagcgcgaagtggcggccgtcgatgcctggctggcttcgccattctggttccaccacatgcgcgattattactcgcacaccgagctgttactggccggcatgtggggcggctgtcacggcgttatgacggcagcgagcgctttaccgaccagtacttcctcaaggtggcgctgtggcccacggtacgcgacagcatcctcaatcacgacgatatctttcacttccaccacgcgcagccgtggccggcgcatgcgccgattcgctggcagaccgacagcttccacgtcggcagcaacgccggtttcgccagcatggccggcaaagtgccaacgccgaaaatgccagcagcagtggagctga

SEQ ID NO: 37169 - DNA, 2772 bp, Glycine max
  Peptide Sequence Number=SeqID_128854
atgacttttacccctctcatcaccggcggtcttgagaccgccctgaaccgtgtgttgtaccgcgatcgcagcctgaaaaccgcacgccagcgtctggccggcaaagtcctgctgctgcgcctgcaggagctggattttccgctggtgctggtgttcagtgaaaaccagctggatgtgctgagtgactggcaggaccgcagcgactgcagcgtcagcctgcgtttcagcacgctgcctaagctgcgcgatcgtcagcagctgaccagcctgattcgcagcggtgagctggacgtggaaggcgatctgcaggtggtacagcaattctccgcgctgatggatctggctgaacttgacccggctgaatatctcgcgccgtgggtgggcgacatcgcggcacagggcatcagccaggccgctcagcgtgcgctggcccagctcaaacagcaggtcacccgccgtcaggattatctggggcaggtgctgaccgaagagtggcgcgtggcaccgggggcgctggagcaggcgtggttttgtgaggaggtagaagcgatggaacgcgcgtttggcacagctggaggcgaaatgacgctgggagaaattcggcgcttatacttcattatcaaagtttttctgacctacgggctggatgaactgattccgcatatgcgcattacgctgccgctgcggctgtggcggcgctgtgttttctggatccccaaccggcacaaagaagccgagatgggcatccgtctgcgtctggccatggagcagctcggtccggtttggatcaagttcggtcagatgctctcgacgcgccgcgacctgttcccgccgaaaattgccgatgagctggcgattctgcaggaccgtgtggcgccgttcgacggcgtgaaagccaaagcgcagattgagcgttcgattggcggcccggtggaaacctggttcgacgacttcgatatcaaaccgctggcatccgcttcgatcgcccaggtgcataccgcgacgctgaaatccaacggccgcgaagtggtgatcaaagtgattcgcccggatatcctgccggtgatcaaagctgacatgaagctgatttaccgcctggcgcgctgggtgccacggctgctgccggacggtcgccgtctgcgtccgatggaagtggtgcgcgactacgaaaaaacgctgattgatgaactcaatctgctgcgtgaagccgccaatgcgattcagctgcgccgcaactttgaccagagccgcatgctgtacgtgccggaagtgttctccgactactgcagcgaaaccatgctggtaatggagcgcatttacggcattcctatctccgacgttgccacgctggagcagcacggcgtcaacatgaagctgctggccgaacgcggcgtacaggtgttcttcacccaggtgttccgcgacagctttttccacgccgatatgcatcccggcaacatcttcgtcagctatgagcatccggaagatccgcagtacatcggcattgactgcggcatcgttggctcgctgaacaaagaagataagcgctacctggcggaaaacttcatcgccttcttcaaccgcgactaccgcaaagtggccgagctgcacgtcgactcgggttgggtaccgccggataccaacgtggaagattttgagttcgcgatccgcaccgtgtgcgagccgattttcgaaaagccgctggcggaaatctcctttggtcacgtgctgctcaatctgttcaacaccgcgcgccgtttcaatatggaagtgcagccgcagctggtgctgctgcagaaaaccctgctgtacatcgagggcatcggtcgccagctctatccgcagctcgatctgtggaaaaccgccaagccgttcctggaggactggattaaggatcagatcggcattccggccatcctgcgggcggtgaaagagaaggcgccgttctgggcggagaaactgccggagctgccggagcttttttacgacagtatgcgccagcacaagttattgcagcacagtgtcgataaactcgtcaccgatttgaacgcgcagcgcacccgtcatcatcaggcacgttatctgtttggcgtcggggctacactgttattaagtggcaccgcagtgctgctgagccggcctgactgggacttcttcccggcgctgcttaagtccggtatttggcaattgttaatcattgccgtcattgttgtacttctgttcggtaccaataagcttcgtaacctgggttcggatttaggctcttccattcgcggcttcaaaaaagccatgagcgatgaagacgagaaaaaggatcaaccgaaagagcaggacgctgacttcaacgccaaactggcagacaaacagcacaccccggcgagcaaagacgacgcccgggacaatgaactggtattggtgttcgtgatcgggctgattgtactgggcccgcagcgcttaccggttgcggtgaaaaccgttgttggctggatccgggccattcgctcgctggctgctaatgtgcagaacgaactggcccaggagctgaaactgcaggagctgcaggacagcctgaaaaaggtcgaagaggcaggacgcggcacgctgtcgccggagctgaagcaatccatggaagagctgcgtaaaaccgcggactccatgaagcgctcggtgcagcagagcatcgatatcgaaaaagcggaagatgaagccaacaccattcatcagccgcccgctgctgcgccacagcccgctgcccgcaccgcagcccgctga

SEQ ID NO: 37170 - DNA, 762 bp, Glycine max
  Peptide Sequence Number=SeqID_128855
atggccgttgaagatacccaaccgctcatcagccacctgattgagctgcgcaagcgtctgctgaactgcatcatcgcggtgtttgttatcttcctgtgtctggtttacttcgccaacgacatttatcacgcggtggcagcgccgctgattagccagatgcccgccggcgccagcatgatcgccactgacgtggcctcaccgttctttacgccgatcaaactgaccatcattgtgtcggtgtttcttgcggtgccggtgattctttatcaggtctgggcgtttgtcgcccccgcgctgtatcgccatgagcgccgcctggtgatgccgctgctgttctccagtacgctgctgttttatgtcggcgtggcctttgcctacttcattgtattcccgctggcatttggcttcttcgccaaaaccgcgccgcagggcgtcaccatcgccacggacatcactaactacctcgactttgtcatgacgctgttcatggcgtttggcgtggcgtttgaggtaccgattgccatcgtgctgctgtgctggaccggcattaccagcccggacgatctgaaaaagaaacggccgtatattctggtcggcgcgttcgtggttgggatgttgctcacaccgccggacgttttctcgcaaactttgctcgctattccgatgtactgcctgtttgaagtcggcgtattcttctcccgctactatgtgggtaaaggacgtcaggcggcagacgatgaggaacagaaccccgacgcctga

SEQ ID NO: 37171 - DNA, 606 bp, Glycine max
  Peptide Sequence Number=SeqID_128856
atgcccgccggtgccagcatgatcgccacggacgtggcctcaccgttctttacgccgatcaaactgaccatcattgtgtcggtgtttcttgcggtgccggtgattctttatcaggtctgggcgtttgtcgcccccgcgctgtatcgccatgagcgccgcctggtgatgccgctgctgttctccagtacgctgctgttttacgtcggcgtggcctttgcctacttcattgtgttcccgctggcatttggcttcttcgccaaaaccgcgccgcagggcgtcaccatcgccacggacatcactaactacctcgactttgtcatgacgctgttcatggcgtttggcgtggcgtttgaggtaccgattgccatcgtgctgctgtgctggaccggcattaccagcccggacgatctgaaaaagaaacggccgtatattctggtcggcgcgtttgtggttgggatgttgctcacaccgccggacgttttctcgcaaactttgctcgctattccgatgtactgcctgtttgaagtcggcgtattcttctcccgctactatgtgggtaaaggacgtcaggcggcagacgatgaggaacagaaccccgacgcctga

SEQ ID NO: 37172 - DNA, 1587 bp, Glycine max
  Peptide Sequence Number=SeqID_128857
atgctgcaggatgccatagcccagggcagctggcaggcgcgtcgtgcgccgaagctggcaccgcttaagctcagcccgattgaagctgcgatgagttttaccctcgccaaaagcatggtgcagcaaaccgccggtaaacactatccggctccgatcgccgcggtgcgaaccatcgaagcggcagcgggcttaggtcgtgatgatgcgctgaagctggaaaccgcggcctttgtgccgctggcgcagagtgatgtagcacgtgcgctggtcggcatcttcctcaatgaccagtacgtaaaaggcctggcgaagaaacacagcagcgcggccggcacgccagagcaggcggcggtactgggcgcaggcatcatgggcggcgggatcgcatggcagtcggcctggaaaggcgtgccggtgaagatgaaagacattaatccgcaggcgctgacgctgggcatgaatgaagccagcaagctgcttaacaagcagctggagcgcggcaaaattgacggtaccaggctggcgagcgtgctggcgagcattcagccgacgctggattacagcggctttgatcgcgccgatgtggtggtcgaagcggtggtcgagaacccgcaaatcaaagccaaagtgctggctgaaaccgagcagcagctgcgggatgatgccgtgctggcctcgaatacctccaccattccaatcagccagctggcgcaggcactgcagcgtccgcaaaatttctgcggcatgcacttcttcaatccggtgccgcgtatgccgctggtcgaagtgattcgcggtgcgcaaacctctgaagccaccatcagtaaagtggtggcgtgggccagcaagatgggcaaaacgccgattgtggtgaatgactgccccggcttctttgtgaaccgcgtactgttcccctactttgccgccttcagcctgctactgcgcgacggcgcggatttccgccagatcgataaagtgatggagaagcagtttggctggccgatggggccggcgtggctgctggacgtggtgggcattgataccgcgcatcatgcgcaacaggtgatggcgcagggcttcccgtcgcggatgcagaaagattaccgcgatgccattgatgtgctgtttgaagccaaacgctacggccagaaaaatggccagggcttttaccgctgggaacaggacaaaaaaggcaaagcgcagaagcgtgccgatgtggaggtcgatgcgctgctggagccggtatgtgaaccgaagcgggtattcagcgatgaagagatcgccaaccgcatgatgctgccgatgctcaacgaagtggtgcgctgcctcgaagaaaacatcatcgcttcccccgccgaggcggatatggcgctggtgtatggcttaggcttcccgccgttccgcggtggcgcgttccgctatatggacacgctgggcatcagcaatgtcgtcgatcaggctaaacgctacctcgcgctcggcccgctgtacgcgctgcctgagctgctggttcagaaagcccaccagcatcagagctggtatcccgtcgctcaaccgattgacgcagcggcgctgcaaactgcctga

SEQ ID NO: 37173 - DNA, 261 bp, Glycine max
  Peptide Sequence Number=SeqID_128858
atgaggaagggaaaagttaacaaagaagcacaaataacttcatcaggaaaacatttttttttcatagtggaaggaaattgtagtgcttgtgatccagaagatctcttccatgcccagcataaagatccctgggagtgtaacgattgcccccccttgttcattggagaagtaattgtgatgggagagttggaaatatccttgaatgacctattagtgccaagcgcaattccttacggccataactggaggtcgatgaagtaa

SEQ ID NO: 37174 - DNA, 75 bp, Glycine max
  Peptide Sequence Number=SeqID_128859
atggaggtgggttttgttgtcgatttagggatggcctttgtggataaatgggcggtaggtaaggagaagggttga

SEQ ID NO: 37175 - DNA, 216 bp, Glycine max
  Peptide Sequence Number=SeqID_128860
atggactgcttctttcattcttcctcactacgaggttgtgaagacaagacaacaattggtacctcaaagccttacactggggcaatcaaaggtaccatgcaaaaacctcaagcaagcctagggccttacactggggcaatgaggggcatcgtgcatgagcctcaagtgaatataggggcagatcaaaactcctcacccgtcgatgtttttaaataa

SEQ ID NO: 37176 - DNA, 102 bp, Glycine max
  Peptide Sequence Number=SeqID_128861
gtgtcaagggaaagagcccagagtatgaagaaccatttgaggtcaaatcctttccaaggtggaggggatgatgcaatcctaccccctaagggtattggatag

SEQ ID NO: 37177 - DNA, 127 bp, Glycine max
  Peptide Sequence Number=SeqID_128862
atgggaagaattgcactaagcaatcactacgcttggctccaaacttcgaaaggtggaggaccacatgaaccgaaaacgcaattccatgtggggttctccaaaaagggtttgagaatggagaattgca

SEQ ID NO: 37178 - DNA, 212 bp, Glycine max
  Peptide Sequence Number=SeqID_128863
atgtctatgtcttctacctttttcatagctgtcgcaacctacccttcggcgggagggcgacgcgtgactcgcgggatgcgtgttccacgaaaggaatacgcgcggagtcgccaccaacgtttatttgagaaaaacgtcggaaaaaccggaaaagacgcgatctacgaacttttaagtgaaaggttcgggagttgtatttacgcacggggaag

SEQ ID NO: 37179 - DNA, 270 bp, Glycine max
  Peptide Sequence Number=SeqID_128864
atgttgtggaagcttggagggattgatggggacccggtgttgagaggaatcaggataagggctacgtgggactacgtgagctcagttgaaggtgggcaacttgggatggtggatttatgtgtgatttgtggatgtggagagtcgacttgcaccatcgcccgatcgccacctagtaccacatatgacggagtggtacttggagatatgtcgcgggggtcaggagaccttggggacgtcaggtggggtgctattgcccaaaaccaagcttga

SEQ ID NO: 37180 - DNA, 480 bp, Glycine max
  Peptide Sequence Number=SeqID_128865
atgagggcttctggtaatcgattaccaagggggtgtaatcgattaccaggcttagaaatgaagaggaatgggtcactggtaatcgattaccagatcgtgatggcggcgcagctaatccatgatcgagtagaagatggagtgcctagagggagcttgggagaccctcgaaggcaaccacgagatgaacctgcacggacgcttcagcgcactgtggagtggatactacccacgcctacaccatatcgtctagtggagcccgttcaagtgatcgaggtaacgtcatccgaggaagaccctgaggaggacctggaggagctacctcctgagcctgctgtggatgcccttgactttctagagggtgatgaggatccacttcttgaggtggattctcccgaggaagtcgtgtcggcatctgaggcagactctacggaggatagcggcccgagggagatggcgatcagcggaggctcttcatcctag

SEQ ID NO: 37181 - DNA, 234 bp, Glycine max
  Peptide Sequence Number=SeqID_128866
atggtagccataacccctgctagggttcctcaacctccatttctccaaggatacgactcgaacgcaacgtgtgcttgtcatggagaagccctggggcattccattgagcactgtatgacctcgaagcgtaaggatttccaagtttatgccattattgtaaaccacaattacaatgctaaaatggatgaatttgacatccctgtctctctcatcctttcacagacacatctttga

SEQ ID NO: 37182 - DNA, 189 bp, Glycine max
  Peptide Sequence Number=SeqID_128867
atgcgtttaccgaggaaggagagtctgctgatgaaatcccccataaccttaactgagattttggatgttagcatttcgtttctaaatgaacatttagaggaaacactgggtccgacaaaaatagaagaaaatcactcaaagtgtatcaatctcgcacagtgtggggcgaaaaagtcgctagcgcactga

SEQ ID NO: 37183 - DNA, 371 bp, Glycine max
  Peptide Sequence Number=SeqID_128868
ggatcgcacccacagagacacccagtggacctgaaaagtccaacagggccctggggtttccagctctagttacgggcctctatcaatcctacagggatcgcgcctgcaagacacccagtggacccgaagaagtccaacagggtcttggagttgccagctctaaatacgggtctctgtcagttctagggagtgcctgtggcccccagcaaggtcatcagggcgaaacaccacagcagcctggcgatggccagcagcgggcaacagacgcaccgccatcacctctagagttcacctctgctcatccacaaaaaggtttgagtattgcctacaccacatggccgaccaataggcgaccaagtccaaagccaaag

SEQ ID NO: 37184 - DNA, 252 bp, Glycine max
  Peptide Sequence Number=SeqID_128869
gaaagcccggccagaaccacacgtgcaagtttccctgcatgtggctcgtccgtgataacttattcggatttgcgcgaactagcggaccgatcactaagtgaggatgctccctccagcatgagcgaaccttttcgaaactggttaggaatgggcgtcactatcccagccctgatccagccagaagaggaaatcgcaatgcatcttgctcagctggcaaggcgtatcttggagtgggagtctagcgtgggtaag

SEQ ID NO: 37185 - DNA, 365 bp, Glycine max
  Peptide Sequence Number=SeqID_128870
ccagcgatagtagcatctctagcggttccctgagattcctccagttttttcctctaattgctccgatagagttgtcaaacgtcagggagacagagaagggattgaagcctccacttatattgtcttggtgcgattcctttttctctctccgtgaatattatcatgcaaatcccaacggtgaagaccattttgagtttctgcgggaaaggaaaagactacgatgcgaaaggtatttctctcatctcaaacattatatcaaaattcccaacggtgagaatgctcggaattgggttgcgaacatagtgctcaaattttacgatgatccaatggtgaatcgttccaagatcgtcttttttctgatacag

SEQ ID NO: 37186 - DNA, 201 bp, Glycine max
  Peptide Sequence Number=SeqID_128871
atggctctgggtgaaaaagggtgctcgacatgttggttcgatggtcttcaaacctttgttggtgaaaggtttgatacattggagttacaagtggacatgagctttaatgagatggagtcaagaatcaccaaggtcaaagaagatgtctcttatattcgttcaagctttgatctaccaccaccgccgtcaccatcgtcttag

SEQ ID NO: 37187 - DNA, 282 bp, Glycine max
  Peptide Sequence Number=SeqID_128872
atgaacggggctaagcgatctgccgaagctgtgggatgtaaaaaaagaatcggtaggggagcgttccgccttagagggaaggacccgcgcgagcagtgctggacgaagcggaagcgagaatgtcggcttgaggttcctccgcaaggctcctccacggagggtgagtcagggcctaagataaggccgaagggcgtagtcgatggacaacaggttagccgaaagatggttatcggttcaaggacgcaaggtgcccctgcttttttcaagggtaataaggggtag

SEQ ID NO: 37188 - DNA, 261 bp, Glycine max
  Peptide Sequence Number=SeqID_128873
atggtcattattgttaatgcggaagcttgtggttacgtgagcctgaactactaccaatatatagatgttgtttatacaaatgagcacatcgtaaaagcttattccgcacaatggtggcctcttgggaatgtagcggttattcctccttctaatgacgcatggacacttatccctgacccaactacaattcgtgcgaaaggtcggccaaaatcaacaaggataaggaatgagatggattgggtcgaaccatctgagcactga

SEQ ID NO: 37189 - DNA, 435 bp, Glycine max
  Peptide Sequence Number=SeqID_128874
atgttagaagacgactgtcggtatctgatggtaagtaagatacctacggtcggtatatctttgaaagctcagacggagataaacggactcctcgagggctacttaaggcactttagtgcaaaccaaccagaaggactggagctgttggatgtagctcagtgctgctataaattaacaaccaaaaagctctgcgtcgaacttcagccccttcgagttggccacggggcaacagcctctgacgccccacaccattgcggcaggaggaggcttgcccatcagcctactttttttgccaagacgtggcaggagcgcaacgacctagcccaaacctactttaaactaaaagcttggcccggtctgaaggaagaagaaagtagaccttgtagagagcggataggagaggtagcctatagactcagcgatcagctcggttaa

SEQ ID NO: 37190 - DNA, 632 bp, Glycine max
  Peptide Sequence Number=SeqID_128875
atggggacaaatcaaatcggaaaaagattctatcaagtcaagattaagggcctagatgtcaccagccttaaggagttgggacggttgatgggacccctccagaggcaagccttccgcaaggcgtacggaaaaattttagatttgactatagcggaggtattcacggaagccgttgtatccctcaccaaatactatgaccaggcattgagatgcttcacgtttggggacttccaaatagtaccaactgttgaagaatttgaggagattctaggatgtcctcttgggggaagaaaaccgtatcctttctctgggtttcttccctccttgagcaagattgaagctgtggtcggggatttggcgagagagttggatcgtataaagcaaactcgaaacggcgtagtgggcctatcgcgaaaatacttggaaggcaatgcaagggatatggcgaatcaagaggagtgggtcccgtttacggatgtactagctttgctaatctttggggttgtcctctttccaaacgtggatggtttggtggacctagccacaattgatgctttccttgcatatcaccatagcaaggagagcccggtgatagctatcttggcggacttatatgatacatttgaccgaag

SEQ ID NO: 37191 - DNA, 195 bp, Glycine max
  Peptide Sequence Number=SeqID_128876
atgtttctcttaaccagtgctttgaaggaatccaatgatcatcaaggaagtaaatccaaagcaactgctaaatggattctagttaaatattttattgatccaagaccattggaactagaaaaaataaaggcaattcgcatttggagggcgagatgcttgcgaagagttgaaaatgaagtactaagtagtgtttaa

SEQ ID NO: 37192 - DNA, 165 bp, Glycine max
  Peptide Sequence Number=SeqID_128877
atggcaatcacagtgaaactaatcatgcgtgctattattgaactagaaagggataagtatagaagaaactatgggagatggaaggaaaatggtgttggtgcacattgtcaacatttccaaagagacgattggtattggaaggttgaagcatccttcagagagtag

SEQ ID NO: 37193 - DNA, 346 bp, Glycine max
  Peptide Sequence Number=SeqID_128878
atggtcactgttcaacaccttgtgatggacaacaagaagaggaggcctattatcaatggaaccaagctagaccttaacaaaactttcaaggaagctaccaaggctatagaggtggctcaggtccttctaacaactcttgtcgaggtttttcaaatagaggatccacgacaacaacaagcccagccagatagaatgtcatatatggaagatactttaacacattttatgtggtggactggggttggtttgaaggataatgatgagaaaaagaataaagaaggagttgaaaaaaaaaacaagaaaaatgatgaagttgtgactagtgaaaaagtggaagaaaaaggtg

SEQ ID NO: 37194 - DNA, 237 bp, Glycine max
  Peptide Sequence Number=SeqID_128879
atgactgctttaccaatagttgaaactcaatcgggagatgtttcagcttatattcctactaatgtaaggaaatttcttgttgagttacgtgcttacttaaacacgaataaacctcaattcaaagaaatcatatcttctaccaagacattcactggggaagcagaagtccttttgaaggaagctattcaagaacagatggaactctttttactacaggaacaggtagaaaaaaattga

SEQ ID NO: 37195 - DNA, 297 bp, Glycine max
  Peptide Sequence Number=SeqID_128880
atggaaaaccatagatttataagcaagtctgattcagcaaaagccaggagcaacagaaagcatattagacaacaaaaggtccatcttaatgttcaggatagtgtccatgcaagtgtcaatccagtttcatcccatactgaagatgattataaccaaccaaagacaccaccgcatagtgtccatgcaactgtgaatcgggcttcacacgatgctgaagatcattttaatatatgcgattcatctaagaatgagagttctggatcaacagaaggtaggattacaaatctcctccattga

SEQ ID NO: 37196 - DNA, 262 bp, Glycine max
  Peptide Sequence Number=SeqID_128881
atggcatcttcgtcgtcatgctcatcaagtatacaaactaggtctggtccaattgatagtgacgtgttgtggatgcaacccaagcatgtttcagaacatgtttggaatggggaaccagacagaaaactacacatcagacgagcagtcccgacgtatcaaggtgaagaacaaataccagaggaaattgttcctttgcttcggcgatgtgggttttattggatcatgaggatgggatacctaaagataaatgcggccttaatta

SEQ ID NO: 37197 - DNA, 156 bp, Glycine max
  Peptide Sequence Number=SeqID_128882
atggggcaaaacacaccaaatgattatgatgatggatggctcaaattctcacaaagggcattgggtagaagactccaagtagattgggctagagatccaagggaaggccctaaggttctcatgagccttagggtagatttcgagcccatgggctaa

SEQ ID NO: 37198 - DNA, 129 bp, Glycine max
  Peptide Sequence Number=SeqID_128883
atgaattgcgttttcgttcatgtatcctccgccaatgagtttggagccatgcttcatgattgcctagtgggatcctcagagtcgacctgcaggcacaagagtttggagccatgcttcatgattgactag

SEQ ID NO: 37199 - DNA, 792 bp, Glycine max
  Peptide Sequence Number=SeqID_128884
atggcagacgccaccgatcccatcgaccgggcctcgcgatcaggcctgtggttgacggtggcgctggcgctgctggcggcgttgctcggctggttcaatggactggggcgcgtcgaccagatcctgtatgaccgcgccgtcgccttgacggggcgcgatatctcgcccgacatcgtaatcgtggcgatcgacgacagcagcatcgatgcgctggggcgctggccctggcgccgggcggtgcatgcggcgctgctggaccggctgcaaggcgcgcgcgcggtgggactggacctgatcttcgccgaacccgacaccacctaccccggcgacgacgtcatccttgccgacagtatccggcgcaatggccacacggtgctgccggtggtactggaccggctgatctatcccacgtcgatcagcgcccccatccccgccctggcccaggcggcagccggcagcggcttcatcaacgccaacctcgatgccgatggcgtgctgcgatcagcggtcctgactgcgcgtttcgccggccagcgctggcagcatttcgcgctgaccatgctggacgtgggcgggcaggcggacctggcgcaacgcctgctacggcgcgcccgcgcggacggcagcatcctgattccgtatgcgggcccggcggcgcatacccgcgccgtgtcgtatctatcagtcctgcgcggcgacgtgccagcggagcagctgcgcggcaaatacgtgctggtgggcgcttgggccaccggcctgggcgacgcgtacaccacgccggtatcccacgag

SEQ ID NO: 37200 - DNA, 809 bp, Glycine max
  Peptide Sequence Number=SeqID_128885
atggagctgcacgatcgccttggcattcgcttcccggtttatgtgctggtcaccaaaaccgacctgctcaaaggtttccgcagctacttcgctgcgctggataaaacccagcgcgagcaaatctggggctttaccttcccgtgggcgcaggcgtcgaccgcagagtttgagctcaacagccagtttcagcaggagtattcactgctgcagcagcgtctggatgccggcctggccgatacgctgctggcggagagcgatgcgcaggcgcgggcggagagctatctgttcccgcaggagttcgccgcgctgcgtccgctgctggcggatgcgctggatacgctgtttgcccgctctgatttcgaaacccagttcgcgccgcgcggtatctatttcgccagcggtactcaggaagggctgccgtttgaccgcgtgatgggcgagctgagccgcgccctgcatctgccgggacagcgcagcggcgaatccggcagttgggaccaggtcgacaaagagtcaccgatcccgccgaacaaaggccagagcttcttcctgaaaggcgtgctggaaaatgtcgtcttccaggagtcgggcctggcgggcagtaaccgctggtgggagctgcgcaatcgcgccggattgtggtccggctatctggcgctgctggtgctggtactgattgccggagcgctgtggctcaccagctacagcaaaaacaaagcttatttacaggagatggcgggtaaaacgccgcaggtggaacagctgggacacagctggagcgccagggcaatggcgatctgtttgcgctg

SEQ ID NO: 37201 - DNA, 153 bp, Glycine max
  Peptide Sequence Number=SeqID_128886
atggctggactttgtggacttgataaaaaaataaaggatcttgagatggacttgatggagtcggctatgaagtcagagaccttaatatgggtggactttgtggagtgtcctaaggttcaagatgaaaaaatggaggaccttgacatgacttga

SEQ ID NO: 37202 - DNA, 481 bp, Glycine max
  Peptide Sequence Number=SeqID_128887
atggtagagccatcgaagaagagaaagggatcatcctccaccgccgctgctgctgcccatcgccgccacggaccatccgaagcacccacaacacctattcatccctctctgtcatctccaagatcatccacattgttttcatccgatgatcagcgtctatgtcatcagatcgactgggcccacttggttcggtaccgaatgcataaggcattgcgggccaatgcacctctcccttacccacaattgataactttgtttctgcgtcattttcaaattccgcttgatgatgaaccatttgttcaagtcaagcgttcctttgcaattggtgctggtgcagtgacttcctttggataccgtaaagatcggaattgtcaatggctgaagaaagacgcactccctcctcaagatgagcgtactccttcacctcctcctcaacgagatgattcaacactcatgaatgaagtccttaccgaattacgag

SEQ ID NO: 37203 - DNA, 147 bp, Glycine max
  Peptide Sequence Number=SeqID_128888
gattgtcatcatcaaaaaggggagattgtggaagcaatgccttccaagattattttgatgatgccaaagaatcaagaggcaagcaagtttcaagaatcaagattcaagaataatcaagatcaagattcaagatcaagattcaagtaa

SEQ ID NO: 37204 - DNA, 126 bp, Glycine max
  Peptide Sequence Number=SeqID_128889
atgacggagaaagagattatcacaataatagtagacacattaccagtgttttactatgaaaaaatggtgggggatcacgcctataagatactcagtgggcccgaagaagtccaacagggtcctggg

SEQ ID NO: 37205 - DNA, 87 bp, Glycine max
  Peptide Sequence Number=SeqID_128890
atgcaaggaaaagaagatgaagatgtgaagaaggagaaggctcaagctacttcaaatacgaaatcatttgttgttggagatgtttaa

SEQ ID NO: 37206 - DNA, 567 bp, Glycine max
  Peptide Sequence Number=SeqID_128891
atgaatcatcattcatctagtgttaatggcgaggctactagtcataaagaccctttatctagaatcttagatgagttgagttccctcaagttgtggaaagaaaaacaagagagaaaagaaaaaggaaaaaaaagagtggaagaaatcagtcaagatgaaagaaagaaaataagagaggaagaaagaagaaaaataatgaaagaaatgaaaagagaaaaacatgcctcctatagtagtcataactcttgcaagagcctaagtgaaaaactttgtgactattatgaaggaaggcataggccacatcttagacctcactcccatagaagagaaaaggaaagaaagcctcaagaggctaacattaaactctcatacttccatgggaaggacaatgtagaggctaacttagattgggaaataagagtagagcaacaacttaaaaagaagtctacttcaaaatcttatggctctcactcttattcaaagaaagaccaaggtcaaggcatcttaggggtgacaccttctaagcccaaagatgataaggggaagacaataggtgggatcctctag

SEQ ID NO: 37207 - DNA, 1083 bp, Glycine max
  Peptide Sequence Number=SeqID_128892
gtgaccgataacgctgcgttgagcaaagcgtttggtacgacggtgagtggcgatgcttatgccgtgatctggaccacaacgccgtggacgctgccagccaaccaggcggtgagcgtgaatgcagagcttgattatgacttgatccaaaccagcaaaggtttactgatccttgtacgtgacctggccgaaaaaaccttggccagatatgaagaagaaaatgcttcggtcatcgccagttgcaagggcgaagccttgcgcggtttattgttgcaacatccgttcgacgaccgtcaggtgccggtgatcacgggtgaccacgtgacgaccgatgccggtaccggtttggtgcacacggcagcggcgcacggtaacgatgactggctggtgatgcgagctaacttcccgaatgagaagccgcgcgtattgattggtggcgatggtaagttcttcactagtgagctggttgagttggcagatatccgcggcctgagccgtcaggatgccaataaaattatcctggctaagctgcaggaaaatggcgtgctgtttgcctctgcgcgtttaaaccacagcttcccgcattgctggcgccataaaacgccactcatgcaactggcgacgcaccagtggtttatcggcatgaattcggtcggtaaagatgctaaagctttacgcgatcttgcaaatatgtctgttgatgcgacccagttcttcccgagctgggggcgtgcacgtcttgaagcgatgatcaagaaccgcccggactggtgtgtctcacgtcaacgtaactggggcgtgccgatgccgttttttgtgcacaaagaaaccggtgagccgcatccgcaaaccatgcagttgctggaaactgtgtgcaaacaggtggaacagcagggcatcgaagcctggtttagcttggatggtgctgctttcttggcgcagcatgcgccagcgaatgctgagcagtacaaaaaagtcaccgatacgctggatgtctgggtcgactctggtgccacgcattacgccgtggtgcgttcagcacaacacccaaagcttgtccgctgccgcgaatgtgcgcgaagctga

SEQ ID NO: 37208 - DNA, 669 bp, Glycine max
  Peptide Sequence Number=SeqID_128893
atgggtgaagtagaggaggtgcaagagcagatgaaggccgacatggaggccatgaaagagcaaatggccacaatgatggaggccatgatgagcatgaagaagataatggaagccaatgcggttgcagttgccactaccagtgctgttgctatggtgaacccgacgcccccatctgaccttaaccaaatgaatcatccaaccttagatatgcatgccttcccaccatatggcttgtctcccaactatacaccacccaatgtggcgtacactcccaatgagagccaacaacctcaatctgatcatgcacatgtctttcaacccatgggggagacacatgaaattccccaccataatctagccgactttgagccttgccttggatatgccactgaagggcaagcagttggtggtatacccctgcaaaacactttggaggggcctcaatttcgcccccaaccacaacccttctatggaaaaatagtgggttacacatcttcaagctttacgaattttttcttcgccggtgaaaggatcaaagtgggtctggaaagaggcaaatctgatcatcctgctttgatgaatgtgaaaactagggcaaatgaagaggatgagaatgaggcagaaacccttgctatgactaccattcctacagggtcaaatctcccataa

SEQ ID NO: 37209 - DNA, 294 bp, Glycine max
  Peptide Sequence Number=SeqID_128894
atggattctaaaactctttacacaacactagcatcgcctatgtttgatggtgataattatcacatctgggcagcaagaatagaggctcatttggaggcaaatgatctttgggaagctgttgaggaagactatgaacagcatgaagccaatgcccaagttgttgagcaggaggaagaagattatatttttgctgcaacatgctattcgatgaggagtagttctgaatgttgtacgaaccacatgacatatgataagactctcttcaaggatttgaagccaactaatgtctcaaag

SEQ ID NO: 37210 - DNA, 288 bp, Glycine max
  Peptide Sequence Number=SeqID_128895
atgaaggctcacgggatttcttggttttccagccttaggtcaccttttctccatggttttgattccattttgcgctattattcatctccaacaggggatggccttaggcctagggtgtgttatgaaataatggggcatgccacattgcccccattcccttgctattcatgcctaaacatgcgcccaccaagtgctccgcaaaatgcctcaatgacatttgggcatggttttgcgaactttggattgtggggctgttttgtgtgtatagggacagcatgtagaggttaa

SEQ ID NO: 37211 - DNA, 132 bp, Glycine max
  Peptide Sequence Number=SeqID_128896
atggagcagaatcgtctcaggccacggtcagaagtcaagacaagtcaatggcagaaatcaaccaaggtacttagggatggaggcaaatggaggatagggtcatggccgaccgttgtcccttcccggcgctag

SEQ ID NO: 37212 - DNA, 280 bp, Glycine max
  Peptide Sequence Number=SeqID_128897
ggttttgatgatgccaaagtagaatcaaacaaggttgcttcaacaaacattcaaaggttaaacattgcttcaagattaattcaaggtcaagtaaacaagatcaagcagcaaaatataagggctcaaacaatctcattggttgatcaagctttttcctcaaaacacattgtttccaacatccaaggctctgagactggttgtctcttggattgtgagaattgtaatcaagagacgggttgtctcttggagaatcttgaacacaagggtgaaggatcccaag

SEQ ID NO: 37213 - DNA, 479 bp, Glycine max
  Peptide Sequence Number=SeqID_128898
atgatcgctcatgtgggtaaggctcgagctgccgtggaagaactgagaaagttccttttagctgattcattagaagaagtgaataggaaacttgacaagttctacatggttcttattttgagaaacttgcattcagactttgatcatgtgcatgatcaagtacttgctggagacaagattccatcgatggattccctcatcactaggcttcttcgcgtgcctcatttattgaaggatgagaatcctactgatggagtggagacgtcagccatggttgcgtctcgaggaagaggaagtagccgcaacaatagaggaggtcgcagtggaaggggtgaacgtcctcattgcacttattgcaagaggatgggtcacacccaagagaatttttattcgttgcatgggtttcccgacaaggtcgcacatgtctctcgttcagaggtgggatcctctagagtcgacctgcaggcatgcaagcttga

SEQ ID NO: 37214 - DNA, 162 bp, Glycine max
  Peptide Sequence Number=SeqID_128899
atggcctctggtaatcgattaccaagagagtgtaatcgattaccaggcttaaaaaacgagatcaggaagctaagagggcttctgaggaacaggccactggtaatcgattaccagttatgtgtaatcgattacacagtgcattttacaggtttcatgtcctga

SEQ ID NO: 37215 - DNA, 340 bp, Glycine max
  Peptide Sequence Number=SeqID_128900
cggtcgcgcccacaagacacctagtggacccaaagaagtccaacagggctctggggtttctagctctagttacgggcctctatcagtcctacagggtgcccgttccccccagcaagggatcgcgcccacaagacacccagtggacccggagaagtccaacagggtcctggggtttccagctctgattacgagcctctgtcagttttacggagtgcccatcacccccaacaaggtcattaggccccgcattaaccgggtttcatcaagaagtactgcgcccccaggcaggcgtagggcgagacaccacaacagcattgggatggccggtagcgggcaatag

SEQ ID NO: 37216 - DNA, 666 bp, Glycine max
  Peptide Sequence Number=SeqID_128901
atgctgcgcgcggcggtctatcagccgtggatccgcgtggacgccacgctgacgctgctcgatccgcgccagttagccgatacgcgcgtcacggagaatgaaaactttcgcgaccagctgatcgccgcagacatcatcatcgccaacaagagcgacaaatgggatgcggaagatcgccagcggctggcgagctggcagcagcagcatttgggcgaccgtcaactggtggaagccagctggggcaatattgatccggcgttgctgagtcagccggcattggcggatcgtgcggtacccgatgccgcgcatcatcatcattcgccacgcccgcaggggctggcggcgctgaaactggaaggcgaagcgcgctggcgtcgtgcgttaaatgaaggtcagggctatgcttcctgtggctggatttttgatggtgacacggtgttcgataccattccggctttagagtgggcgcggcttgcgccggtggatcgcgtgaaaggcgtgctgcgtaccgctgacggtctggtcagcattaaccgtcagggcgaagacctgttcatcgaaacgcgcccggtcacgccaccggatagccgtatcgaattgatccaccatcaggccgccgactggaacgccttgcagactgccctgttgaagattcgtttaaattag

SEQ ID NO: 37217 - DNA, 531 bp, Glycine max
  Peptide Sequence Number=SeqID_128902
atgactaggggcaatccaggtgatttacaaccctttgatcctgaaatagatagaacctttcatagattagttaggcatagtgtgcatcctggtcattctgtgcattttaagcattttgagcattatgttgctggtgattctgaatattctgattttgagcattccactactaattttcatactgagaacatggctcaacctccacctcgtgagaggactcttagggagatggctgcacctgatttcacttatgaaagcctgtgctttcaatatcctgatgagggtgttccatatgttctcaagactggaccaatacatttgctgcccaagtttcatggtcttgcaggtgaagatcctcataagcatcttaaggagttccatattgtttgttccaccatgaagccccctgatgtccaggaagatcatatctttctaaaggcttttccttattttcttaaggagttccatattgttcgttttctgcaatttcgttttcttcttcaaattgcaatttcgttttatgctgattaa

SEQ ID NO: 37218 - DNA, 324 bp, Glycine max
  Peptide Sequence Number=SeqID_128903
atgatggtggcccgggtgatgctggggaatggttacgaacctggaatgggtttaggaaggaacaacagcggcagaaccagcctgataagcgccagaggaaaccatgggaagtttgggttaggctataaacccacgcaagcggaaataaggaaaagtgttgcaggaaggaagagcggaagccaaggttcgcaattgggacgaaaagtcgaagaggtcccgccctgccacatcagtaggagctttataagcgcgggtctaggacacgaaggccaagtcattgtgatatgcgaggatgactctccgagtgggtcggatttggtatga

SEQ ID NO: 37219 - DNA, 318 bp, Glycine max
  Peptide Sequence Number=SeqID_128904
atgatacgcggagataccttatggttattcgcacccttttgtcatccagaggcggcgggcccgatgacaagcagagaccaagtttggtcattctgcacccttgtatcatccagaggcggcgggcccgatgatacgcggaaatacccgagtggttatccgtataaacattcttttgctatctcacccaggcccatttgggccctccagaagattcctccagaaggcggttgcttctggaggaagcaaccctgctcgcctgggcgagctgagctcgcctgggcgagctgggcggcaaccacctcccctattttgctataa

SEQ ID NO: 37220 - DNA, 349 bp, Glycine max
  Peptide Sequence Number=SeqID_128905
cgagaattcgctaagcgcaaccttcaatggctaagcgagaggaagaatccagaagaagatgagctatcaagttcactaagcgcaccgctccagaagctcagcatgcacgaaggttctagagagagaaaggtccaagttccagagagttctgagagattttgctgtgaaggagacatcctcaccacttgtgtttttgcagtctttcatcatgttcttctctttgttgtaaaggaggtttccagactatggaaagctaaatcctctgttggatcttcccttggaaactggtctgattctaaagtccttgatagtacagtactaagttgttgtgctatcacgaggaatcaag

SEQ ID NO: 37221 - DNA, 374 bp, Glycine max
  Peptide Sequence Number=SeqID_128906
atgggtgaagtagaagaggtgcaagagcagatgaagggtgacatagaggccttgaaagagcaaatggccacaatgattgaggccatgatgagcataaaagagataataaaggtcaatgcggttaaaatagccgctaccagcaccattgctgagacacatgaaatgccccaccacaatctagccgacttcgagccttgcctcggatatgccactgaagggcaagcagttagtgatatacccctgcaaaacactttggagggccctcagctcagggtcattgaagtatgtgaagattatgcctttgctaacctagaagagttgttggactttgacaagtacaagggaactacttgccctaagaaccatctaaagat

SEQ ID NO: 37222 - DNA, 709 bp, Glycine max
  Peptide Sequence Number=SeqID_128907
gggagcaccgacggaagaaagcatgtctcctttccttgtgagggatctcggcgcacaaaattccaagactatacaaggaatccataaggcatgggaaaccccgttaaggaaagatcaagagcttagaggcattcgtaatggcatcattggtgggtaccacgaatggctgaaagttcgcatacgaggtttagattggctcgccaagttaaaagtcgtcagcgaagagaattttgaagcaccggaagaggacgaagaagtccaagctctcaaaagcgagttaggaaaggcaaaactcgccaaggagaagttcaagttggctgccacacacgttcggaaggagtgtgccgggttacgggaagagaatgcaattaccgcaagagcccttgaacgagagaccaagagggctcgcaaggaagagtatggccggaacaaatttcgcggagctctatggggtagcaataatgaactcaagttgcgaagggaagaaagggaccagtcgcgagcacatagcatggttctgaaagaggagttgattgcttgttcaaagtccaaaagaagcttgtctcaacgtttatgcgagacagagaccaacatgttagctatcatcgccaagtaccaagaagagttaggtctagccacggcccacgagcatagatcgcggatgagtatgcccaagtatacgcggaaaaagaggctagaggaagggtga

SEQ ID NO: 37223 - DNA, 1080 bp, Glycine max
  Peptide Sequence Number=SeqID_128908
gcgcaggtcggcctcgatctgggggcgcagcccggggcgctggaccttgaccacgacttcgatgtcggcagcgctggccgcaggggtgctgtcgctgtcgcggccgtcctcctggtcttgccggtcatcccggtcatcccggacttcagccgcaggcagccgcgcgcggtacacctgggccatggaggccgaggccagcggcacgggatcgaaatgcgtgaacacctgctccacgggcaggcccagcgattgctcgatcaacggctgggccgtctcccagggcagcggggcggcgtggctgtgcagttgctgcagggcggccgtccattcgggcgcgagcaggtccgagcgcgtggccatgatctggcccagcttgacgaagctcggccccaggtgttcgagggccatgcgcaggcgctcggggcggctggcatccagcggatgctcgggatggggctggctgccgcgtggcgcgaagcgggccaggcccagcgtgtcgaccaggtcggccagcccgaagcgcagcagcacgccgacgatttcctgcagccgggcacggtcgcgcacggcgaccacggcggtttgcagcatgggcatctcctgtcggtggtggcaatgcggtccattgtgccgatgcgccagacgccattgcgcaggaatcgcccgtctccggggcggggctcaggccagccgctgcacctgtaccgcgcagtcgtagaagctgggcgcgcggcccaggtcggtcaggcgctggtgggtgagctcgttgacattggtgccgttgtcgccgtgcttgcgccaccagatgcccaggccgttgcccccgccacggcgcgcgcggccgttgagggtggcgtggcattcgtagctgccccggtcgttgaagacgcgcacccggtcgccctcggccacgccgcgcgtggcggcgtcgtcggggtgcagctccaccagcgggcggccttccatggtgcgcaggctcttgacgttgacgaagctgctgttgagaaagttgcgtgccggcggcgagatcatggccagcgggtagcgcgcatccgtttcggcggtttcgtagttgggcag

SEQ ID NO: 37224 - DNA, 497 bp, Glycine max
  Peptide Sequence Number=SeqID_128909
atgggtgaccaagaggagacacaggaacagatgaaagccgacatgtcggctttgaaagaacaaatggcttctatgatggaggccgtactaggaatgaggcaactcatggaaaagaacgtggcctccgctgccgctatcagttcggctgccgaagcagatccgactctcctagtcaccgcgcaccatcctcccccaaatacgctaggacgaggaaggaacacactagggcacaacaacaacccccatttgggatacaaccgagcggcttacccttatggattgccgcctaattacacgccgccagtcatgcaagatgatgcgggtcatatctcttctcccatccttgaaagggagcctcctcgacagcccgacgaggtccacgaagatcatcaagagtatgcccaaggggatgtcgagttctacccctcgattcccgtcgagggaccagcacccaacactttgcctcagcccaacctcactgcacagccgatgatctt

SEQ ID NO: 37225 - DNA, 734 bp, Glycine max
  Peptide Sequence Number=SeqID_128910
atggcgagtgacacacatgcaagagcatatcactttggtgagtctagtacatgccacccacaacaagtgacatgtgcgcacgagcaccctgacaagcctccacaccctactaagcctctagtgcgtgccacccacgtcccgctgattcacatcaccatgcctctagtacttgccactttgaaagaggcacgtatacaagagcacaacactcacgctgcacacaagacttgtcaaacccaagctccacccttgctgatcttcacaggtctacaaaatctaaggcccatccttggtaagcctcgacacagcttcgtaggctttacaaaacccaggacaaacacgtccctggtccaatgctcgacaaacccaaggtccacccttggtgaagccctttccattactaggttccatctccatgggaactcaaggcttatcaaaaacccaaggtatgcccttggtaatcacatctccaaaacccaaggttggcccttgataccaaaacccaaggtccgcccttggtacacatgcttgcaaaacccaaggtcaacccttggtacatacttctataaaacccaagatgctctcttggtccgctcacatgcagcagctatgactaccaccatcaaaggtctaagttccaccaagcaaactatcacaccactatttggcaagacctttaatcaacttgaagcccatactcactcctcacaaccatcaaaggagtactttggacg

SEQ ID NO: 37226 - DNA, 538 bp, Glycine max
  Peptide Sequence Number=SeqID_128911
atggggacaaatcaaactggcaaaaggttttatcaagtcaagattaagggcctagatatcaccagcatcaaggatttggggctgttgatgggacctctccaaatgcaagccttccgcaagacatgcttcacgtttggagacttccaattagtactgactgttgaagaatttgaggagattctaggatgtcctcttgggggaaggaaaccgtatgttttctccggctttcttccctccttgagcaaaattgcagctatggtcagggattcagtgagaggattggaccgctatcaagaagaactaagcctagccacagcccacgagcatagggtggcggacgagtatgcccaagtgtacgcggaaaaggaggctagaggaagggtgatcgactcgttacaccaagaggcaaccatgtggatggaccgatttgctcttaccttgaatgggagtcaagaacttccccgattgctagccaaggccaaagcaatggcggacacctactctgcccccaaggagatccacggacttctcgactatt

SEQ ID NO: 37227 - DNA, 557 bp, Glycine max
  Peptide Sequence Number=SeqID_128912
atgagtcgtcattcatctagtgttaatgatgagcgtactactcataaggatcctctatctagaatcttagatgagttgatttccttcaagttattgaaagaaaaactagaaagaaaagaaaaaggaaaagagatggtagaaatgaatcaagataagagagaacaaataagaaaggatgaaagaagaaaaataatgaaagaaatgaaaagagaaaaacatgcatcctatagtagtcatgactcttgcaagagtttaagtgaagaacttagcgactattatagagggagccatagttcacatactaaacatcattcccaaagaagagaaaaggatagaaggcctcaagaggttaacattagcctcccatatttccatggaaaagataatgttgaggcttacttagattgggaaatgaaggttgaacaactctttgctagccatcatattagtgaagagagaacattccattggctacccttagctttcaagggtatgccctctattggtggatattaccttgttatggaacgaaggattcatggcgatcctccagtaga

SEQ ID NO: 37228 - DNA, 84 bp, Glycine max
  Peptide Sequence Number=SeqID_128913
atgacttcattgatgaagaagatccaaggcctacaagctccacatggagctacatcatgtggttctatcattttccagccataa

SEQ ID NO: 37229 - DNA, 192 bp, Glycine max
  Peptide Sequence Number=SeqID_128914
atggcttacactcacattccggattcacaagcgattctcctcaaatttcagctagcccacatcaatttagactttgcaccttacgcttcagggtcatacaatgctcaatggaatgccccggggctcctccatgataagcacacattgtgttcgagccgtaccctcggaaaaatggaggttgaggaaacctag

SEQ ID NO: 37230 - DNA, 675 bp, Glycine max
  Peptide Sequence Number=SeqID_128915
atggtggcgacggtgccgctgttcaccctctgcttcagcctgctgtgggggatgcgcaacaccaaactggaatgggccggcatcgcgctcggtctggtgggcatcgtgctgcttaataccggcaacaacctgctgggccttcgggtcggtactgggatcgcgcatctcgctgccggccgggccgatggccggcgcggcggaaatgttggtcgccggcgtggtgttattggcagccagtcagctgagcggcgagcgtctgactcagatgccgagcaccggcggctttctggcgctgggctatctgatcgtcttcggctcgatgctggcgatcagcgcctatatgttcttgttgaagaacgtgcgcgcggcggtcgccaccagctacgcctacgtcaacccggtggtggcggtgctgctcggcatcggctttgccggcgaatcgctggcgccgcgcgagtggctggcgctggtgatcatcgtggcggcggtggtgctggtgacgctgggaaaatacctgttcgcccgcccggcccgcgtgcaggccatcgacagcgaacggtagcgatcgcaaagggcggtctgcgggccgccgttaaaaacgattcttgtttcacccggcgaaggggctataattcccgctgttccaagcaacctgcgaaattattcctatgctga

SEQ ID NO: 37231 - DNA, 444 bp, Glycine max
  Peptide Sequence Number=SeqID_128916
gcgattgtcggcgccgggaccgtgaccaacgttgagcagctgaaagccgttactgaagcaggcgcgcagttcgctatcagcccgggcctgaccgaatccctgctgaaagcggcgaccggcgaaggcaccatcccgctgatcccgggtattagcaccgtatccgagctgatgctgggcatgcagtatggcctgaaagagttcaaattcttcccggcggaagcgaacggcggcgtgaaagggttgcaggcgattgccggtccattcggccacattcgtttttgcccgaccggcggcatctctccggcgaattaccgcgactatctggcgctgaacagcgtgctgtgcatcggcggctcctggctggttccggccgacgcgctggaaaacggcgactacgatcgcatcaccaaactggcccgcgaagcggtagaaggcgcgaaataa

SEQ ID NO: 37232 - DNA, 237 bp, Glycine max
  Peptide Sequence Number=SeqID_128917
atgtgcacatgtgcaatttttggtaccccaaatgctgtgagtatgcatgaaatggccccaaggaagcttgcctcaaagaggtccaggaaggataaggcgggcgaagggactagttccgctcctgactatgacagtcacgctttaggagcgctgtacaccagcagcgcttcgagggcatcaaggggatgtcgtttctccgggagtgacgcgtccagctcaagacgacgatataactga

SEQ ID NO: 37233 - DNA, 222 bp, Glycine max
  Peptide Sequence Number=SeqID_128918
cctgctgtggatgcccttgactttctagagggtgatgaggatccacttcttgaggtggattctcccgaggaagtcatgtcggcatctgaggcagactctatggaggatagtggctcgggggagatggcgatcaacggaggctcttcatcctatgctttaaaaggtcttgatgatgctccacagcctaaatcaaaggctcctggtaggtggattttcgtcaag

SEQ ID NO: 37234 - DNA, 357 bp, Glycine max
  Peptide Sequence Number=SeqID_128919
atgggttctccacctgtctccactcctcctcctcctcctccttcgaacgcatcggcttcgccgtctgccgtgaagtggacacgcaaagcctcacgtctacgatcgttgtccactagaccacctagtgctgagagaccagtggtgcatgttgatcctgctaccgggaaggccgacggtccccacaggaagaaattaagaacatatttgaggattgtggcgcgtgataaggtggacatcacctacgagaactggaaggaggtccctactactcagaaggacctgatttgggaggatattcaggcggaatttgatatcctagaggcttctaacagtaggacgaaaaggaagttactatag

SEQ ID NO: 37235 - DNA, 219 bp, Glycine max
  Peptide Sequence Number=SeqID_128920
atgacattgattataaagagacattttactagtctcacgaaaggattctttcaggattatcatgacattagtagcccattaagacttagagctacatcaaatagatgtgaaaaccgcctttctgaatggagatttagaggagaatctaacgatcttggtcttcttcatgagactaagaaatttctctctagaaactttgaagtgaaagatatgggtgag

SEQ ID NO: 37236 - DNA, 300 bp, Glycine max
  Peptide Sequence Number=SeqID_128921
ggtttgttggtttttttccccccccagcaacgaatcaaagcgacaagggctgaatcaaaaaggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctcctccccccctcggcaaacggacggcgggcgcacgcgtcgcttctagcccggattctgacttag

SEQ ID NO: 37237 - DNA, 93 bp, Glycine max
  Peptide Sequence Number=SeqID_128922
atggggcatgccacattgctccccttctcttgcaattcatgtccaaacatgcgctcaccaagtgctcggtacagcataggagattcaaaatag

SEQ ID NO: 37238 - DNA, 432 bp, Glycine max
  Peptide Sequence Number=SeqID_128923
atgatgatttggaaacaaggtgccaaattagtcatggccacagccaggtgggcactcaagcatcccttttatggcattgtggtactacggttgggaatttacacaaacagacccaacgtttccaaattatgttctttcatcagttcaatgaatccatccattcttatctcggttattcaggaaaataaactcttagtgtcagtcccttgtttccagaagatatgtttgctctctacgaatgatttatgcttcctaatcataacatgccgaccttcgagcatttcgtttctaaacgaccatatagaggaaacattgggtccaacaaagataggagaaaatcactcaaagtgtatcaatctcacacagtgcgtggcgagaaagtcgctagcgcacaggattttgtcggcaatcaaagggagaggaccactttag

SEQ ID NO: 37239 - DNA, 207 bp, Glycine max
  Peptide Sequence Number=SeqID_128924
atgttggcaacccattctggataccgagcgacggccagaaaaccagcgtcaaattgcttcttcacttcttcttttatcttcaaggatgtttcgggcttcatccttctcagtttctgctttaccggggaacactcgggatttagaggggaagtcccacatcctcgttcccttcatcttccgtttgattcgtttcttgctcgaagttga

SEQ ID NO: 37240 - DNA, 180 bp, Glycine max
  Peptide Sequence Number=SeqID_128925
atgatccagagggaatggagggaggaattggggtttcctgtgacctggaatgtcgttgactccgactcgaagtgcatttctgcttcttcgatggtgcaaggacgcgttgtaatcgattacacaaatatggtaatcgattaccagaaagcaacaaagccagaaataactgcttgtaattga

SEQ ID NO: 37241 - DNA, 186 bp, Glycine max
  Peptide Sequence Number=SeqID_128926
atgcacgaaacacaatgtggaccaccacggcaaaataggggagatgcttgccgcccagctcgcccaggcgagctcagctcgcccagggaagcagggttgcttcctccagaagcaaccgccttctggaggaaccttctggagggcccaaatgggcctgggtgctatttgcacccccatttttactaa

SEQ ID NO: 37242 - DNA, 190 bp, Glycine max
  Peptide Sequence Number=SeqID_128927
cttgagaggattgatggggacccggtgttgagagaaacgaggatatgggctacgtgggagtacgtgagctcagatggagagtggtacctggagatatgtcgcgggggtcaggagaccttggggacgtcaggtggggtgctattgcccaaaaccaagcttgaccaatcccgacccaacccgggcatagtcg

SEQ ID NO: 37243 - DNA, 318 bp, Glycine max
  Peptide Sequence Number=SeqID_128928
atggaattgcccgttgctttgcctgagaataacaattggttgaccacaacagcgctggggtgcggcaacggacaatgttctttccctgttgtaatacaggatcaaaggcatagtgcgttcaaaatttggttcaaacctgcgtatatcggtgaatggcttccggcttgcaaaatcactaacctgaatttgaaccaatgggcacattccaaccttgatgttacaatctctgctgctgtttctccagaagaggttcatgtgtatcagttgggagcccctccatactttgaaagcaagatattgtgtgatttagtagcctag

SEQ ID NO: 37244 - DNA, 521 bp, Glycine max
  Peptide Sequence Number=SeqID_128929
atggaaggaaggaaaagaaggagtccttttctcaatgtggaagataccccaaacattccgctggcatgggaaaccccgttaaggaaagatcaagagcttagaggcattcgtaatggcatcattggtgggtaccacgaatggctgaaagttcgcatacgaggtttagattggctcgccaagttaaaagtcgtcagcgaagagaattttgaagcaccggaagaagacaaagaagtccaagctctcaaaagcgagttaggaaaggcaaaacttgccaaggagaagttcaagttggccgctacacacgttcggaaggagtgtgccgggttacgggaagagaatgcaattaccgcaagagcccttgaacaagagaccaagagggctcgcaaggaagagtatggccggaacaaatttcgcggagctctatggggtagcaatagtgaactcaagttgcgaagggaagaaagggaccagtcgcgagcacatggcatggttttgaaagaggagttagttgcctgttcaag

SEQ ID NO: 37245 - DNA, 171 bp, Glycine max
  Peptide Sequence Number=SeqID_128930
atggcatttgcgcatgattttgtgaaaaagagcagcagttgggctaagctcaacaattgggctaagcgcatatccaccactaagcgcagcttcagcgtgcttagcgctaaggagaatctggcagagcatcagcatcaaagctgcgcgctaagcgagagatcagtgcgctaa

SEQ ID NO: 37246 - DNA, 423 bp, Glycine max
  Peptide Sequence Number=SeqID_128931
atgagtcatcattcatctaatgttaatggcgtgggtactattcataaagaccctttatctagaatcatagatgagttgagttccctcaagttatggaaagaaaagctagaaagaaaagaaaaaggaaaagagagggtaaaaataaatcaagatgagagggaacaaataaggaaagaagaaagaatgaaaatactaaaagagttaagaaaagaaaaacatgcctcctatagtagtcataactcttgcaagagcctaagtgaagaacttcgtgactattatgaaggaaggcataggtcatatcttagacctcactcccataggagaaaaaaggaaagaaaggctcaagaggctaacattaacctcccatacttccatgggaaggacaatgtagagacttacttagattgggaaataagtgtatag

SEQ ID NO: 37247 - DNA, 492 bp, Glycine max
  Peptide Sequence Number=SeqID_128932
atgttgtacttggaatgtgatccaattccaaaagttgttgagaatgaggatgatttagatgatgtacctgttgttgaccatgaggaagatgttggtgtgctggtgagcatgttggtgctggagagcagagagatgctggtgagcggagggatgctgatgctgcaaagagatggtagtgagcagagggatgcggatgctggtgagcagagagatggtggtgagcatagggatactgatgctggtgagcaaagagatggtagtgagcagagggatgctgatgctggtgagcagagagatgctggtggtgaagagagagatgttgctgatagtgaggaggaaaaggaagttgatagtgatgagtggtttataaatttctcttgtatgatgaatggagttgaagctgaagttgagacagatggttatcattcagaggagcttaatatccccattagtagtgatgatgaagatgaggatgttgaagtttatccttaa

SEQ ID NO: 37248 - DNA, 684 bp, Glycine max
  Peptide Sequence Number=SeqID_128933
atggcattgctgtcttcgcagaaacgagtagcgcacgatcctatagatacaggcttgaccgaaataattagcttgacggaggtactatgcaatgctgagattgttgtaggtaaatctgaaggatgtgcagcattgcttttgttattgcacgccccgaaggggcgtgaaatcagaaagagagccaaatccactaatgtagtggagtgcatgtccactaaagtagtggattttgcccgacagagtaggatgcttcatacccagagcctgattccacagctcatggccaggttggccacaggcagcctgcatcgtgagccaatgcgcacatgcaataagcacaagttatgcagagaagcgtcacatttcccattcttactattcaaaggtgttctgtgtgatcgatcaacaggatctgctgctacatttgggctcgtcacttttttgcgcttctgccaagctctgctttcagctgctgcacgaagtcgccacctacgtcctcatcgtcccagtctgcttcccacagggggagttcgggctctttctctccctcttgcactcccactggttctgcagtacaataaaagcgtcagccaaggatgcatacgctcaaaacatcgaactgggaaagctatctttgtgctgtctcttgttgttgcctggcagactcattcagtgcagaaatag

SEQ ID NO: 37249 - DNA, 162 bp, Glycine max
  Peptide Sequence Number=SeqID_128934
atggaagagaaggtaaagcaaaaaattaatggagcttgcttgtggggcttctatggaggctggatctttgagcttcaacggggtcctttaatggtgattttccaccatggagatgcagcggaagacaaaggaaaagaggtgagaggaggcaccatccattaa

SEQ ID NO: 37250 - DNA, 330 bp, Glycine max
  Peptide Sequence Number=SeqID_128935
atgtcttccatggttattttgatgatgccaaagaatcaagagttaagcaaattccaaagattcaagaatcaagtttcaagaatcaagattcaagaatcaaggtacatcctttgtggtacaagtagagggtacatctacttggggattgttatactgagaacaagagagggtacatctcttgtggatcagttcaagtggagggtacacccacttggtttgttcaaagagaacaagggagggtacatcccttgtggatcttgggcttgtaaaggtttttacaaggttgaaagaaatctcaagaaccgcaagttgcttggggactggatgtag

SEQ ID NO: 37251 - DNA, 222 bp, Glycine max
  Peptide Sequence Number=SeqID_128936
atgcatggctatataaaggaaacgaaacatagtgtgtttgttccgtgcccctatttcaggaacctaataggagggactaaagggactaccaatgacaatgtatcatcaaagagaaaaactctagatgaggtttcactgtcatcaagcgagtcggagactcagcatgaccatagatcaacctccacttcctatgttcccatggacccgggtatagggccctaa

SEQ ID NO: 37252 - DNA, 228 bp, Glycine max
  Peptide Sequence Number=SeqID_128937
atgactgatgttattaaagatgctctctacctaacaatgtttctatgttctatgatgtctcctggactgctaaaccctgatgtctcgtgcatgtttagcctaatcctagccaagcgtcatcctcaaatccctcttgttggactaaacttgatcagaactgcattaagacatacataccaacaactaggttaccgtaccccgatccctcacgacaattcgataaactag

SEQ ID NO: 37253 - DNA, 285 bp, Glycine max
  Peptide Sequence Number=SeqID_128938
atggggccgaatcaagcatatgcttttaagaaaagattttcatcaagtcaagaatgcgctttacggtgcccttaccaaatgtgtgccagagctagagtgatgagtgaaatagaagaggtacaggaacatatgaaggccgacatggaggccatgaaagagcaaatgaccacaatcatggaagtcatgatgagtatgagaaaaatgatggaggtcaacacggctacagtcattgccgcaagtactgccactgaggtggacccaactcacccatctggcctcaatcaa

SEQ ID NO: 37254 - DNA, 144 bp, Glycine max
  Peptide Sequence Number=SeqID_128939
atgttcaagggaaatctgattcgccagaaagcgcaccggatcgtcaagtatttaaaattaaaatggatgaatccgagtatcgaactcagggaactagtactagacaagcctaaagtactagaccacgatccctcattaggctag

SEQ ID NO: 37255 - DNA, 238 bp, Glycine max
  Peptide Sequence Number=SeqID_128940
atgaggttagtagatcttcccgggagatatcacagccatcaagttggcgatgaaggacggcaaaaggtcttcgtacgtcattgggatcggggagaattctggaattggcctcaggggaaagttcctcatcacattggaaccggcgccaaagtgggcattgccggccaggcgagtcgtggttggagccggagcttgggggcctccctttggatgggggcgagcgctataggttgtacgg

SEQ ID NO: 37256 - DNA, 588 bp, Glycine max
  Peptide Sequence Number=SeqID_128941
ttaggccaccacttcaagaactctgtagcaccgcctacatacctcgctctgctaatcctgttaccagtggctgctgccagtggcgataagtcgtgtcttaccggggtcggaacaggagagcgcacgagggagcttccagggggaaacgcctggtatctttatagtcctgtcggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgcgaaacagctatgaccatgattacgaattcgagctcggtaccccttttgggagaattgtcagagaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 37257 - DNA, 597 bp, Glycine max
  Peptide Sequence Number=SeqID_128942
gcattggctgcacgtcttagcactaaaggaagtaatgtagaaactgctgatgttgacccatcaggcaacaaaaatgtgagcttaaaacccactatggggttatacgtgcaacgacaacatactacagtgttggtggccttggggaaaatatgtgaggggggatctgccattcacaatgtcacttatgttgatgatgttgtaagggagttcgatactagtccaaggaaacttcctgaaacaaatgaaagggggacgaatgattttgaccatgatccgttgcgtcaactgattaaaagcctatatttcatgtacgacacacctgttgagttgaagtgggatggcagcaaatttgggctttcaaatgttgatgcttcattcttcttgacattctcttatgtaaatgaaatagtagctggatacaaatgtttgaacatatctatactacagttatggatgctgtttttggatgagtggagctcaactttgggtcatgcttccgtgtatggattccttgagccacaatcgatacacaatgcaaaggatcgacgtgctgaatgtgagcattacttacaagcatggctcaaggaatcgcaatga

SEQ ID NO: 37258 - DNA, 231 bp, Glycine max
  Peptide Sequence Number=SeqID_128943
atgatgcacttatgtattacaacgggaactggaaaataccacgacaagtgtggaagcaatgccttccaaggttattttgatgatgccagagaatcaagagataagcaaattctgaagattcaagaatcaagtttcaagaatcaagattcaagaataatcaagatcaagattcaagaatcaagagaagaattaatcaagataagtactaagaaaagtttttcaaaacattga

SEQ ID NO: 37259 - DNA, 219 bp, Glycine max
  Peptide Sequence Number=SeqID_128944
atgacatctccggaaagggtgcaaatgaccaacattttgtctctgcgtgccatcaatcacactgtgtctgaatggacgggtgcggataaccgtaaggtgtctccgcgggttaccagtcttgagccatggcaacaaaagtgtggtgtggtcgacaaaagcgaggctcttgctcctacgtatcctccaatgaggaactcagacctacgtagttctggataa

SEQ ID NO: 37260 - DNA, 147 bp, Glycine max
  Peptide Sequence Number=SeqID_128945
atgctccaaccatatgggatcaacataggcttaaaggagcactcaaacccggtgacccccaaggcctacactccgaagagtccgtcagggcctctccctcttgattcaggaacctacactttctctttaacactggttcctaaatag

SEQ ID NO: 37261 - DNA, 351 bp, Glycine max
  Peptide Sequence Number=SeqID_128946
atgattatgaggggccaagacatttatagtagccaagatgaggctactacttcaccttcctctagtgaaagtgaaaaagcaaaaggggaagaatctagtgaagaaatctacccccaagaagaaggacaaccattagtgctaagaataggtggtatgatgaatgttttgagtggtgcaacactcttttgtaaaatcactcatgcacccaacatcttcatgatttgtgaacatggggacccattaggtgttgagggaaggagcctagagcatgaagaacctcgggatttgaggtcaaatcctttccaaggtggagggaatgatgcaatcctaccccgaaagggcattgggtag

SEQ ID NO: 37262 - DNA, 348 bp, Glycine max
  Peptide Sequence Number=SeqID_128947
atggcggcgcagctaatccgtgatcgagtagagatggagtgcctagagggagcttgggagaccctcgaaggcaacacgaggtgccgatttcggggcaccattcaattcacggctacttcattgcctgtccaagtgatcgaggtaacgtcatccgaggaagaccctgaggaggatctggaggagctacctcctgagcctgctgtggatgcccttgactttctagagggtgatgaggatccacttcttgaggtggattctcccgaggaagtcatgtcggcatctgaggcagactctacggaggatagcggcccgggggagatggcgatcagcggaggctcttcatcctag

SEQ ID NO: 37263 - DNA, 327 bp, Glycine max
  Peptide Sequence Number=SeqID_128948
atgaagaacgtcgaagacggttcaaacctttgcgagattcctcacggaaaacgttacggaaacgtttcggaagcgcctcggcttagattttcttcaggaaaacaattttttcaagcaatttccaaagagagagaagtgcctaaagggctgggcaaaataggggagatgcttgccgcccagctcgcccaggcgagctcagctcgcccaggcgagctcagctcgcccaggcgagcagggttgcttcctccagaagcaaccgccttctggaggaatcttctggagggcccaaatgggcctgggtgctatttgcacccccatttttactaa

SEQ ID NO: 37264 - DNA, 171 bp, Glycine max
  Peptide Sequence Number=SeqID_128949
atgaggaagaaaaagaaggatagtaaggccttgtcttcaaaggccaaggggaaggaaacatcccttagcaccgccatacctcttgagctcgaggttattcctcaagtaaaggagttgctggatgagggtttggttcgcaagagcttcaatccttgtgctttgttggaataa

SEQ ID NO: 37265 - DNA, 567 bp, Glycine max
  Peptide Sequence Number=SeqID_128950
aggactacacgtcctcgccttgaggactacacgtcctccccttcagagggctacacgccctcaccttcagaggactacacgtcctcgccttcaggactacacgtcctcaccttcagaggactacatgtcctcgcctttagaggactacacgtcctcgccttcagaaggctacatgcccccgcctttacaggactacacatcctcaccttcagaggactacacgccctcaccttcagaggactacacgtgctcgccttcagagggctacacaccctcaccttcagaggactacacgtcctcaccttcagagggctacacgccctcgccttcagaggactgcatgttctcgccttcagacgactacacgtcctcgccttcagagggctgcacgccctcaccttcagaggacaacacgtcctcgccttgaggactacacgtcctcaccttcagaagactacacgccctcaccttcagaggactacatgtcctcaccttgaggactacacgtccttaccttcagaggactacacgccctcaccttcagaggactacatatcctcgccttga

SEQ ID NO: 37266 - DNA, 407 bp, Glycine max
  Peptide Sequence Number=SeqID_128951
atgagtcacgggcgcttgtaccagcaaagaatgaagagtgcattcgacaagaaagtacgcttacgcaagttccatgagggagaccttgtgctaaagaaaatagggctttttccggaggagccctggtgcttaccaacatggatggcgaagagctaccttcacccggatttcctgtctgttgtatctctcgttacaatctttcaaagaaatgaacgtggattcgaggcttgtagtcctcacgggcaggatcatcttgggctaccttctggggtagagacaaaacatgaacggcagaaaccaatcaaggtacttaaggacggatgcaagtggggatggggtcacgaccgaccgatcgttgccccttctctgtgcgaaacaagcagagaatgtcgctgcaaggcagcccc

SEQ ID NO: 37267 - DNA, 495 bp, Glycine max
  Peptide Sequence Number=SeqID_128952
atgtgtccttcacccttcgtgtttggagccatgcgtattgagtgcttagtgcaattctccattctttccatttttcggagccctatgaattgcgttttcgttcatgtgtcctccaccttcgagtttagagctatgcgtagtgattgcttagtgcaattctccattttcaccctttttcggagccccatgaattgcgttttcgttcatgtgtcctccaccttcgagtttggagctatgcgtagtgattgcttagtgcaattctccattctcaccctttttcggagccccatgaattgcgttttcgttcatgtgttctccaccttcgagtttggagctatgcgtagtgattgcttagtgcaattctccattctcacccttttgcggagccccatgaattgcgttttcgttcacgtgtcctccaccttcgagtttgcagccatgcgtagtgattgcttagtgcaattctccattctcaatcttttcggagccccatga

SEQ ID NO: 37268 - DNA, 536 bp, Glycine max
  Peptide Sequence Number=SeqID_128953
atgggacacttgaacaaatgtgggttgtatgtcgatgatagtcctccccgactagtttctcttggaagactttatgagggattgaagattgtccacaacgttcctttgggcaataatcaagtgaaggataaacaagtagctgagggatcgatgaaaccaatagatatgtcagatcctaacgtcgatcccctgtaccttatgacattgacaatcccgcagcttttcctcaagccattgcaggtgttgtgggatgctagcgtgtttgggggattcgttaaggcattggaccttgaaattatctcagggtacaaggcttgcaagagaaatgatgtaggaaacaatccacggtccagcccccttaaaccctccccctgcatggctatttatcaaaaaagccatttggtgcagggaaagctcgtcttgacgagccagttgcttaggcttaaaggtatcacctcacctaagcgagttggttgcttaaggttgaagccttcccatggcccaggcaagccagatgctggcctgggcaaatttag

SEQ ID NO: 37269 - DNA, 650 bp, Glycine max
  Peptide Sequence Number=SeqID_128954
aggactacacgtcctcgccatcagaggacaacacgtcctcgccttcagaggactgcacatcctcaccttcataggactacacgtcctcacctttagagagttgctcgtcctcaccttcagagggctacgcgccctcacctttaaagggctgcacgtgctcgccttaagagggttgcacgccttcaccttcaaagggcgatacgtcctcgacttcagagggctgcacgccttcgcctttagacggctatgcgtcctcactttcaatgggctccacatccgcactttaagagaatttaaggggcaagatttcacctgtgccgctgcaaagagacgagtgcgaatcatgcgcaccaaaatgaccactcttacacaaatatggatgacgttgctacttagcaacattccgtccagcgaccacaatgccgatctccccctgcggaagtatcagttgggatcgcacccacaaagacacctagtggacccggagaagtccaacagggccctggggtttccaactctggttacaggcctctggatcgcacctgcaagacacccagcggacccgaagaagtccaatagggtcttggagttgccagctctgattacgggtctctatcagttctacggagtgcactgtcgcccccagcaag

SEQ ID NO: 37270 - DNA, 380 bp, Glycine max
  Peptide Sequence Number=SeqID_128955
gctggtgagtcaggaggagctacaacttcattatctgagtcatcgagaatgagtatcgaaggtggtgccggtggagctggtggaggtggtataatctcaacctccggggaagccggtgggtctactactggtggtcgcgactcagctggtgcaggctctatccttgttggtatgggactggggggcacaacctcggaagatcttcctaacgccaactgctgctggttgtggacaataatcagttgcccccggaataggctctacaacataggaactataggttgtgcttgtaggccatttggttccatggttgctgttggaggaggtgggttggatgatgtagaagcaaagcttcatggtgaatcaaaagtgattcaaag

SEQ ID NO: 37271 - DNA, 477 bp, Glycine max
  Peptide Sequence Number=SeqID_128956
atgaccaagaaaagatcgcacctctcgcacacaagaggggccgaaaggcatcctcctataagcaaaagtgccgaaggggcaggtgaatgtggtcttttcctgatcctcaggagcaatagtaatttgcatataaccagaaaaaccatcaaggaaacagtagtgggatttacctgccaggcgttcaagcatctggtcaatgaatggcaggggaaaatggtcctttttggtaacctggttcagcctcctatagtcaatgaatggcaggggaaatccagtatacttgaagatgcgcagaagtctaaagctaagctgaactataggctggtttccactaccaattcaattccaagccttgttgaggagattcagcttggatttagtagaagagcaaaatgggagatggacaaaggtaaacatgcaaaggttgcagcagacatagaagataggttttttaagctgaaagggttaacattttga

SEQ ID NO: 37272 - DNA, 615 bp, Glycine max
  Peptide Sequence Number=SeqID_128957
atggcgagggacaatgtagaggctaacttagattgggaaataagggtagagcaacaacttaaagagaagtctactccaaaatcttatggctttcactcttatctaaagaaagaccaaggtcaaggcatcttaggggtgacaccttctaagcccaaagatgataaggggaaggcaatagaaaagcaagcccctaaggctagtatgcaagagaaaactagctttgggccagacatttatagtagccaagatgaggctactacttcaccttcctctagtgaaagtgaagaagcaaaaggggaagaatctagtgaagaaatctacccccaagaagatggacaaccattagtggttaaagagaagtgtaaggaggtaagtgtctcctccaacaggttagctaagaaggaaactcattttacaacaaagacaaacattaaagaaactttccctcttagacaacctccacattttctcttttgtaaaaagacatttgctagcattgccacacctcttgggcttgagtttattcctcaagtaaaaaagttgttggataagggtttggttcgcaagagcttaaatccttgtgcttttgttggtgcccaaaataggtattattag

SEQ ID NO: 37273 - DNA, 315 bp, Glycine max
  Peptide Sequence Number=SeqID_128958
gttccactgcagcggacactggcagatggtggtcatcctgcccaaggaacacctagttgtctgggtcttgatgatgctccacagcctaaatcaaaggcttctgctaggtggattgtcgtcaagtgtaatagacaaaaaggaagtactgagtgcggctactatgtgatgcaatggatgtccaccatcattttaggaacttttaggaataattgggaagcgtattttaacgatcctagaacattggagacagagagattaaaagcattgcggatccagtgggcacagttttatctccgagttagagatcaggcctag

SEQ ID NO: 37274 - DNA, 339 bp, Glycine max
  Peptide Sequence Number=SeqID_128959
atgtcggtggcctcttccttcctttcgcttggaggtgcatacctctacgggactgcgtggctgtttcggtatggaaacggaacaagtttaactaccgaggggtatcggggcgtttggggagctgcgtctttggtgaaatataccaccaaaggcttaggacttcctaaacttctctcatccgcggactgcatgcatatatgctgttcttccctcccctcatcaccgacttctagtcggcctcgatctatcatctgttgcaacagctcgctgggatgcatcaaacaggaatcctcttcgtgcccaccgtggggaattacgccccccttttgtagggcctag

SEQ ID NO: 37275 - DNA, 1278 bp, Glycine max
  Peptide Sequence Number=SeqID_128960
atgacggcgcttggttccttgggcggtttgttggatagcagcctggcccgtagcctgcagcaggcacaaatcatgatcagtcaaggtcagccattatcgcaggcgtttcaaaccgtgggcatgaccaccccgattggagagcgcatgctgctggttggcgagcgtggtggcaacgtcgcgcaaatgatggatagaatcgccagcttttatgacgaagagctcgcgcgctggatcgactggtttaccaagttatttgagcccttactcatgttgtttattgggctgctattgcccatcttatctgccgacgtattggcacaagcccaaacgcaggcgacacagcagcaacgccgcgtgattgaagtgctcgaagagcttgcgcccatcgacaatgaaaccatggtcagccaattggcgcatgtattgcactatccggttgcgaccatgcgtgagatgcgtgaatggcaggtggcctttgacatcgtaagttataacgatgcgcagcagaaagaatgcctggcgttttatgatgctgaacaacacttgatcctggtgtttgctgacccgtttaaccgtcagttatcactgtgggcgcagcatgcggtgcaagtgccgtttgagtggcggctggcacaccggctggagatcagtgcttacctggcaggcgaagaggaaaccatgcgcgccatggatggcgtcgggttatcgaccgagcaagcgcaagaaggcgacgaagaagtcgtcatgcagctgtcgctcaagtccatccatgaagatgccaatccgattgtcaaactgattaactccactttgtatgatgcgctgaaaaccggcgccagtgatatccatctggaaacccatcccggtggtctggccgtgaagtaccgcattgacggtgtcatggcaagtatcgccaatagtccggggctggacagtgcagagcaagccatttcacgtatcaaagtcatggcgcaactcgacattgccgaacgccgtattccacaagacggccgttttaaagtacatgccatggggcggctgattgattttcgcgtctctatcatgccaagtgcctttggtgaggatgccgtgttgcgtgtgctggaccgcaaagcgctgactgagcaggcacaaggcctgagtttgaaagcccttggatttgatgccgatgtgattgcccgcttcaggaagctcgccagtgagccctatggcatggtgctggtcactggtccgacgggtagtggcaaaacgacctctctctatgctgccatttcagag

SEQ ID NO: 37276 - DNA, 879 bp, Glycine max
  Peptide Sequence Number=SeqID_128961
atgcgcgttgcgatttttggtaccggttacgttggactggtgaccggtacctgcctggccgacgcaggccaccaggtggtctgcgtggacatcgatcaggccaaggtcgatggcctcaaccagggcatcatcccgatctatgagccgggccttgagccgatggtgaaggccaaccacgccgcctcgcggctggcgttcaccaccgatgcggcggccgccatcgagcatggccaggtggtgttcatcgccgttggcacgcccccggacgaggatggcagcgccgatctgcagtacgtgctggccgtggcccgcaccatcggccggcacatgagcgtgccgaccgtggtggtcaacaagtcgacggtgccggtcggcaccgctgacaaggtgcgtgcagccatcgctgaagagctggccgcgcggggcgcggacatcgccttcgacgtggtgtccaacccggaattcctgaaggaaggcgacgcagtcgccgactgcatgcgcccggaccgcatcatcatcggtgcgaccagcgccgagtcggtggcggtgatgcggcgcctgtacgcgccgttcaaccgcaaccacgaccgcgtggtggaaatggacgtgcgttcggccgagttgaccaagtacgccgccaacgcgatgctggcgaccaagatttcgttcatgaacgagatcgccaacatcgccgagcgtgtcggtgccgacgtagagcaggtccgccagggcatcggctcggatccgcgcatcggctggcatttcatctacccgggcgccggttacggcggctcatgcttccccaaggacgtgcaggcgctggcccgcaccgcgcagcaggccgggctggagccgaagctgctgaacgccgtggaagcg

SEQ ID NO: 37277 - DNA, 387 bp, Glycine max
  Peptide Sequence Number=SeqID_128962
atgcagccgtatgtggcgttgggccgtgtacaaccgctgagtggcgcacaaaagatattgggtgattttaatgcctacccgacacccggccatacgccaggacattactactaccggctggaaagccagggccagtcgattacatttatcggcgattcagtgcatgttgaagcagtgcagtttcctcatcctgacatcaccattacttacgatgttgaccaagccagcgccgcaaaacagcgccaggctcaattcgcgcagttagctaaaagtggcgccatgattgcggcaccgcacttgccgtatccagggattggttacattaatacgcaaaaagaagggtttgcatttatccgtgcagaatttcatgacagggatggactgtga

SEQ ID NO: 37278 - DNA, 408 bp, Glycine max
  Peptide Sequence Number=SeqID_128963
atgaagctcttaaggtggttggccccttgcttctggactcaaattcttcaagggatggcaccaatcctccttccaattccctatatggcaacccacaaacaaggaaacaaagagacaagcaataacctgggatcctctagagtcgacctgcaggcatgcaagcttggcactggccgtcgtttacaacgtcgtgactgggaaaaccctggcgttacccaacttaatcgccttgcagcacatcccccttgcgccagctggcgtaatagcgaagaggcccgcaccgatcgcccttcccaacagttgcgcagcctgaatggcgaatggcgcctgatgcggtatggggctccttacgcatctgtgcggtatttcacaccgcatatggtgcactctcagtacaatctgctctga

SEQ ID NO: 37279 - DNA, 280 bp, Glycine max
  Peptide Sequence Number=SeqID_128964
atggataatcccatacaaggaaaaatttgttacagcctagatgaacaagataatagccttggagacctgtgtagtgtttgggatgccatgaacaacatgatcacactgcagcacactcaaattaaagcatcctttgaaataagtacacatgtggttggacatgtatttaaaaaaaccttatacaagaagcttcttggaatggtttcaaggtacactttaaatgagattgctactgagtttgagcgtgtgcattatgctggcaataatccttcttcttgtg

SEQ ID NO: 37280 - DNA, 776 bp, Glycine max
  Peptide Sequence Number=SeqID_128965
gcgtgggaaagcccgttaaggaaagataaagaacttaggggcattcgtaatggcatcattggtggttatcatgaatggctgaaagttcgtacacggggtttagattggctcgccaagttaaagattatcaacgaagagaatttcgaagctccggaagaggatgaagaagtccgagctctgaaaactgaactaggaaaagcgagacttgccaaagaaaaattcaagttggtcgctacagacgtccggaaagagtgtgtcgggttacgagaagaaaatgcagctaccacaaaagcccttgaacaagaaaccaagagggctcgcaaggaagagcatggccatgacaaatttcgtggagcattgtggggcagcaacagtgagctcaagcttcgaagggaagagagagaccaatcacgagcgcatagcatggttttagaagaagagttagctgtttgctcaaggtccaaaagaaacttgtctcagcgtttatgcgagacagagaccaacatgttagttatcatcaccaagtatcaagaagaactaagcctagccacggcccacgagcatagggtggcggacgaatatgcccaagtgtacggggaaaaggaggctagaggaagggtgatcgacttgttacaccaagaggcaaccatgtggatggaccaatttgctcttacctttgaacaggagtcaagaacttccccgattgctagccaaggccaaagcaatggcggacacctactctgcccccgaggagatccacggacttctcagctatt

SEQ ID NO: 37281 - DNA, 210 bp, Glycine max
  Peptide Sequence Number=SeqID_128966
ggctgttcatgtgtcctccactttcgagtttggagctgagtttcatgattgcctaagtgcggaccctcaaggcaatccttcatactccacctttgttcggagcaccatgaatatcggttccttcgccaatcccgagacgtctcagaaatctaaaggaagcaggcttgcgcgatccgtgaaattccgtaatgtggcggaagtcgaaaagag

SEQ ID NO: 37282 - DNA, 1062 bp, Glycine max
  Peptide Sequence Number=SeqID_128967
atggagcaaaacccgcagtcacagcttaagctgcttgtcacccgtggtaaggagcagggctatctgacctatgctgaggtcaatgaccatctgccggaagatatcgtcgactccgatcagatcgaagacatcatccaaatgatcaacgatatgggtattcaggtggtggaagaagccccggatgccgatgatctgatgctgaatgaaaacagcaccgatactgacgaagatgccgcggaagctgccgctcaggtattatccagcgttgaatctgaaattggccgtaccaccgacccggtacgcatgtacatgcgtgaaatgggtaccgttgaactgctgacgcgtgaaggcgaaatcgacatcgccaagcgtatcgaagacggtatcaaccaggtgcaatgctctgtcgccgaatacccggaagcaatcacctacctgctcgatcagtacgatcgcgttgaagcgggcgagtcacgcctgtctgacctgatcaccggtttcgtcgatccgaacgccgaggaagatctggcgccaaccgcgacccacgttggttctgagctgtcagaagaagaccgcgacgacgacgaagaggaagacgaagagagcgacgacgacagctccgacgacgataactctatcgatccggaactggcgcgcgagaagtttaacgacctgcgtacgcagtacgaaactacgcgcaacgtgatcaaagccaaaggccgcagccatgcggacgccgtggccgagatcaacaatctctctgaagtgtttaaacagttccgcctggtaccgaagcagttcgattacctggtgaacaacatgcgtgaaatgatggagcgcgtgcgcacgcaagagcgcctgatcatgaagctgtgtgttgaactgtgcaaaatgccgaagaaaaacttcatcaccctgtttaccggtaatgaaaccagtgagagctggttcaaagcggcactggccatgaacaagccgtggtcagaaaactgcaggaagtggaagaagacgtcatgcgttcgctgcagaaactgctgcagatcgaagaagagaccggcctga

SEQ ID NO: 37283 - DNA, 117 bp, Glycine max
  Peptide Sequence Number=SeqID_128968
atgtcagctttgatgcaacatatggagaggttaatgaaacaacgagatgatgcgctccatgagaggttggatcaaatggagaatagagatcataatgaagaaggtgggatcctctag

SEQ ID NO: 37284 - DNA, 480 bp, Glycine max
  Peptide Sequence Number=SeqID_128969
ggaccgcacccacaaagacacccagtggacctaaagaagtccaagaggccctggggtttccagctctggttacgggtctctgtcggccctacagggcgcccgttccccccagcaagttcatgtcgtcgtgacataggtaaggattgtgcccgtaagacacctagtggacccgaagaaggccaacagggtcttggaggttctacggagtacctgtcacctccagcaagggcatcaggccccctactaatcgagctttcatcaagaagtactgcgtctccaggcaggcgcagggcgaaacaccatagcagcctgggatggccgatagcaggcaatagacacaccgccaccacctctagagttcacctcagctcatccacaaaaaggttagagcgttgcctacaacacatggccgaccagcaggctaccaagtccaaagccaaaggtaagcaaagtactagatcagtgaccgacaagtcataa

SEQ ID NO: 37285 - DNA, 402 bp, Glycine max
  Peptide Sequence Number=SeqID_128970
atgattttgtataattcaagaggatatgaccctttagaggcattacccatgacatggtctgaaggacatgtatgggctgtggagctggatatgcctgctggacaaacattccagtataagttcatactgaaaggagaaggaggggatattatttggcagccagggttggatcgattgatccacacttgggaaactaagaatagaatagttgttctcgaagattgggagaatgtagaacttcagaaaataacagaggaagatcaacttgccgagccaaatgaggaaccccagttttggccacttctgttaatctgtatagtactaggagtttcatgggcaatagatagcgcttttgctgtatgtcataccatagtgatagtgatttttacaaaggcatcttag

SEQ ID NO: 37286 - DNA, 501 bp, Glycine max
  Peptide Sequence Number=SeqID_128971
atgtcgcgtgcgacgtgcaacccagcaatggtgagtaggagtgttctagggtcccaaacgagttcaaaatcggtgacagagacaatgagtggttcccacgagtttgtgatcaagggttactcactaacgaaaggaatgggcattgggaaatacatcgtgagtgagactttcatagtgggagggttccaatgggccatatactttttccctgatggtagggaccccaaagataatgccgcttatgtctctgtcttcgttgcactccattccaagagcaccaacgttcgtgcattgttcgatctcacgttgctcgacctatgcaagaaaggagagcacaaggttcatagccacttcagtcactccctcacgattgggccttacactctcataaaccatggcagcatgtggggctatacgcggtttttcaaacggagacaccttgagacgtcaaattttctcaaggatgattgcttgaagataattgcactattgcggttttag

SEQ ID NO: 37287 - DNA, 321 bp, Glycine max
  Peptide Sequence Number=SeqID_128972
atgtgtttcccccatgggttgagagacatgtgcatggtcagattgaggttgttggctttcaatgagtatgggagtggagttattgacatcctccttgggaggcaagccatatggcgggaagattggggcatcgagttcaccttagcaacagcgctggtagcggaaacttccaccgtattggcttccattatcttcttcatgctcatcatggcctccatcattgtggccatttgcactttcatggcctccatgtcggccttcatctgctcttgcacctcctctacttcactcattactctagctctagcacgagttcggtaa

SEQ ID NO: 37288 - DNA, 111 bp, Glycine max
  Peptide Sequence Number=SeqID_128973
atggtgaggctcaccattgaaagagcgattgctggctcatacgtcattggggccatcgaagaaggtcacgcttctctggcgcatagttcaacgagggggacctcgtgctga

SEQ ID NO: 37289 - DNA, 441 bp, Glycine max
  Peptide Sequence Number=SeqID_128974
atgcccccgactgtccctgttaatcattactccgatcccgaaggccaacacaataggatcagaatcctgtggtgttatcccatgctaatcaccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggatttggtaatttgcgcgcctgctgccttccttggatgtggtagccgttttctcaggctccctctccggaatcgaaccctaattctccgtcacccgtcaccaccatggtag

SEQ ID NO: 37290 - DNA, 72 bp, Glycine max
  Peptide Sequence Number=SeqID_128975
ggatctcgcaaaggtttgaaccgttcttcgacgttcttcattcgttcttcatcgttcttcgatcttcaacgg

SEQ ID NO: 37291 - DNA, 372 bp, Glycine max
  Peptide Sequence Number=SeqID_128976
atgttagtactaactgtggaagagtttgaagagatcttgggatgcccactaggaggaagaaagccatatctcttttctgggttctacccctccttggcgaggatagccaaggtggtcaaaatctcggcacaagaattggacgaagtaaaacaaattagaaatggggtagtcggaataccaaggaagcacttggaggagaaggcaaagtctttggcagatcaaggtgaatgggcttcattcattaatgtcttggcgctattggtatttggagtcgtcctttttccaaatgtggatgggctagtggatttagcagtgatcgacgccttccttgcttatcaccatagcaaagaaagcccagtcgggatcctctag

SEQ ID NO: 37292 - DNA, 279 bp, Glycine max
  Peptide Sequence Number=SeqID_128977
atgaataaatatttacctcatgcacacattttaaaatgcactaaaagcatcaaagagttatatacacaagaacataagaaaaataaaagggaaaccaacaaaggagaaagtcataataaaacattgcacaagattaaatggcctaactctctaaacacagtccctagtggagtcaccaactatcgcaacctacccttcggcgggagggcgacgcgtgactcgtgggatgcgtcttccaagaaaggaatacgcgcggagtcaccaccaacgtttatttga

SEQ ID NO: 37293 - DNA, 198 bp, Glycine max
  Peptide Sequence Number=SeqID_128978
atgtcaattcttaggttatacagtgctcagtgttgtagaaatgatgacaaaaagcccaagagaatgatttcaagattgagtcaagaacaattcaagaatcaagtgaaatttgatttcaagattcaagaatcaagtttcaagtttcaagaatcaagaatcaagaataatcaagatcaagattcaagactcaagatttaa

SEQ ID NO: 37294 - DNA, 273 bp, Glycine max
  Peptide Sequence Number=SeqID_128979
atggaactaaaagtgtgtggaaaagtgaagaacactattgaacaagacgctgaggttgaagattggaaagggttagtgattaatgtgaaggttgaagatagaagcttatctgaggagaggatgtatgagctatgtgcacaggaaagggataattgccaatccatattcaaatctattcaaaaattatatgacaatattgtttctacaaataaacttgtgtggatcgtatgcgttggagttcctatcagtgcctgggggaggaatgttttctaa

SEQ ID NO: 37295 - DNA, 360 bp, Glycine max
  Peptide Sequence Number=SeqID_128980
atgaaggcaaatttacgaaagagggttccttttaaaaacaatttacgggatggggtctatttcaaaagaaataacggagggggtatgatatttacgtgcaatccgccattactactggcggcaagcttgtatcgctatcggcagcagcgggacacaggcggtatcgccattggcatcagcgatacacttgtatcgccattggtagctgcggaacaaaagctgagtcactctgcgtgccgctattcaagctggcgatacatgctgactaagcatgtcgccattaggactggcgggacatgccaacgtgggcagtcccgccattggtgcctgcgagaccaagccagcattgttttgcattga

SEQ ID NO: 37296 - DNA, 279 bp, Glycine max
  Peptide Sequence Number=SeqID_128981
atggctgtcttgccagcaccgtgggcgagtcccacgtggcctatcccgccagaagggctagcggctccagctggggtgtgtcgccattcccataggcgacactctcctctctcctcctacgtggcctatatcgccactaccagtgacgatactctcctctctccagctttgccgccactggcaatggcgggttcagccttgccgccagtggcaatggcggtttcccccgagaaacagaccccctccgttatttcttttgaaatagaccccagaccgtaa

SEQ ID NO: 37297 - DNA, 81 bp, Glycine max
  Peptide Sequence Number=SeqID_128982
atggcatgtcgagaccaagacgagatcggtagtgaaggtggcagcagagagggagaaaaggtggtgacgaagaatgcatga

SEQ ID NO: 37298 - DNA, 522 bp, Glycine max
  Peptide Sequence Number=SeqID_128983
caattggataagcccaaggtagtggttcatgttaatcctaccactaagagagcttcagggccacataaagagaagttccacaactatttagggatgacagctcgagataagattgatattttgtatgccaattggaaagctatacctgatgctctaaagaatctgatttgggaagacattatcggaacatttgatattccagaagtgtccaacaccaagaagaaggggcaacatgatcgaactccttgtaataagtatggtctggatccaaagaattgggaagaatttgttgcaagccacaaaaccccttcttggcaagatatactgaccattgtcattggacaaccagagcacccaagtcatgttcgtgctatgggacttggtgtcaccattagccaatactttggacatgcatcacatggctccaagagttctacatccattatcccacaacatctgactaagatgatacaaaaccttaaagaagagtggaagatagaaacaaaagaggagaacaaataa

SEQ ID NO: 37299 - DNA, 638 bp, Glycine max
  Peptide Sequence Number=SeqID_128984
ggaagaacacatggacagttaatgatctcgtgccttacatgaaaaagttagcgattatatctgaagagcaagagagaatcactgagccagtgtcacatggtccaacatcagagtgtgaattcccagcacaagagtttcacattcttcaatcaagtgttgaaactcggggcataggtagacgaagggagcctattgaagcggaacaatattcccaacaaatgatggagcgtggtcatggaatgtattacacgccagcaacattttcccaatatccttcacagatgtatcagtatccttttgaaggtcatcacattgatacttctgcgagcgaacatttgttcggtggtgttgcgaaaacacggcctcatttttcatggcccattatcactccttcacagcaacacgatgccccaatggcaacacctaacgccccatttgctccgcaatggaatgtacccggagcaatacctgatatgggcgacttattaggtgttgatttgcatcaggagttttttgctgaggctgagcaagtcgaagtggggagacatcgcggcagaagaaatcctgatcgtcaagcgcgaagatgggatcaaccatgtggcacatcctcacgacatcacggacaccataatgaatga

SEQ ID NO: 37300 - DNA, 2406 bp, Glycine max
  Peptide Sequence Number=SeqID_128985
atgggtaaggagaaaataccgcatcaggcgcctttccccattcgggctgggcaatttttgggaagggcgatcggtgggggccttttcgttattaccccagctggcaaaagggggatgtgctgcaaggcgattaagttgggtaaccccagggttcatgagcgttatgttacgaggctgcggaggaagttgcagtttgaggagtggaagcaagctaatcaaagaagggtgctttcagattctgaaacagtccggtggttgaaccatgcagttgaaaacatatggcccatatgcatggaacagattacctctcaaaagatattgttccctataataccatggttcttagagaagtacaaaccttggactgctaaagaagctgttgttcagcacctatacttgggaagaaacccacctttgattactgaagtccgcgttcttcgccagagtgatgatgatcacttggttctggagttaggattgaattttctcacggctgatgatatgagtgctatacttgctgtgaaactaagaaaaaggttgggctttggaatgtgggcaaaactgcacattacaggaatgcatgttgaagggaaggtcttagttggggtaaagtttctcccgacatggccttttattggccgtttgcgtgtatgctttgttgaacctccatattttcaaatgactgtcaaacctttgtttactcatgggcttgatatgactgaacttccaggcattgctgggtggctagataagctgctgtctattgcttttgaacagacccttgttgagcccaatatgctggttgttgatgttgagaaatttgtttcaccacagcaagagaaacttatggttgtcatcaaactctatccatttgtgattcttaatctcacagagtcttggttcaaggtggatgagaaggaacctgttgcttatgcaaaagtagaagttattgaagcatctgacatgaagccatcagacctaaacggattagcggatccttatgtgaaaggtcaaatgggtgtatacagattcaggacaaaaatacaaaggaaaacacttactccaaaatggcatgaggaatttaaaattcccatcataacttgggagtctgacaatgtgctggttattgcagttcgtgacaaggaccatttctatgatgatatccttggggactgttctgtgaacatcaatgaatttagggatgggcaaagacatgatatgtggctgtcgcttaagaacataaaaatggggagtttgcatttggcaataactattcttgaagataatggaaagggagttgatactacatgtgagcaggaaccaatggactttgaagaaccaaaaaactcctttgaagcaaatgagaccactgataatagttccttctcacctgttccacctgaaaaatctgagaagttggcagataactatgagcctatagatatcaaagggcaacaggagacaggagtttgggttcatcacccaggaagtgaagtttcccaaaggtgggagcctaggaaagggaagagtcggcgtcttgatacagaaattcatggggagcctaatgattcagttggcagtggtaattcaactgtatcaggatccttgaacaatgacagcagcagtcctgataataatcatgaagaaaaacatcgaatgagattggttaggaagggcctgcacaagattgggtcagtattccaccggagtcctgttggtgaggagttgctgtctccacatgataacatttctagctttcaaactggtaaggttcaggcagaagggggatcaacagaagggagtagtcctgagagccctgccagtgccaagggaaatgtcaaggatatggcaaagaatattttgaaacatgcagaaaaatcggctcgcggcttgaggcacgttctttcttgtaaatcaaggaaatttaaagatgagtctccaacagttccagaaatagaacatgaatctgactcttctgatcaggaatctgttgcagctcagtctcccatagatgtaataagaactccagttggttctcctgctgtggtctccggcagcaatggttcccccaattctggggtgaatgtggttcaaatagttccatcaaacactaatgtggacaatcaagccacaacggaaattgcaaatgaaaaagatgaccctgaaaatacatgctcctctgacagtaatagtcctgtgatcgtcaatgtcagactggttttacataaacatgttcgggtttcagatggtgctgtagtttgtaagcattcgtcggcacaggcacccaagttctctgacttacgaactgagccagggcagaatcatagtacaagtgatgtggctagttcaactctttctctggattcccaaaaccgcatactagcagcattcagtgatgatgagtaa

SEQ ID NO: 37301 - DNA, 1107 bp, Glycine max
  Peptide Sequence Number=SeqID_128986
atgttcaacgcgcgtgttcacgagcacgttgaggacgaaattaaaagtgcgcgtggaaggggagcagtggaacaaggagttcatgtcgtggagggtttggagggccatgtccacgcgctggaaggaggtgaggatagggttgagttggtgagggtggaggaagggtgtgtgagggaggttaagagggtggtggcttctttcggagtgagccagtctttgtgtttaagacgcgccagaattgcggtgtcgcggttcggggttgtggaaaattgggacagggagaacaacaagaacctcgtagagttatggttggaatttggactgatactggctgaactcacgaacggactaatcacactcaaggactcagaaaatgctttgggagttgctaggtgcacccagcattattgctggtgcacccagctacttttgaaattgccaaaattgcccctactgcctgctgtcgcggctgccccttctttctctcttttcatgaatagtgctgccatgaacagtgcctccatttactacacccagcatccgacttttaaaaatggcacaatgcttccatttgcgcattgtctctttcttttctctcttcggtgtgcaatgcttccttccttgcgattggtttggttcggtgaacggttaggttacgtgaaggtgaaggtgcattctggtgttcggtgttgcaatgatcgtcggcggcatacggcatacgagatggacggagatcagtggatgtatgaaggtataatgcctaaagaagtggatatggattatgaaaatgaagaagaatgtggtgtgaatgaaccgcatgtttattgttcggatgcgttcaatacttctcaggtgtttgacagtcgagagaatgttttgcgatgggctcgatctgttgcttatgaaaatggatttatgacggtgcttgtaaggtctgacagaaacacaggtagtagaggaaggacttcatttgtgttaattgactgtgaaagaagtggcgagtataagtgtatgaagaaagaatttgttagaagagacactgggactaggaaatgtgggtgtcccttcaagcttcgtcgcaaaccagtggttggaggacaaggctag

SEQ ID NO: 37302 - DNA, 240 bp, Glycine max
  Peptide Sequence Number=SeqID_128987
atggcaaggcaagagagtctaatgaaaagcttgtccaaagctaaaaccagtggatgctgggatcagtctaaagttggtcccaacgtcgcaagttgtagccatggtgattggaaattgatgactggttggaagaagaaagaagatgaaagaattttacaagttgagaaaaagatcaaagtggccagcggcacacccaccatgggaactaaagtgctcaagaagccctacatccaacggtga

SEQ ID NO: 37303 - DNA, 2010 bp, Glycine max
  Peptide Sequence Number=SeqID_128988
atgggaggttgtgatagtattgaatgggaggttgaaggaagcaaacgtgaaagcaacaatactaacgtacgtgagttacagaatttgcataatttgacaactttggagatatcattcaaaaatacttcggatttgccaatggacttccagttccctgcaaatctgaaaagatacaacatattgattgggatttgtcagttctcttcattatggtatggtggagctctcgaaagaacacttaagctcacagactatagttggacgagcagatcgttgttcaccacagttgaggacttgagctttgctaaattaaagggtgttaaggatttgttgtatgatttggatgtggaaggttttcctcaattaaagcatctgtatatccaagacactgatgaattgttgcacctcattaacccaagaaggttgatgaatccccattttgcattcctcaatttggagactttggttcttgacaatctacataagattgaagaaatatgtcagggtccaatgcacacacagtcttttgcaaagctaaaagttattaaagttacatcttgccatcggttgaagaatctgtttttgtattctctcacagtaaacctttctcaacttcatgagattgaaatttctagttgtgaaggtatgtcagagatcatagctgtggaaaaacaagaggatcagaaagaacttcaacagattgttctgcctgaattgcattctgtcactttacgacgtttacttgagcttcagagtttttattgttttttaaccgtcgaccagggtagtccatccaatcagagctatactttggcactgtttaataatcaacagaaaatagaagccgttagtcctacttgtaatatgacgcatgtttacattgaagttttagctgaacgagagtgtcaaaatatgaagaccataatcccatcctttgtgccatttcagtgtttagatgaattgattgtgcccagttatgatggacaggaaatttgcggaagcagtaatgagggtgatccaccacttggcgagattgcttttatgaaattggaggaattgacattgaaatgcttaccgaggctcagaagcttttgccagggaagttacgacttcaggtttccatcactacaaattgtacgtttgaaagaatgtccaatgatggagattttttgtcagagaaacataaccacaccaagcctcacaaaggtggaatatagattgagtggagataattggtatacgagtggagatcattggtatggcgaccttaatactactgttagaacagttttcactaaaaaggatcaatataatccagacttggggaaactggctatcagagacaacaatgatctgaagtccatatggccaaatctagtgactccaaattcctttcctaacctgacgaaaattgtcatttcttcctgtgaaagccaatatgtgtttcccatccatgtggctaaagtgcttcggcagctccaagttcttaaaataagcttttgtaccatagagaatattgtcgaagaaagtgatagtacttgtgatatgatggttgtttatcttcaagtacagaagtgtcatgatatgatgaccatagtcccatcctctgttctgtttcattctttagatgtattgcatgtgtactggtgtgaaagactagtaaatattataaggccatcaacaaccacaagtttgccaaacctccgcattttaaggataagtgaatgtgatgagctaaaggaaatttatggaagcagtaatgagggtgatggaccagtactggatgacattgcttttatgaaattggaggaattgacattgaacaacttaccgaggctcacaagcttttgccagggaagttacggcttcaggtttccatcattacaaaaggtacatttgaaagactgtcccatgatggagactttctgtcatggaaacttaaccacaacaagccacattgagaatatagaacaagatttgacttcatcatcagaatcagacgacagctga

SEQ ID NO: 37304 - DNA, 129 bp, Glycine max
  Peptide Sequence Number=SeqID_128989
atgagactaagggaggctggtgatgaaattcagagacaagtcttcccaaagtccggcagaatcaatctttcggtgacggatattccaactttgattcagcattcgatgagaggagaagaggagagatga

SEQ ID NO: 37305 - DNA, 3207 bp, Glycine max
  Peptide Sequence Number=SeqID_128990
gatactcaagacggtgtgcaacaccgggttgttgaggctaaaaggaatggagagaagattgaaaatattgtacagaactggctcaagaaagcaaatgaaattgttgctgcggcaaataaagttattgatgttgatggaactagatggtgtctgggacaatattgtccctatctgtggacaagatgtcagctgagcaagagttttgaaaaaatgacaaaagagattttagatgtcataaagaaagcaaaatttgataatagattttcttaccgtgatgcccctgatgtcacaattacaccattagagcgaggttatgaaacactggagtccagaacatcaatgctgaatgagattaaggaaattcttaaggatcctaaaatgtacgtgattggggtgcatgggatgggtggcgtgggtaaaaccactcttgtgaatgagttagcttggcaagtaaagaaagatggattatttggtgctgtagccattgccgatataacgaattctcaagatgtgaaaaaaattcaaggccaaattgctgatgcgttggatttgaaacttgaaaaagagtcagaaagaggaagagcaacagaactgcgtcaaaggataaaaaaggaggagaaagttctgattattctagatgacatttggagtgaacttaatttgacagaagtgggaattccttttggtgatgaacacaatggttgcaaattggtgataacttccagagaacgtgaagtgttgacaaagatgaatactaaaaaatattttaatcttacagctttactggaggaggatagttggaatttgttccagaaaatagcaggtaatgttgttaatgaagttagtataaaaccaattgcagaagaagtggcaaaatgttgtgctggtttgcctcttttgatcgcagccgtggcaaagggtttgatacaaaaggaagtccatgcttggagggttgccctaacaaaactaaagaaatttaagcataaagagttggagaatattgtctaccctgctttgaagttaagttatgataatttagatacagaggaattgaagtcactattcttattcattggttcatttggactaaatgagatgctcactgaagatttgtttatatgctgttgggggtggggcttttatggtggcgtggacaaattgatggatgcacgagacacacattacgcattaataaatgagcttagggcctcttcattattgcttgaaggtgaacttggttgggttcgaatgcatgatgttgtgcgtgacgtggctaaatcaattgcatctgagtctcctccgaccgacccgacctatcccacctatatagaactctcaaatttagaaattctttccttggccaagtctagttttgcagagctcccaggaggaataaaacatctgactcgtcttcgtttgctaaatttaacagactgcagttcactaagagtcattcctacaaatcttatatcaagtttgatgtgcttagaagaattgtacatgggaggttgcaataatattgaatgggaggttgaaggaagcaaaagtgaaagcgacaatgctaacgtacgtgagttacaggatttgcataatttgacaactttggagatatcattcatagatacttcggttttgccaatggacttccagttccctgcaaatctcgaaagatacaacatattgattgggagttgggcgttgtcttcaatatggtatggtggagctctcgaaagaacacttaagctcacagactattggtggacgagcagatcgttgttcaccacagttgaggacttgagctttgctaaattaaagggtgttaaggatttgttgtatgatttggatgtggaaggttttcctcaattaaagcatctgtatatccaagacactgatgaattgttgcacctcattaacccaagaaggttggtgaatccccattctgcatttctcaatttggagactttggttcttgatgatctatgtaagatggaagaaatatgtcatggtccaatgcagacacagttttttgcaaagctaaaagttattgaagttacatcttgcgatgggttgaagaatctatttttgtattctctcacaggaaacctttctcaacttcatgagattgaaatttctagttgtgaaggtatgacagagatcatagctgtggaaaaacaagaggatcagaaagaacttctccagattgacctgcctgaattgcattctgtcactttacgaggtttacctgagcttcagagtttttattgttctgtaacagtcgatcagagcattcctttggcactgtttaatcaacagggtcaatttccaaactcggagacagtggaaatgagcatcaagaatgatcgggaatcaatacggcctaatcaagtgcctccaaattcctttcatcacaagctgaagattgacattagtggctgtgaaagcatggattttgtctttcccatatctgcggctacagagcttcggcagcaccaatttcttgaaataagatcgggatgtaatgagctagaggaaatttgcggaagcagtaatgagggtgatggagcagtactggatgagattgcttttatgaaattggaggaattgacattgaacaacttaccgaggctcagaagcttttgccagggaagttacgacttcaggtttccatcactacaaatagtacgtttggaaaattgtccaatgatggagactttttgtcagggaaatataaccacaccaagcctcacagaggtggaatatggaagttacgactacaggcatatgctgagtgacggtcctccaaattcgtttcattgcatggatagtacaggcatgaagaaaataactgtagagaagtgtacaggcatgaagaccataattccatcctgtgcgctatttcagtgtttagatgaattgattgtgttcagttgtcatacactggtcaatattataaggccatcaaccacaagtttaccaaaactccgcattttaaggatatgggattgtaatgagctagaggaaatttgcggaagcagtaatgagggaattgacattggaatgcttaccgaggctcacaagcttttgccagggaagttaccacttcaggtttccatcactacaaattgtacgtttgataaaatgtccaatgatggagactttttgtcagggaaacataaccacaccaagcctcacaaaggtggaatatga

SEQ ID NO: 37306 - DNA, 180 bp, Glycine max
  Peptide Sequence Number=SeqID_128991
atgaagtctgaacgcataaacagaaacgcacctcgaacagacgccggaaactttgttgaaggatgtggagggaacgtcggtcgaggagggcgagtctccccgggatcctctcctgcagccgcgtctccagccctctccaaccagtttattttggacccttggatcttcatatacggatag

SEQ ID NO: 37307 - DNA, 609 bp, Glycine max
  Peptide Sequence Number=SeqID_128992
atggctactgaagatgtaaaggtgaaaattgaaaagttcgatgttttgcatagagtcaagaagaagaaattcaataagaggatatgcacttggaaaatcaaaggaaagaaggtccaaattcaagaatcattgaagttctcacaactcgaagactatcgagtgtttgaattttggaagaactggacactacaaaaacccgtgcaagacctaagaatcaagagaaggtgtagtggtctacatcatgtttgtacaattgttgtggctaaggagcttcaacagctccaagtgcttgaaatagggaggtttgaaaatatagaaaccattgttggaaagagtgatagtggtgatgcacaagatgagactgcttctacgaaattggaggaacagaaagctagaagtgagaataagggtgatacgttaggtgggtttgcttctatgaacttggaggaattaatacctagaaatgggaataaaggtgatgctccaggtgagatagttttcacaaaattagaggcattgttcttgatctccttaccaagccttacaagcttttgcaaggcaagttacaacttcaagtatccagcacttgatgtagtaatggtgatttga

SEQ ID NO: 37308 - DNA, 252 bp, Glycine max
  Peptide Sequence Number=SeqID_128993
atgatttcttgtttagccaggccccattacaagccaataaaagtccttagtgatccaccaagtgtcgcaaaatttcaaacgttcaccccagacacttgtgtgcagagagaaacactacccttgataaaacctgtaacaagagccgaagctttgataacagatgatgtgatccttactaggagcggattgcttgatacaagttacagagttaggatgatgccacttccagtgagggaagataagtcagggtag

SEQ ID NO: 37309 - DNA, 65 bp, Glycine max
  Peptide Sequence Number=SeqID_128994
atgatgaaagaaaaggggatggagatagatacatggactgagatgagaaaggttatgcgaaagag

SEQ ID NO: 37310 - DNA, 5145 bp, Glycine max
  Peptide Sequence Number=SeqID_128995
tacaaggggctggcgatggatgcgatagctcatgtcccagatgtttctgaaatagctcatttgccgggtgtttctcaaattgctactgtgattacatttattaaggatcaaattgggtacatatcctcctacgaggaaaaccttgaaaagcttatgaccgaggttcaacgtctgaaggatactcaagacggtgtgcaacaccgggttgttgaggctgaaaggaatggagagaagattgaaaatattgtacagaactggctcaagaaagcaaatgaaattgttgctgcagcaaataaagttattgatgttgaaggaactagatggtgtctgggacaatattgtccctatctgtggacaagatgtcagctgagcaagagttttgaaaaaatgacaaaagagatttcagatgtcataaagaaagcaaaatttgaaacaatttcttaccgtgatacgcctgatgtcacaattacaccatcttctagaggttatgtagcactggagtccagaacatcaatgctgaatgagattaaggaaattcttaaggatcctaaaatgtacatgattggggtgcatggcatgggtggcgtgggtaaaaccactcttgtgaatgagttagcttggcaagtaaagaaagatggattatttggtgctgtagccattgccgctataaccaattctccagatgttaaaaaaattcaaggccaaattgctgatgcgttggatctgaaacttgaaaaagagtcagaaagaggaagagcaataaacctgcgtcaaaggataaaaaagcaggagaaagttcttattattctagatgacatttggagtgaacttaatttgccagaagtgggaattccttttggcgatgaacacaatggttgcaaattggtgataacttccagagaacgtgaagtgctgacatacatggaaactcaaaaagattttaatcttacagctttactggaggaagatagttggaatttgttccagaaaatagcaggtaatgttgttaatgaagttagtataaaaccaattgcagaagaagtagcaaaatgttgtgctggtttgcctcttttgatcacacccgtggcaaagggtttgaaaaaaaagaaagtccatgcttggagggttgccctaacacaactaaaggaatttaagcatagagagttggagaataatgtctaccctgctttgaagttaagttatgattttttagatacagaggaattgaagtcactatttttattcattggttcatttggactaaatgagatcctcactgaagatttgtttatatgctgttgggggttgggcttttatggtggcgtggacaaattgatggaggcaagagacacacattacacattcataaatgagcttagggactcttcattattgcttgaaggtgaacttgattgggttggaatgcatgatgttgtgcgtgacgtggctaaatcaattgcatctaagtctcgtccgaccgacccgacctattccacctatgcagatcagtttcgcaagtgccattatattatatctgagtatttgactaaagtcccagatgataactttttctttgggatgggagaagtgatgactttgagtgtatatgaaatgtccttcacccctttcctaccctccctcaatcccttgataagccttcgctcattgaatctaaatagttgtatattaggagacataaggatagtggcggaactctcaaatttagaaattctttccttgggggggtctagtattacagagctcccaggagaaataaaacatctgactcgtcttcgtttgctaaatttaacatactgcgattcactaagagtcattcctacaaatcttatatcaagtttgatgcgcttagaagaattgtacatgggaggttgctataacattgaatgggaggttgaaggaaaaaaaagtgaaagcaacaatgctaacgtacgtgagttacagaatttgcataatttgacaactttggagatatcattcataaatacttgggttttgccaaggaacttccggttccctgcaaatctcaaaagatacaacatattgattgctaatcatatgctggcatacaacatattgattggtagtgatagggggaaatgggagttgtcttcaatatggtatggtggagctctcgaaagaacacttaagctcacagactattggcagacgagcagatcgttgttcaccacagttgaggacttgagccttgctaaattaaagggtgttaaggatttgtatgatttggatgtggatggttttcctcaattaaagcatctgtatatccatggcaatggtgaattgttgcacctaattaacccaagaaggttggtgaatccccattctgcatttctcaatttggagactttggttctttacaatctatataagatggaagaaatatgtcatggtccaatgcagacacagtcttttgcaaagctaaaagttattgaagttacatcttgccataggttgaagaatctatttttgtattctctctcaggaaacctttctcaacttcatgagatgaaaatttctagttgtgaaggtatgacagagatcatagctgtggaaaaacaagaggatcagaaaaaacttctccagattgttctgcctgaattgcattctgtcactttacgaggtttacttgagcttcagagtttctattgctctgtaacagtcgatcagggtaatccatccagtcagagcattcctttggcactgtttaatcaaaaggtggtgactcctaaacttgaaacattggagttgtatgacatgaatgtatgcaagatatgggatgataaacttctagtcctttcatgctttcaaaacttgacgcgtttgatagttgtcaaatgtaattgtttgacaagcttattcccatctggagtggcaagagtactggtcaaactacaacatgttgagatttcctcgtgcgaaaggctgaaagtgatatttgcccaagaagagaaaatagaagccgttagccctacttgtgatatgacgcatgtttaccttgaagttttagctgaaatttgcggaagcagtaatgagggtgatggaccagtactggatgagattgcttttatgaaattggaggaattgacattgaaatacttaccgaggctcacaagcttttgccagggaagttacagcttcaagtttccatcattacaaaaggtacatttgaaagaatgtcccatgatggagactttctgtcatggaaacttaaccacaacaagccacattgagggtaggatgggattagctggaactagtgtagagaatagtagccactcagctgcctatagttttttcggcttttcttttctacacattttcgcaccatcagtcattattctcaaatatgaaatcttggtgaattccatcgccacattaattttcatgaatgtgattgtgtctattgtgtttaactttggagagatagagcatgaaaatgcaactccttatgtgctattatccaactggtttgcagctgtgaagaagattgttggtggcttagaaatacagaatctaaggggaaaaaaaactccagccaccgccaccacactgcccttgccacttcctccactgtcaccaccaccacaaaacattacagcctccaccaccaccaccaccagcgtcttgcctcctctcttctccctcctcacattccacggcaactccctggtccagtccaacgctaaccccgacctccttgccgccttcaagaccggcggcgccaagctcctctacgagatccacctcctcagcacctcacagtgcatcgccgccgcatccttcctcatcgagaatcggtgtgatgggaaggccgcacaggagctcgcacatgcaatgaaggatttccctagcaagcgcggggataaggggtgggagagcttcgactacactctcgagagagattgtctttcttttatgtattattggcagagtagggagcataggaacccatcggagcagaggacttcagcgctagagcaggggttgggcgtggcagagatggaggcggcgaggaatgtgattttggaagagttggaggggaagggtgtgtctgagaagaagatccaaaaacagacggtgtccctaatggcagcgtcgttcaggtggatattacaactacacaaggatgttccaaaagccgcacgcttctactccgaaggcttggacttcagcatcaatgtctgcagccttcgttgggccgaactccaatccggttctctcaaggttgccctcgtgcattctcccaatgagcagcagcaagccacacagaaagggtactcatcgcttctatcatttactgtgaatgatatgaacaatacagtaactaaattaatggcgttaggagctgaactagatggacccatcaaatatgaggtccatggaaaggttgcagctatgcggtgtattgatggacatgtcttaggcctctatgaacccggcgaggatttacttagagaaagtggcattccctatgcaatcgtgaggccttgtgcattaacagaggagcctgctggtgccaatcttattttggatcaaggagataatattacgaagtatcaagaaaaggttgctagcaaatccaagaaaaagtccaacaatcttgcttgcattcaagctaaagatcgtacgacaggaagaacagagattgcttcttgtgtcaaggttgttgagattagagtgggtgcccatatatatcctcaaaatccagttcttcacattggaagtcctttcaacctaagcataaaaggtttgagtgatacagtttctggacagtggtttaccacaaatggaagtgtaatatcagttgatacattatctgggatggccaaagctattggggaaggttgtgcacaagatccagttgaagctgactcatgcaaagagcatttagttccacttgcggatatggtgaacacatgttacaaagctgcagggaatcatgtgttgcctaacttagcagtcaagagacacgtgcaaatgggttctcaccaacaagaaccatggctattgcagaatgggaaaccaagggtgttgaccaaggagaccaggcatggccgttctgcacacagaatgtcctccacctctttgcgcaagaaatctagctga

SEQ ID NO: 37311 - DNA, 339 bp, Glycine max
  Peptide Sequence Number=SeqID_128996
atgcaagagaggggtttataccttctaatgacgagagcaatgtggtgttcagaagatgacggcgattgcaggatgaggggttcagacttcgacgtcgacgggggcacgatagtcttcagaagactattgcaattgcaggttcaatacgatgaggtgacaacgacgcgtgcaatcactaaccatacaatgacagttttcgggactagaccgtctttatatggtaataataaatttacaagtctgccaccgaacaatattcaaagacaggttcgcgcaaacgtcgttgttttgttcctgttaattacgaaaatgtcaccgccacactttcaaccgtcttag

SEQ ID NO: 37312 - DNA, 366 bp, Glycine max
  Peptide Sequence Number=SeqID_128997
atgactaaggggcaaaccacgcagatgccattcaatatgtcaccccaaaacatgacagtgccacaaatggctggtatacgacactccactatgacagagaaccccatacccacttggactgaggtgagaatgactgcccctcaaaccatagatgctaatatgatagcaaattcaatttcaatgccttccaaggttattttgatgatgccaaagaatcaagagttaagcaaattccaaagattcaagaatcaactttcaagtttcaagattcaagattcaagaatcaagtttcaagaatcaagatttaagaataatcaagatcaagattcaagaattaagagaagactcaatcaagataagtactaa

SEQ ID NO: 37313 - DNA, 756 bp, Glycine max
  Peptide Sequence Number=SeqID_128998
atggcttgtgcagagatgcatgggagggttgctgttgctagggacctgtttgaccggatgcctgagagaaatatggtttcattgagtgcaacgatagatgggtatatggggaaatgtttcattcaagaggtgaatgctaggtcgttgcccggaagcaacgcgctgtatggctcgagtacagtgtcaaaagagcaagggccgctgcatcgctgcccggatgtagtgaaaagtaagcaagggttcccacattttcgtgaacgggtgtgggtaaagaagctagttcatgacagaaggattcgctttggtacatggaatataggcacagttactggaaaatctatggaaatagtggatgttatggtgaggaggaagatcaattttatgtgcctacaagaaactaagtggacaggtgaaaaagcgaaagaattagacaactcgggatttaagctgtggtatacgggaaaaatcagatcaagaaatggggtagggattattgtggacaaggagtggaagaaggatgtcgtggatgtaagaagagtaggagatcgtatcatagccttaaaattggtagtgggacaggacacctttaatgttattagtgggtacgcacctcaggttgggttagcagaacactttaaggtaaaattttgggaggatctagaaggggtacttcaggatataccccaaggagagaatgttttcctaggaggggatctcaatggacatgtaggtagcgtggctagaggttttgagggg

SEQ ID NO: 37314 - DNA, 153 bp, Glycine max
  Peptide Sequence Number=SeqID_128999
atggcacatcacgctgcaatcagacctcaagaagcaaaggaatccattgatgaagaagatccaaggcctacaagctccacatggagctacatcaagaatcgtctcattaggtttagagaagcaaagacccagagacattttattgtcgtttga

SEQ ID NO: 37315 - DNA, 225 bp, Glycine max
  Peptide Sequence Number=SeqID_129000
atggaagatattgaagccttttctgcaacaaatagagcaaaattggatgaagcagaacttgccaaatctgttcctgacaatatatgtttggagataattagaacaattagcacatctactgctcatgttctaactagctcatgtgaatgtaaagcagaaaacaaattaacagatgcaagtggatcaagagacattggattgtttcaggttaaccaatggtcttga

SEQ ID NO: 37316 - DNA, 204 bp, Glycine max
  Peptide Sequence Number=SeqID_129001
atggcgctaaagaacgaagaggtagagcaaggacccaagttctcaacttttagagagattagggagcttttgagtgattgtgaggtgcaaagaggtggaggagacatcccccctcctgtgaactttagcattgggaagtgtattgtttccttagaacttgataaagcagggctagataactgcattgctagggatagggtgtag

SEQ ID NO: 37317 - DNA, 367 bp, Glycine max
  Peptide Sequence Number=SeqID_129002
atgaacacgttaagcgagttcattgctcctgttgaagattttgatttccaaatgaacacgctaggcgtggccctatggcttcatgaaagaggaaggcaacaacttcattactccaggccagatatgacagatccagatttacatacgaagaggcctgggaccgttgcacggataatagagttggagaggagaaactggcataaagagctcacaaacttcgcagatgggagcatagatgtggcagtagtgaaggagttttatgcaaatctctatgaccttgaagacacatcacccaagcaagtgaggcctcctagcttattccaggtttgccagattgaggctagatctagaagagctggtagtccgt

SEQ ID NO: 37318 - DNA, 171 bp, Glycine max
  Peptide Sequence Number=SeqID_129003
atggacaataaaggctctaagctaggggtggagagccctgggagaactggagctgctactgaaggaagagcagatgaagatggagctgatgctcaagctctcgaaattcaaagaatcagatgtgacttcctaggccttgcacaaggcagtgatgagggcagaaaaacctag

SEQ ID NO: 37319 - DNA, 507 bp, Glycine max
  Peptide Sequence Number=SeqID_129004
atgacgcaaaagatcaaggaccaattggaggagtcgatcacagaaaaagatgttcgaatgaaggcacaggccattcaaaaacaaaacactacccctcacgtgttgtctcgtgagggttatgaattactagaaaagaagttaatatatgagaagaaaaagaaacaactagaggaagttgctaaatttggaagtactaacaccttgattgatcctccctcttccatcagacgacacgtgaagtggaagatggcccgcaccaagaaaacttaccaaatgacatgtgaggcaacaaaggaaattggtgacaagattaattccttggaggagcaggtctcacagggttcctttgtctcctatggatgtcaggatctccaaggacctgccacatttcttcttccacgactcccaagacctagagcaatgacgcaaaagatcaaggaccaattggaggagtcgatcacagaaaaagtgactcaacaactaatgttgtccttcagccagatgtag

SEQ ID NO: 37320 - DNA, 246 bp, Glycine max
  Peptide Sequence Number=SeqID_129005
atgaagcttaccttgacaccaacatcgacagtggtagcgagattggccataagtggtagtgagaacaaagagtcgcgacgtggagagtttgtgatggagaggaacacatatacggaggcacgagactcaaatgttatgaaccgtgaatggatgagttgcgatgaagaggatgacgcgggcgacactagagttgcaacagagagaaagatatgcaacaaagtttttagtagtaaagctttggagtga

SEQ ID NO: 37321 - DNA, 330 bp, Glycine max
  Peptide Sequence Number=SeqID_129006
atgggtgagggaatcccaacgagaggtttacctaggagcctacttgaatcaagccatgttcaaagtggaggctatgagtgtggctattatgtcatgcattggatatggaacatagtaagcgggggtttgaagaatgattggcccatgtggtttggagatggcacaacattagacaacaagaccataacaataattcgctacaaatgtgcagcttattttgtaaaagtcaacgaacttgaggttcgacaaccacatttaccctctcagatgcctgaagcaagaaggctctcagagcattacttggattggggaactggagaaccagtttga

SEQ ID NO: 37322 - DNA, 372 bp, Glycine max
  Peptide Sequence Number=SeqID_129007
atgccttctacaattgaagaaaacgaggtggatgacgtacaagcaaatcataatgatcatgatgaaggtctatcggagaacattcccatggtcatgggaacaccgccaaggtcccctctgcattcagaaggtcattcagaggtgacgtccaagaagagtagacaatcgacacagttaagaaggttgaccttaaggagcttacatcagccaagactgattgttcacgtcgaccctgcaactgggagaggatcaggcccacaaaaacaaaagttccacaactatctaggggttgtagctcgagaaaagattcctattgtacatgacaattgcaattggaaacatgttcctgaatctctgaaagacctagtatag

SEQ ID NO: 37323 - DNA, 3936 bp, Glycine max
  Peptide Sequence Number=SeqID_129008
atggatgcgatagctcatgtcccaggtgtttctcaaattgctaattatgtgattacatttattaaggatcaaattgggtacatatcctcctacgaggaaaaccttgaaaagcttatgacccaggttcaaactctggaggatactcaagttcttgtgaagaaccgggttgctgaggctgaaaggaacggatacaagattgaaaatattgtacagaattggctcaagaatgcaaatgagattgttgctgaggcaaagaaagtcattgatgttgaaggagctacatggtgtctgggacgatattgtccctctcggtggataagatgtcagctgagcaagcgtcttgaagaaacgacaaaaaagattacagatcacatagagaaaggaaaaattgatacaatttcttaccgtgatgcgcctgatgtcacaactacaccattttctagaggttatgaagcactggagtccagaacatcaatgctgaatgagattaaggaaattcttaaggatcctaaaatgtacatgattggggtgcatggcatgggtggcgtgggtaaaaccactcttgtgaatgagttagcttggcaagtaaaaaaagatggattatttgttgctgtagccatagccaatataaccaattctccaaatgtgaaaaaaattcaaggccaaattgctgatgcattgtgggatcggaagcttaaaaaagagacagaaagtggaagagcaatagaactgcgtgaaaggataaaaaagcaggagaaagttcttattattcttgatgacatttggagtgaacttgatttgacggaagtgggaattccttttggtgatgaacacaatggttgcaaattggtgataacttccagagaacgtgaagtgctgataaagatggacactcaaaaagattttaatcttacagctttactggaggaggatagttggaatttgttccagaaaatagcaggtaatgttaatgaagttagtataaaaccaattgcagaagaagtggcaaaatgttgtgctggtttgcctcttttgatcacagccttgggaaagggtttgagaaaaaaggaagtccatgcttggagggttgccctgaaacaactaaaggaatttaagcataaagagttggagaataatgtctaccctgctttgaagttaagttatgattttttagatacagaggaattgaagtcactattcttatttattggttcatttggactaaatgagatgctcactgaagatttgtttatatgctgttgggggttgggcttttatggtggcgtggacaaattgatggaggcaagagacacacattacacattaataaatgagcttagggcctcttcattattgcttgaaggtaaacttgattgggttggaatgcatgatgttgtgcgtgacgtggctaaatcaattgcatctaagtctcctccgaccgacccgacctatcccacctatgcagatcagtttggcaagtgccattatattagatttcagtcttccttgactgaagtccaagctgataaatctttctctgggatgatgaaagaagtgatgactttgattttacataaaatgtccttcacccctttcctacccccttctctcaatctcttgataaaccttcgctcattgaatctgagaagatgtaaattgggagacataaggatagtggccgaactctcaaatttagaaattctttccttggccgagtctagttttgcagacctcccagttgaaataaaacatctgactcgtcttcgtttgctaaatttaacagactgctatgatctaagagtcattcctacaaatattatatcaagtttgatgtgcttagaagaattgtacatgggaggttgcaataatattgaatgggaggttgaaggaagcaaaagtgaaagcaacaatgctaacgtacgtgagttacaggatttgcataatttgacaactttggagatatcattcatagatacttcggttttgccaatggacttccagttccctgcaaatctcgaaagataccacatattgattagtgatctgggggaatgggagttgtcttcaatatggtatggtagagctctcggaagaacacttaagctcaaagactattggcggacgagcagatcgttgttcaccacagttgaggacttgagatttgctaaattaaagggtattaaggatttgttgtataatttggatgtgggaggtttttctcaattaaagcatttgtatatccaagacaatgatgaattgttgtacctcattaacacaagaaggttgatgaatcaccattctgcattcctcaatttggagactttggttcttaagttgctgtataagatggaagaaatatgtcatggtccaatgcagacacagtctcttgcaaagctaaaagttattaaagttacatattgcaatgggttgaagaatctatttttgtattctctcacaggaaacctttctcaacttcatgatatggaaatttctcattgtagaggtatgacagagatcatagctatggaaaaacaagaggattggaaagaacttcaacagattgttctgcctgaattgcattctgtcactttagaaggtttacctgagcttcagagtttctattgttctgtaacagtcgatcagggtaatccatccggtcagagcaatactttggcactgtttaatcaacaggttcaatttccaaactcggagacagtgaaaatcagcatcatgaatgattgggaatcaatatggcctaatcaagagcctccaaattccttccatcacaatctggatattgacatttatgactgtaaaagcatggattttgtcattcccacctctgctgctaaagagtttcatcagcagcaccaatttcttgaaataagatcgtgtggcataaagaatattgttgaaaaaagtgatattatttgtgatatgacgcatgtttaccttgaaaaaataactgtagcagagtgtccaggcatgaagaccataattccatcctttgtgctatttcagtgtttagatgaattgattgtgtccagttgtcatggactggaaattggaggaattgacattggaatacttaccgaggctcacaagcttttgccagggaagttatggcttcagggaaacttaaccacaccaagcctcacaaaggtggaatatgaagggatacaatatgtttggcattctagtaaactgagtgaagatcattggtatggcgaccttaatactactgttagaacagttttcactaaaaagctccaagttcttaacataagctggagtaccatagagaatattgttgaagaaagcgatagtacttgtgatatgacggttgtttatcttcaagaaatttatggaagcgataatgagagtgatgcaccacttggcgagattgcttttatgaaattggaggaattgacattggaatacttaccgaggctcacaagcttttgccagggaagttacaacttcaagtttccatcattacaaaaggtacatttgaaagactgtcccgtgatggagactttctgtcatggaaacttaaccacaaccaaccacattgaggtgcgatgcctacatggatggcgttatgaagaatcagaagatcagtgggatggtgaccttaatactaccattagaacaattttcactaaaaagggtaggatgggattagctggaacttgtgtagagaatagtagccactccgctgcctatagttttttcggcttttcttttctacacattttcgcaccatcagcacgtgaaatcttggtgaattccatcgccacattaattttcctgaatgtgattgtgtccattgtgtttaacattggagagatagagcttgtaaatgcaactccttatgtgctattattcaactcgtctgcggctgtgaagaagattgttggtggcttagaaagatag

SEQ ID NO: 37324 - DNA, 582 bp, Glycine max
  Peptide Sequence Number=SeqID_129009
aaaccgctcgctcgaacccacaaaaccccctatcgaagaaaattcgaagaaaaccctacactgctcttggaactgtggctcgaagaaaaccctagatacactcctccgctaggtactagcttgctgaaacagtcatgggtgctcaaagctcaaagctttctccgcgagatagagggtaatatggagtatgttgaagaagctaatagagcagctggggctatagtgaggttcaagaaagttgtttcactcctaaatagtggtttgggtcatgcaagagtacgtttgactgccattgtcgctgccattgtcgttgttgggtttgagtgtcgtggtgaccgtcgtatcattccaccagtgttgtcgatctccaaggctcgaaccaccgtccttccacttagctgcgtaattgcactcatcggctcaagctacgaccgcagcacgcctcaaccactgccagttaacaaggtatgcgctctacctcagtttgttgctcttcttagtaagttcttaatcagtgcggtgggattgatactgttttctttgggacaaccatttttggaccttaatcggttctcttcttag

SEQ ID NO: 37325 - DNA, 399 bp, Glycine max
  Peptide Sequence Number=SeqID_129010
atgactaatgcaaactgtccccaagaatcattgcattcagtctcaaacgggaatctaagggtttgtgtgtgtttgattagggttataggagtagttatgggtgatactcatgaaaatgctaagattgcatcaaaaaaagttcatgttgagtatgaagagctcccagccatcctttcaatacgggatgccgtcaatgctacaggtcagtgtgaccgaataattgaaggggaaattcagatgggagaaatcaattcaagaaaccagtataggcaaacatgggaagctggtgagcaaagtatgccatatggtacacaaaatgctcactcccaaggcttttcccagcctttggagtgcaaccccacattgcagatagggtacaaccctgaagcctcagagtag

SEQ ID NO: 37326 - DNA, 738 bp, Glycine max
  Peptide Sequence Number=SeqID_129011
atgtcttcctcagagggtgtcgttgaattgggaattgagttctcagaagccaacaattttcttctcatgtctctaatggaagaaacacaagaagaagagtacgacggcgatgatagacttgtgagcatgattcagtcattggaggcagagatcagtgacactgaaatgagtcaaatgtatgagatgagtcacgtggatgatcaagattgctctacgtcagtcagtggccctgatcattgggttgacatggaattgatctcttctttgacctttgatgggatgaatgcatggattccttgtggagatgagatgatggagcatgcagcaatggaatatgaggctggaaatgacatcaatgattttcaattgtgttatggagttttcttggagcaacaatatagagagactaattatctggcacaagggccatctgagtttctggtagggaagcctcctcctggtgttatgcctctattgtctcatgagtccagttgcgttctcggcttctatctcaatccatttcacaatcttgatcctggtagtgcactcttcagtgttgtgaccagccacccgatgatagcaacaatacttgaacttgtcaactcttgtcgaaccgataccttggtcagtccgagctggttgttggatcaatcatacagtggtccgattctacctacttcgactaaaccaattttcatagaaactggtgacttagttgagtcttgtgacccgaactag

SEQ ID NO: 37327 - DNA, 897 bp, Glycine max
  Peptide Sequence Number=SeqID_129012
atggcagaaccatcaaagaagcgcaaaggttcttcgagtagaagccaacggcacttcgaggctcaggatattccaattccttcctccatttcctcctcctcattgttctcattagaagaacaacgtacactggatgatgattggaaatttgatttttctgtgcatgatgcccgccggttggtttgcaccagccaagcggatatgatcggaaggctgcttgtcgattcattggctcttgaaagccgcatccttcactattttgttgttcgtatgttactccctagatcttcaaaccttgcacaggtttctgaagaagatctaatagtcatgtgggcctttcataccggccgacaaattgattgggcacatttagtccgcatccctcttgattctgaaccatatattccaatcaagagatctttcttgatcggtgctgctgcggttgcgtcctttggttaccgcaaagagcgtgatgactcttgggtaaaaaaggttgctcaaccaaatgatgatgaaggacaattatcggttgaaggggactcttctctccttcagagtattttggacaggttcgatggactccaaacctatgttggtgaaaggtttgatgctttggaacaacaagtggacatgcgatttgatgcaatggactcaaggatcacaaacgttgaagaatatgtcaccatcattcgcgactgccttgatttacctccaccaccaccatcaaacaagagagggtacatctcttgtggattagttcaagtggagggtacatccacttggttgttcaaagagaacaagggagggtacatcccttgtggatctttggcttgtaaaggattttacaaggttgaaagaaatctcaagaaccgcaggttgcttggggactggatgtag

SEQ ID NO: 37328 - DNA, 1032 bp, Glycine max
  Peptide Sequence Number=SeqID_129013
atggttagggctagaggcttaggtcgtgccttaggtagggttattggcagaggtctggggagagagaatcgtgatgattcagatgatgcttcccaacggcgaaggcctacaccatcagcccgtaggcaacgaaaatctgtccttgttgccgcggatgagcctgtggtacctgcggaagagcctgtcgtaggtacaaatgagcctgtggtagatgcgaacgtacatgcaaaggctgctgtagatgagcctaagggatttccaggtggaccgagtgacccatcggtgcttattgagtatactgagcatgttacaaccagcgtatggagcggggagcggcctgaattgaagttgtcctcccatgggaggaaggggcagaaattaggtaggtttgttcctgcaattgaggggttagttgctggcacaggactaagtcctttgatcgcatgttcaatagacactggcgatcagggacttatatcctcgtttgtggagaggtggcacagagagaatagtagtttccatcttcctatgggggaggttaccatcaccctagacgacatggcgtctcttcttcatcttcccattgtcggcgccttccatatcttccagcctctacaagtcgacgagacggtgttgatgttggttgacttactactggtctcaggagaggcagccagggctgagacaacacattgtcatgaaccatactgttggatacatgagcactttttgtcagttgcggagtgcatcgctgatccggactatgacgaggtgtcaccatgtgcatgtcggtggattgctacgaagaagaccgtgaagatcatatccatagagacgtacagtccaagagtttcatttgatttcatgcttttccggtcagctccgctgggtgcccgctgctgtcagacactgaacagagagggtcatgcaccagtaggggtgggtaagtgggccagcctgccccgcgtaaggcctgcccgcattggcagtggaccgggtcagttcaccccgcttcttacatggactaaataa

SEQ ID NO: 37329 - DNA, 4314 bp, Glycine max
  Peptide Sequence Number=SeqID_129014
atggatgcgatagctaatgtaccgggtgtttctgaaattgctaattatgtgattacatttattaagggtcaaattgggtacatatcctcctacgatgaaaaccttgaaaagcttataaccgaggctcaaactctgaaggatactcaagacggtgtgcaacaccgggttgttgaggctgaaaggaatggagacaagattgaaaatattgtacagaactggctgaagaaagcaaatgaaatggttgctgcggcaaataaagttattgatgttgaaggaactagatggtgtctgggacattattgtccctatctgtggacaagatgtcagctgagcaagagttttgaaaaaattacaaaagagatttcagatgtcatagagaaaggaaaatttgatacaatttcttaccgtgatgcccctgatctcacaattacaccattttctagaggttatgaagcactggagtccagaacatcaatgctgagtgagattaaggaaattcttaaggatcctaaaatgtacatgattggggtgcatgggatgggtggcgtgggtaaaacaactcttgtgaatgagttagcttggcaagtgaagaatgatggctcgtttggtgctgtggctattgcgaccataaccagttctccaaatgtggaaaatgtccaagaccaaattgttgtagctatatgtggtaaaaatcttgaacacacgacaaaagtaggaagaatgggagaattgcgtcgaaggataaaagcacagaacaatgttctcattattcttgatgacatttggagtgaacttgatttgacagaagtgggaattccttttggtgatgaacacaatggttgcaaattggtaataacttccagagaacgtgaagtgctgataaagatggacactcaaaaagattttaatcttacagctttactggaggaagatagttggaatttgttccagaaaatagcaggtaatgttgttaatgaagttagtataaaaccaattgcagaagaagtggcaaaatgttgtgctggtttgcctcttttgatcacagccgtggcaaagggtttgagaaaaaaggaagtccatgcttggagggttgccctaaaacaactaaaggaatttaagcataaagagttggagaataatgtctaccctgctttgaagttaagttatgattttttagatacagaggaattgaagtcactattcttattcattggttcatttggactaaatcatatcctcactgaagatttgtttagatgttgttgggggttgggcttttatggtggcgtggacaaattgatggaggcaagagacacacattacacattaataaatgagcttagggcctcttcattattgcttgaaggtgaacttgattgggttggaatgcatgatgttgtacgtgacgaggctaaatcaattgcatctaagtctcctccgatcgatccgacctatcccacctatgcagatcagtttggcaagtgtcattatattagatttcagtcttctttgactgaagtccaagctgataacttattctctgggatgatgaaagaagtgatgactttgagtttatatgaaatgtccttcacccctttcctacccccttctctcaatctcttgattaagcttcgctcattgaatctaagatgtaaattgggagacataaggatggtggcaaaactctcaaatttagaaattctttccttggaggagtctagtattgaagagctcccagaagaaataacacatctgactcatcttcgtttgctaaatttaacagactgctatgaactaagagtcattcctacaaatcttacatcaaatttgacgtgcttagaagaattgtacatggggggttgcaatagtattgaatgggaagttgaaggaagcagaagtgaaagcaagaacgctagtttaagtgagttacagaatttgcataatttgacaactttggagatatcaatcaaagatacttcggttttgtcaaggggcttccagttccctgcaaagctcgaaacatacaacatattgattggtaatatttcagaatggggtcggtctcaaaattggtatggtgaagctctaggaccctcaagaacgcttaagctcacgggctcttcgtggacgagcatatcgtcgttgaccacagttgaggacttgaggcttgctgaattaaaaggggttaaggatttgctgtatgatttggatgtggaaggttttcctcaattaaagcatctgcatattcatggtagtgatgaattgttgcacatcattaactcaagaaggttaaggaatccccattcatccgcattccccaatttgaagtctttgcttctttacaatctatatacaatggaagaaatatgtcatggtccaattccaacactgtcttttgcaaagcttgaagttattaaagttagaaattgtcatggattggataatttacttttgtattccctcgcaagaaacctttctcaacttcatgagatggaaattaataattgcagatgtatgaaagagatcattgctatggaagaacatgaggatgagaaagagcttcttgagattgttctacctgaattgcgttctctcgcattagttgaattaactaggcttcagagtttctgtttgcctcttacagtcgatatgggtgatccatccattcaaggaattcctctagcactgtttaatcaacaggtggtgacccctaaacttgaaacattgaagttgtatgacatggatatttgcaagatatgggatgataaacttccacttcattcttgctttcaaaacttgacacatttgatagttgtcagatgtaatagtttaacaagtttattcgcatcctggatgggaagaggattggtcaaactacaatatcttaatatttactggtgtcaaatgttgaaagccatattcgtccaagaggaaatttatggaagcaataatgagagtgatgatgcaccattgggcgagattgcttttaggaaattggaggaattgacattgaaatacttaccgaggctcacaagcttttgccagggaagttacgatttcaggtttccatcactacaaattgtaattattgaagaatgtccagtgatggacactttttgtcagggaaacataaccacaccaagcctcacaaaggtggaatatagattgagtagagataattggtataggattgaagatcattggtatggcgaccttaatactactgttagaacagctttcactaaaaagtatctatatgatgactgggagacgctagatatcagaaacaacaataatttgaagtccatatggcctaatcaagtgactccaaatttctttccaaacctgacgaaaattgtcatttatcgctgtgaaagccagtatgtctttcccatctacgtggctaaagtgcttcggcagctccaagttcttgaaataggcttgtgtaccatagagaatattgtggaagaaagtgatagtacttgtgaaatgatggttgtttatcttgaagtacggaagtgtcatgatatgatgaccatagtcccatcctctgttcagtttcattctttagatgaattgcatgtgtccaggtgtcatggactagtaaatattataatgccatcaacaatcgcaaacttaccaaatctccgcattttaatgataagtgaatgtgatgagctagaggaagtttatggaagcaataatgagagtgatgaaccactgggcgagattgcttttatgaaattggaggaattgacattgaaatacttaccgtggctcaaaagcttttgccagggaagttacaacttcaagtttccatcattacaaaaggtacatttgaaagactgtcccatgatggagactttctgtcatggaaacttaaccacaacaagccacattgaggtgcgatgcctatatggatggagtaatgaagaatcagaagatcattgggatggtgaccttaatactactattagaacaattttcactaaagagtgttatatgagtgggaatgggaagggtgggatgggattagctggaacttgtgtaaagaatagtagccactcagctgcctatagcaattcttcaatcattgtcaaatatgaaatcttggtgaattccatcaccacattaattttcatgaatgtgattgtgtccattgtgtttaactttggagagatagagcttgcaaatgcaactccttatgtgctattatccaactcgtctgcggctgtgaagaagattgtggatcagaaagataaggttcatatgtttcttgcagtgaggggatcaatcacaggaatattgaagtga

SEQ ID NO: 37330 - DNA, 600 bp, Glycine max
  Peptide Sequence Number=SeqID_129015
atggtgttaaagtctagccctttctcggatagtcagtgcaagaaacaactggcaacattggaggagttgagagcaagggatgtcagattcatccaaagggaagacatgactagtttctgtgagaaattacatggagagtcattaaggaaaccaatagaacgagaggttaagactaggagtagttgtagtagaggaaagtctagagcagatagactggctcggtcaagtcaaacccaagtagatgtaccctctacttgtaccacaaaggatgtaccctccaatgtgttgagacaaagatctcaggctgttaaacctttgatactttgtgaatggggatacaaaagaattctcaggcgggagaaggaagacacaaaagaattcaggcggttagtccttcgttcttttggaaaagggagaagaaagacacaaaaagaattcaggcagttagtccttggcgaattctttttggcaaagggagaagagaatgaaaagatgaatagcacaagttttcaaggtttagaaaaccagaaaacttcaaaaagattttggtacaaagaagaagaagaagttcaaagagagtcaaggcttgtaaaggattga

SEQ ID NO: 37331 - DNA, 153 bp, Glycine max
  misc_feature (76)..(76): n is a, c, g, or t
  Peptide Sequence Number=SeqID_129016
atggaaaaatttgacaagaaaaccttcaaagacaagaaaggaaagaaaacttacatcacttgggaagataacgatntggattcatcaggagattcagaaaatgaagtcatgaatctaagtttcatgcccaaaaattatgaaagtaacgaagag

SEQ ID NO: 37332 - DNA, 720 bp, Glycine max
  Peptide Sequence Number=SeqID_129017
atggctgctgctagtactatgatcacactcaagttctcattcctctggagtctccttctctcagtttcactcttgggtgtaaagtcatcacatagccaccaaaatggtgggagaagaacaattcctccaacatgcaagcgcattgagtgccccacccatgatgtgattgaagtgggtgatggctatgaaatccgacgctataataataattcaactgtgtggatgtcaacttctcccattcaagacatttctctggttgaagctacaagaactggcttcaggagtctatttgattatatccaaggcaagaacaactacaagcaaaaaattgagatgacagcgcctgtgatcacagaagtttcacctagtgatggacccttttgtaaatcctcatttgttgtcagcttctttgtgccaaaattgaaccaagcaaaccctcctcctgcaaagggtctccatgtccaaagatggaacaatatgtatgtggcagcaaggcagtttggtggacacgtaaacgattcaaatgttgcggtggaagccgctgtgttgcgagctagtattgaaggcacaaaatggtctggtgccattgacaaaaaccagaaagctggccatgcttctgtttacactgtggcacaatacaatgacccttttgaatatcagaatagggtgaatgagatatggttcttgtttgaaatggaaagtgaaaggcatgcaatttga

SEQ ID NO: 37333 - DNA, 168 bp, Glycine max
  Peptide Sequence Number=SeqID_129018
atggccaaatttggaatgtcttcatctgtaggcatgttggctacagccggggatgggaatggcatggatgtaaggtaccggggatggtatacgtgcattaattggggatggggatggtgtggatgtggaggtggtgtaagtgcaacatcgaaagatctgactgcatag

SEQ ID NO: 37334 - DNA, 420 bp, Glycine max
  Peptide Sequence Number=SeqID_129019
atggcgagtttgctctgcgaaagccacgtggcctggaaaccaccagtggtgatggcaattcaagcgcaggtgcaagtcgccagtttctctggcgagtctggtcacaggtttccagtttcacttttcagagggaggcacatggttgaagcttttccagaaggcacgtttttcaggtacacgatgaattcggttatgatcgtgttgtatttcaatggaagggtatatgaagataatgatggtgtaatatttgaaggcagtaaaaaagcgattcagattaaacgtggaattagtttcaatgctttcaagaaaaaaattggagacaagtgtcatgaaaatatattgccttgcaaatttgcgatgacgaagacgttgaaacgatgctggaaagttttaaacaacaacaagaaatgtcagttctag

SEQ ID NO: 37335 - DNA, 702 bp, Glycine max
  Peptide Sequence Number=SeqID_129020
atgaaatcacgatttcatttgttgaaagtttttggtaatataacggaatcaagatttcattgtgctgcgggtcaatggattggaatacatttatatctgatgtggttacaatgtcacctggatggggaaataaggatgatggaagtcaaggattttcaagagcaagataatttgttaaattgggctcaacctgtgaaaaaggagcataggacccaaaccgccagaaccaatggcgagtttggtgtccttgagcaaatcgccagcaccaatggcgtttcgtgcatgcagagacgaaaccgccagtccaaatggcgatacggtttgcgctttgggaaccgccagtcaaactggcgagttccatggcctgaggctgcagggctacgtccctgccatggcagtgcagtgctgcaggtgcaggcgaaaccgctattaccattggcggtttgccttgcacagggattgccaagaaaacgctattaccattggcggaagaagcttcgtgattgcactgcacttccttcctttgcttccattgctttgctattcttcttccttatttcctcttatttggttgctgttgccttcttcttatttggttgctgtcttttgtttttggggtgtgctttgtttcagtcttggtacgtgatttctctcctcttcatattacgtgagttctctgtgcttgatttagttggaatgtga

SEQ ID NO: 37336 - DNA, 753 bp, Glycine max
  Peptide Sequence Number=SeqID_129021
atgggagagaggaaggtgttgaacaagtattacccaccggactttgatccgtcgaagcttcccagagcaagaaggccaaagaaccagcagatcaaggtccgcatgatgcttccaatgagcattcgatgcaacacttgtggtaattacatctacaaaggaaccaagttcaattccagaaaggaagatgttattggcgagacatatctgggaattcaaatattcaggttctactttaaatgcactaagtgctcagctgaggttaccatgaagactgatccgcagaattcggattacatcgttgaatctggtgcaaccagaaattttgaaccttggcgtgcagaagatgaagaagctgataaaacgaaggagaagagggatgctgaagagatgggagatgctatgaaatcattggagaatagaaccctggattctaaaagggagatggacatccttgctgcattggatgagatgaagtcaatgaagtctaggcatgcaactgtcactgttgatgaaatgctggaggctctgcagcgcacagcagctgacaagtgctatctcagtagtgcttttggaaccaaaatactgaattcagacggttttgtcagaagaattcgtgatgaagatattgaaacagaggagcaattggatcagttttcaaatggacatggcgaaacatccagttctaatactaagaaacagagagaaagagaagaagagagagcgagagagaaactggaatttgtggaattgtaa

SEQ ID NO: 37337 - DNA, 354 bp, Glycine max
  Peptide Sequence Number=SeqID_129022
atgggaagctatataccccagctgctgttgatctcttcaggatacttggtgagcaagtacaaattgttcgggataatagcactgatctcatgttatacagaattgccttggcattcattcaggaaaataaaggcaaactggacagaacttggaagtcggaaagtgccaagatgtgcttctaagggtttcatagtaagagcgtgtttgctttgtcgtttgaaatgcaatggcacaaagctcaacacactttcaccgcagaagcaaggaagaggatgtttcctggaaacaaaggttggtactaaacggaagttggaatcgaaaattcaaaatgacactaagtgcatgtttggatga

SEQ ID NO: 37338 - DNA, 480 bp, Glycine max
  Peptide Sequence Number=SeqID_129023
atggagttctctgttatgtttgatcgcaccttgtcctttgtggtgttcttgccctttggattcacttttactcatcatgtgcaacctatcattgaagaagtggagtctattgttgaagctgaagttgatcttgatgtcatggctgtcaaagtatatgatcctctaccctcaagggtgtatgttagattagtagaggctaagctactaaagatgagagaagcacttgcacaagatagtgattatgttgagaaagaaactatgaagtggcatttgattgccgacttcttccacgagaaggccactggttatgaatttccatcccctttaaatagtcatgtctttccttctcttattgatctttcatcagagtctaatgattctggtgatgagttcttgaagaagttggatgaggagtttaatgttaccatacctcatacatctgtgtttatattatcagacaatataagagtcttgccatga

SEQ ID NO: 37339 - DNA, 486 bp, Glycine max
  Peptide Sequence Number=SeqID_129024
atggcacatgcacaacctggacttattgatggctcgttgttgcgcttacaagacaaccatattttgaatcaagtgtgggaaggccaacagagaatcattcatctgagagctcatatcatgaagctgataggcggttgtttgatgccaaatacatcaagtgcaaaagttcattttatgtatctccttttattttcaaatttgactgaggcatgggatcgcattaaatgtattaccccgaagatagataacctatcagtggaagaagtacaagaaggacttggatttcctcttacacgaaagtggtctcatccaacgatcgaaacaaacattcacgccaattcagttagattaatgcacgtcatatttgataggctacacatgaattattatcttgaccatcaccaacatcaatcatatgttaaatccaatgtacctctagtgcatgtttctggatatatgccacaacattatcaatcacaagcataa

SEQ ID NO: 37340 - DNA, 1149 bp, Glycine max
  Peptide Sequence Number=SeqID_129025
atggcacattctcctaataagactaagtccattgatggatcaagagaaacacttaaacttgctgtaaggatcactgatctttggttcatttggatccctaacaagtctgaacaagccgaaatgggagatgaaatccatgttcttggtaaaaaagatcagctaaagtcttggaaggatgatttgaaggaaaattttacttatgtcatgcataattttaaagtaatgaagaatgatggtcaattcagactctgtgatcatcaatataaattagcttttactgaagttactgttgttaggcaatccgatttggatcaccttccttttaggaaatttagatttgctgatttttctaatgtcattgctggtcatttccaaactggtctcttggtgctatcttgcactctttgggaagattgctgcttgcagttcttagcttatttgaatgaggttgaaaatgataggcccatcattattcttttgacgcatgctagaatcaaagaagatcagggatcatatccatcctcggtgagtaattctttgaaggtgtccaaactaatgatcaatgaacttgtgttagaaatacaagaattcagtgagaggctttcagatttagaaattgaggttaggtcagttttcacatctcttggccaagggagttcacagctttcaggatcaagtcaattatcatcaaagaatgcatttctttcaaagtctgaggcaaaaagtatttgtcagattaatgccatttcgaaggatggcgatgttgatttaaatgcttctcctcaagcacttgataggctactgggttgtgtccttgcatttaaagtcaagcttcaaccaaagttcaggaattctattgttcttaaatattcaaatgaattagatttgatcaatgttgtcctgaatatgttgcctaatactgaggcatgttccaagattgatagttcaatcctacactccaacgatgctacacaacttgaatttcaatttatgtctgtcatagcagatcatgacccacttctaagcattccattaacaccgacaaagcgcctatcatctaatgaattggatgatgaaccaagaagctctcaaattttacccgcacaactttcctctaacaaattagcaagacattgtcagattgaatga

SEQ ID NO: 37341 - DNA, 633 bp, Glycine max
  Peptide Sequence Number=SeqID_129026
atgtcttccaaggttattttgatgatgccaaagaatcaagagttgagtaaagtattaagcaaagattcaagaatcaagtttcaagtttcaagattcaagaataatcaagatcaagattcaagagtcaagattcaagaatcaagagaagactcaatcaagatatgtgcattggacgatgattggaagtttgatttttctgtgcatgatgcccaccggttggtttgtaccaaccaagcggatatgaccggaaggctacttgtcggttcattggcatttgaatgcctcatcatgcactacttgattgtgcgcatccttctccctagatcttccaaccttgcacaggttttcttaaccggtcgtcaaatcgactgggcccatcttttgagatattgcatgcataaggcattgcgatcaaatactccactcccatatcctcatttgattactttgtttctacaacatttcaatgtctctcttgactctgagccctttgtcaaagtcaaaagatccttctctataggtgtaaatgtattttcctccttcggttaccgtaaagagatggatgattcttggataaagaaggatgctccagtacaagccgctgaagatcgctctccatcaccacattcttag

SEQ ID NO: 37342 - DNA, 192 bp, Glycine max
  Peptide Sequence Number=SeqID_129027
atgaacctccacggagctgtcttgcttggccagtttgacagtgagcttgcagtagtcggaggggcgacgaccgtcgactcagagaacttagacgatgtgcgtgtggttgagggacaaaatgtgcgtgaggtggggagaaaatggctgaagaacaacacaatggctcagagaatgggtgagggccgggagtag

SEQ ID NO: 37343 - DNA, 827 bp, Glycine max
  Peptide Sequence Number=SeqID_129028
atgaaagtcgcaggtgccttgggagccaagacagcactagcctgcgatagctgcgtaagcagaaggccaaggtggttctgtgcagcagatgatgctttcctctgccatgccagcaacactttggttcattccgcaaaccagttagcaagcacacatgaaagggctcagcttcaaactgcatcctctaagatcatcatcctcagccactactgcacaaccacaccaccaacaacttataaggaattgaattttgtagacacaaatgtcactgtttcacggacactggaaactgacattgatattgagaatgagcaaatgaagcacgccatggctgtggctactgccactacagtaccagctcatgctgcaatggcagctatagctgctgtgatccttttgacttctgctgccaatggaacatctaaaagcattgaagaggctgctgccatcaaaatccaatcttcctttcgctctcacttgctatttcactttctaaggaatcgagttttgtctttgagatttaatgttgttggcacaagtaataggtcacttggtgaaaaaacaatcgaaggcaacactgacatgcatgcaggctttggtcacatgcaacacaagtcagacctcaggaaatacccacattggataaagactcctggtttaaggattgatgtgaatttgggagtttcaaagcaggaccaacatccactaaggatggaactgttgctaactggtgaacaaccacctgagaagcagattgagaagcatgagcagacaagacagtcaagaattgttgaggagaagcaagtacaacagttaaagagtctaag

SEQ ID NO: 37344 - DNA, 855 bp, Glycine max
  Peptide Sequence Number=SeqID_129029
atggaatacgcaaaaaagcacaggaaatacaaaaattcaacgactctccctacttactgtctcatggaggatatggtcgtcgcccctccatcccccattgcaagacatgtcaagtggaagatggctagaacaaacaaatatggccaaatgacatctatagcagctcaagaaatctttgacaaaattgaacaaacaacacatagaacatttgtcccacatggtcgtcaagacattctcaacactgtgcttggcagtccaaagcatcctggtcgtgttcgtgtagctggacatggtgtcaccataggtaatttttggacagcatgccagtggctccaacaattctttggcaatgatcaccccatatcaattggtggaaatcataggaaatctaaagcaagagtggaggagagagcccttgttagaccacttaaccctgatgtattggttgcacgtgttagcaccaaagaaagttgtgttgaagctgctgcaaatgttgttgctaaggaccggtctgcagttgatgaaactactatgggcaaacgtgttgatcaggtagaagttgctgctgaatctagtggaattgccgtgggaagggagccaatttggacttccaaatattggggcaaaatttttcacacacatgctgatgtagcagaaataatatcaggtcacaagtgtttaagcatatctatattgcaattttggatcatgatgagtgcggtagaagcagaggtgatgggtcactgtatggtttccttgagcctcagtcgatacacaatgctaaggacagatgtgaacaatgcgaacaatacattcaaacatgggtcaaggaatcacaatgacaattgtacttag

SEQ ID NO: 37345 - DNA, 513 bp, Glycine max
  Peptide Sequence Number=SeqID_129030
atgatatttattgtgtcatttgaattgaaggtaattgattgccgaatttgtggtgatccacattctgttctccgttttgcttttgttgagtttgcagatgagtatggtgcaaggaccgctctaaatcttggtggtactgtgcttggatactatccagtcagggttcttccttcaaaaactgccattcttccagtgaatcctacattcctccctaggtcagatgatgagcgtgaaatgtgtgcccggactgtctattgtacaaatattgataaaaaggtttctcaagctgaagtgaagaatttttttgaatcagcttgtggcgaggttatgcgcctgaggctcttgggggaccacgtgcattcaactcgaattgcttttgtggaatttgcaatggctgaaagtgctattattgcactaaactgtagtgggatgctcttggggacccagccaataagggtgagtccttcaaagactccagtgaggccaagggtcactcgtccggcgtctcattaa

SEQ ID NO: 37346 - DNA, 1316 bp, Glycine max
  Peptide Sequence Number=SeqID_129031
caatgtctgggtcgatggtggcattgggtggagggtggatttacatgggagaggtaggggacatgctaggtgtacctagcaacattgttgctgctatttccgtttgtttgcgaaacctctgtggtgtcgttgctgtgtttctggcgtcgagacatggaaattgtctgaaaatggcaaagatgaaaggttctgaaactcctggaagaacttcttttggtagcttctccggaagaagttcttctggagaagctactggaagaaggttcttcttgaagaataactttttcttccggaagaaccttcttctggtagcttgttcggaagaaggttcttctggtcgtgctttagctagggttatagggcgaggtagacaggataagcatgatgcaattgatgttgcccggaggcgtaggcctactgcatcagcccgtaggcaacatgtacatattgtggttgatgagggtgttcctcaagtgattgaggatgtccttcatatggctgacgatgttcctcagacgagtaaagatgcacctcagatgacttcggacgtagatgcgactgttgcagaggacttaggtcgtgatagtgctaaggggtcacatgctgatgagggattccttggtgggctccatgacccatcagttctgacttcatttgcgaagcatgagtgtcttgagctgaatttggtgtcgcacgagaggaaggtggtgttaattggaaggccagtgcctgagattgaagggctggttaccaccacaagattaagtccattgatcgggtgttcagttgtaaccgacgatcctggacttatatccgtatttgtggagaggtgccacagggagaccaacaccttccaccttccagtaggagagttgacgatcacactagatgatgtgttgtcgctcctccatctctctatcagtgacgccttccacaacttcgaggctctttccatggacgaggcaatatttttgttgatggagttgcttgaggtgtccgatgagatgccagacacgacgatggattgtagcagctcgtgcttatctcctgcagctggctttttgcgacctgggttagagtgggggctatgcttggggagctacgaccctgaccatgaggactatatgcagccagacattctagaggttatagtggcatttgatccccctcgacatgcagtggcgatcgcagaaaggttggagtgtgtgctcaatcttaggagggtcactgcagggacagagttacatgatatcttgcaagattgcctgaggatcgttagggggggtgctagcgcaaatggaagtgttagggattga

SEQ ID NO: 37347 - DNA, 270 bp, Glycine max
  Peptide Sequence Number=SeqID_129032
atggtttccccacacaaggccccaaaaaagccacccatcacctttaccacatctgatttcaaggcgatatatccggttcaggacgatccagtggtgatcagtgtcgagatcaacaacaaaacctatagttcaaagaaaaagaaagatggaggaagaaaggtgtcaagcagtatggcaagaagtctccaaattgctaacagctcgtattttccaagaaatagactacacaacatggcctgcaaatgtcatcatggtcaaaaaatcgaatga

SEQ ID NO: 37348 - DNA, 90 bp, Glycine max
  Peptide Sequence Number=SeqID_129033
atggaagagtgtccctgcatccatggcccattagctctcgaaggcaagctagtgttgaaggcacatggagggcacaatcagcagagttaa

SEQ ID NO: 37349 - DNA, 435 bp, Glycine max
  Peptide Sequence Number=SeqID_129034
atggaaactagcataagatatgcccttgcaatgagcaattacataagatatgcccttgcaatgagcaattacataagatatgttcctataggactcaacactcaaacatctaaagtgggctggttgttacttccagcacttcctaagttgcttcctacactcttttcagaatattttttgaccttccagattggtcattccataagcaaaaaagggagtgcattcccaaatacaaagagagagcccaagaagcaactgaaaagtgcagaaagcaatagccctcatccaagtgcaccaaaagaccaaaagaccatggctaatagagcccatttagtttcttcaagccatgtgcacactaggaaaaataattatgagaaattttgcagaacgtttcaaattttcaatcacactccaaaactcaactaccatgattag

SEQ ID NO: 37350 - DNA, 600 bp, Glycine max
  Peptide Sequence Number=SeqID_129035
atggtaactaaaaagccagtgggtgggcacgtgcagctgataaagcaactaggccgtgttaggtatgtagaagcagaggctccctcctttccctcaagcccctccaaaccggcttcccctccgacacttcgactcccacttcatcttcaacaagctctgccaactctccctcatccgcaatccccacattccactctccgcctaccaccacatcatcaacgtgtccctattgtgatggcatcaaatctgttggccgacgaggaaggagttgggccccccttggagctgctttgtaagacattgtatgcgtgggaggaggccgtgtccccactcttggccacagagagggagggtttggtcccgaaggactcgacggtgctggaaactcttggtgaatgtctcaacgatgtggcggaatggggggccagtaaggagagactgttggtgaagttgccagtccaggaccttctggctcgcttcgatgttacttgtacagcttttgttggggatgggaggctaggaggcatttctggaacaatatcagcttatgagagtccactgatgttgtggatgttgtttttgaggatcacgatcttctaa

SEQ ID NO: 37351 - DNA, 726 bp, Glycine max
  Peptide Sequence Number=SeqID_129036
atggcattcttaggagaaacttcctctcagacgatcgtcaactcaaggttggccttcatttttcaaaatggatccgtcattcacaacgagtgtgggatttattttcaaagttcaaccccagtacccatgcgagtaccaaacacgtgcgattttgcaactcttaaaagcaggatacacaacacccttcagctaaatgacaatcaagttgtggatgaaattcattaccggcaaccactcgaagatacagataacaaaattcacttccaatgtatgcaattgaaagatgacatggatgtgaacacaatgttaatgtgtaatgatcgattttcatgtgttggaccgattgagttgtcatgcactgctagtagaacaccagatggaatattaaacttacttgaacgcactatgacctctactcatgatgtggttctgtattacaacggaaggtggaacatgccacgccaaaacaactttgtaggttacgcgttcacgagaaaaaatccccaaaaatttgatattccaaaaggatgtaccatatatgaactgaaggatttgatcaagcaagtagcacctaaaggaaatcctcttcatgggattcatgaatcccaacttgtattggtagagtccaattactggaaacaatttatgccaatagaaattttggctctctttagtaaaccggttatggaaaataaggacgaggtggttacgtcgttgcaggattga

SEQ ID NO: 37352 - DNA, 1887 bp, Glycine max
  Peptide Sequence Number=SeqID_129037
atggaaaaaaaggcaaaagggtacttgacagtgaggggtacgaggaaggggtcaatgttgccccatgaacttcctgtagcttctcaactgatacctgcaagctttcgttcattttcttcaacttgggctactaccaatggagcccttcatgtatcagcacaaaggtggaactgcagtgcgtcttcttgttgtttccgtgtcagggaatgcagatgcaaatggaaacgggttctcagatgctgctccaccactgttatgaatgggaagctacgtgcgcaggccataaggaaagcatgcaacctgctgcatgaagcattcatagcgaggaagttagttaggaagtgtcaatgctctcaatcccttggaattgattttgagagtacccgcaaacgtttgttgagcttgttcgatcctgagagaacccttccttcatttcagcaaccaccatacgaagcttccatggctgccgtccatgattgccactcgccgtacggagcttccaccttccactaccaccaccccttccctagtcattctttccacacagccaaccaccagcaaccatgtccacaacacccattcccttccatgtccaacacaagcaagcacgaaggatctttgactcacctcgaggctgtcctcactcgtcttgacgagagcatgcactccatgaatctaaagatagatgaactcctgaaccgttttccccctgccactccgatctcaaatgcaaacccaataccagttccacacccctaccacgctgctcctgcaaacaatcacaggatcaacttagaaggaccatggaccgacggcacagcaccacaccttcaagaagagaagctttcggaatgctgtccgtggactccgtctccgccaccacctccaccgccggctccgtcaccacctccgccgtcacctccattggtcgcactcatacagccgccccccacaaccttgcccggtccgcttcccattgtgattgtttccctcatcaccaacagcaaccctcacatgtcctctgacccccgcgggatcaccattctcggagtccgcaaggagcacttcagccgtggaaaggagctcgaccactccttccccctcaccttttacactgcaaaatggttagacttccgcaacactaacctccatctgctcatttcttcacccattttaatttgggatcctggttcgaatgttgaagccatggtggcacttggttctcgaaatccaagtataacattgagcaggttgcatgctttccttatgggctgcacacgtagcttcccattcataacaaccactgagtttgttattgccagtgatgacaactatggcaagaagcaggtcgttagtctcactcccttcctctatgactatgtcctaaaaaatgttcgagaaccagaggcaattgcgacaggagacgacctctatgcttggaagtcagatgtcgttgcccggaagcaacgcgctgtatggctcgagtacagtgtcaaaagagcaagggccgctgcatcgccgcccggatgtagtgaaaagaggattcgctttggtacatggaatataggcacacttactggaaaatctatggaaatagtggatgttatggtgaggagaaagatcaattttatgtgcctacaagaaactaagtggacaggtgaaaaagcgaaagaattagacaactcgggatttaagttgtggtatacgggaaaaatcagatcaagaaatggggtagggattattgtggacaaggagtggaagaaggatgtcgtggatgtaagaagagtaggagatcgtatcatagtcttaaaattggtagtgggacaggacacctttaatgttattagtgggtacgcacctcaggttgggttagcagaatactttaag

SEQ ID NO: 37353 - DNA, 117 bp, Glycine max
  Peptide Sequence Number=SeqID_129038
atggagtcttgtataatcagaattgatgcacgaaagttggaagagtgggctggagttcaaaatccaacttctcttgttgagttttcatccaaagaaggagaagctgagaagatttaa

SEQ ID NO: 37354 - DNA, 318 bp, Glycine max
  Peptide Sequence Number=SeqID_129039
atggtgctcatctcttcattttcaccaccaccttcacctacctctctcttctctcttatcacaaaacagacattttcttcacttcatttctttataacatttcattgtgagatgaccaagttgagaagttcaaggctcaccatggaggttgctccaccaaggtttgtgtcggtgacccggtgccgggtgaagaaaatgctggacaccattaaggaggaagagaatgattttgctgctgacaaacgcttctcttcaccatcttgtggctcttcctctctaagccttgtagagaggccagttttgttgaagaacttctag

SEQ ID NO: 37355 - DNA, 843 bp, Glycine max
  Peptide Sequence Number=SeqID_129040
atggcagatgaggtggttctgctagatttctggccaagtccatttgggatgagggtcaggattgcacttgctgaaaagggtatcaaatatgagtacaaagaagaggacttgaggaacaagagtcctcttctcctccaaatgaacccggttcacaagaagattccggttctcatccacaatggcaaacccatttgtgaatccctcattgctgttcagtacattgaggaggtttggaatgacagaaatcccttgttgccttctgacccttaccagagagctcaggctagattctgggctgattatgttgataagaagatatatgatcttggaaggaagatttggacatcaaaaggagaagaaaaagaagctgccaagaaggagttcatagaagcccttaaattgttggaggaacagctgggagacaagacttattttggaggagacaatctaggttttgtggatatagcgcttgttccattctacacttggttcaaagcctatgagacttttggcaccctcaacatagagagtgagtgccccaagtttattgcttgggccaagaggtgccttcagaaagaaagcgttgccaagtctcttcctgatcagcaaaagctgggtgcatccaagatgttgaccaaccaggctaatcatcaaaaggagacttgttataacatatatggcatcaacccttatggaatgagggtccggattgcactagaggaaaagggcatcaagtatgagaatagagaagagaaccttagcaacaagagccctttactcatccaaatgaacccagttcataagaaaataccagttctcatccacaatggcagacccatctga

SEQ ID NO: 37356 - DNA, 456 bp, Glycine max
  Peptide Sequence Number=SeqID_129041
atggtggtgcagtcttgggtggaggatgtctcagatctgggtcttgtggagaaaaatcatgatcatttaagggagaagaacatgggcattgctcttaaccaactggacgtccttgattcaagaatcgccggtgtagggtccgacggtgatgttggagccgggaaggaccgtggagtcgtcgacctcggattgcttgaatgggaaagagggtggcgaaaggagaagagagaggagaacttcgatcgacctcgagggagagattggctcagaacgcaccgaagcagagtcaataagtgcacgaggaagggcagagtgatggaaaacttggagagaggtcgagggagaatgagaaccaagaacaattgcaaagaggtacgacagagtgtagtggggaacttagagatagagaggtcgagggagaatgagagcgcgcaaagaatagctgcagagaggtag

SEQ ID NO: 37357 - DNA, 384 bp, Glycine max
  Peptide Sequence Number=SeqID_129042
atggtgggactagctctcaaatcagccatatcaactagtgatgatagtgaaggagaagatgcagaaggatcaaaagctgaaaatctaactttgctcaaaaaacaaaatgaagaaaaacctggctacatagcatggaaagaaaatgcttcaagctcttcaagtggaagtaatgatgaagaggaagaaaatctctaccttatggccaatgaagaagttgatagcaatgtaggtgcatccgattttgatcaacttcttgatgcttttaatgaaatgcatgaggaagtacaaaaattatctcttgctaataatttccttaaaggaaagctaaggtggcatcctagcaacttatgtggtatcatggcaacggatgctcaaggaatatga

SEQ ID NO: 37358 - DNA, 2999 bp, Glycine max
  Peptide Sequence Number=SeqID_129043
gaagatcaattttggggtattctcttacatccccagatttggtcatttgtggctcaccagatattgctggaatcagctatggtgattcccctgagttgttgaagaacaaacattccaaggatgtggagcaatctatggagctttctctagagtatggaatcaaggggtctcaagttgaagctgacaatggccataagatcccaaccgttaaattctcaaacttttgtcaagcttttgagcaagaggaagagctgctatcccctgaagcctcctttgagcttcttccacctcttgtaaccaagaatgagtcaccccaagatctccctcttagagatactgagatgctagaagacattggagtgtctcaggaggcagaaatggagtcctccgaagtatgcctctttgtgaatagggatagatttgctgttttgagcaggaaaaatgataccgaggatattgggatggaagcgaagtttaagaggctgaaaagagactttgacagtcagagaaaggagctgacggaaacaaggagggagttgggggagatcaagagagagaatcaacagaagagtagagaatgccaagaagcttggaactccttgaaagagcttcaaaatgagctaatgcgcaagtccatgcatgtaggatctttggcatttgccattgaggggcaagtgaaggagaaaagtaagtggttttcatcactgagagacttgacgaggaaattgaagattatgaaaatggaacacatcaagctattagaggaagcagaggcaagcaaaaaatatcaagcagatatgagagaaatggggcttattattaagtccaaaataaatgaacagctggagtcacatgaagatctcaagtccaaatatattgaaggggctacggaacggaaagatctttacaataaggttttggagttgagaggaaacataagggtcttttgccgttgtaggcctctcaacaccgacgagatatatgcaggagcaacagtggccttagattttgaatctgcgaaagatggtgatttaactgtaatgtcaaatggagctcctaagaggactttcaagtttgatgctgtctttggtccccaagctgagcaagctgatatttttaaagacacagcaccatttgcaacctcagttctagatgggttcaatgtatgcatttttgcatatggtcagactgggacaggaaaaactttcacaatggagggcacagaagaggctcgaggtgttaatttcaggactcttgagaaaatgtttgacataatcaaggagaggcagaagctctactgttatgatatttctgtaagtgtcttagaagtgtacaatgagcaaataagagatttgctggtagcaggaaatcatccaggaacagctgcaaaaagacttgagataaggcaagctggtgaaggaatgcatcacattccagggttggttgaggcacatgtgaacaatatgactgaagtctgggaagtcctacaaaccggtagcaatgcgagggcagtaagctcaaccaattccaatgagcatagcagccgatctcactgcattcactgtgttatggttaagggggagaatttgttgaatggggaatgcacgagaagcaagctatggctggtggacctagcaggcagtgagcgagtagcaaagacagaagtgcatggcgatagactaaaggagacacaaaatattaataggtctctctctgcacttggtgatgtcatatcagctcttgcaacaaaaagttcacacattcctttcaggaactccaagcttacacacttactacaagactcattaggaggagactcaaaggcactcatgtttgtacagatcagtcctaatgaaaatgatttgagtgagacaatttgctctctgaactttgctagtagagtaagaggaatagaattgggacctgcaagaaagcagttagacactgttgaacttttgagacacaaacaaatggttgagaaagtcaaacaagaggtaaggctgaaagatttgcaaatcaagaagctggaggaaacaatccatggattggagtccaagatgaaggaaagagacagtaagaacaaaaatctccaagagaagtcttcctttccccaagtagatggattctcttggacttcacttgcgaatgtctcatcattgtccgttttcacttctaaggtcaaggaactggaatcacaacttctggttgagagaaagctggcgcgtcaacatgtagactcaaagatagctgaacagcaccaaatgaaacatcaagaagagcaaaacaatacacttctgagaccagcacttgcaagtagaccactaggaagtctcaagaatttcaatgatccagttagtggtgggtggttcaaagaccaacaaataaattcagctaaaccactcactgagaacaacatcttgaaacctcgtatacctttttctacaatggagagctccatcaagtgcattgatcatgctgagaaagaaaacaatcctgacatggctgacaaagccctactgccaaaaaggcctggaagagcttctatctgcatgatgacaccgcgtgttccttcagctgttgcttcaaggagaaactctctgattccactcccaagtatacctagcttaacacagttccaatcaccattattaccaaagttaacaaaccaatttgatcagaaggatgccaatggggaatcagaaaccaactgtgtgcctgcacagactcattgtgagagtcccaaagaagttagaagtggtgctaagaggattggtagcatactaagaagaagccttcacaagaaaatacaggttaagtctccacttcagcagcacatgaggaaggttggtgtaaatgtagggatggagaaagttagagtttccattggaagtagggggagattggcaccaagggggcaagtaggatctggtagaagaggaggagctaaagatattcaacaaaagaatagtcaaaaggagaaggaaaggggatggatataa

SEQ ID NO: 37359 - DNA, 369 bp, Glycine max
  Peptide Sequence Number=SeqID_129044
atgtggctatgttggaaaaacaaggttggagacttttgtctaaacctaattcttctggagggaggattctcaaatctatatactatcctacggaggacttcatggatgcatctcttggtcactacccatcgttcttatgacaaagtgtggggaactgaggaggagccttggcttcgaaagcaaggccatagatatgtggaaactcctatggtggagggtttggaagatatgacagttgctgacattgttagtcatcaaaatgattcgtggaatctggatatcattaaccagattcttatccctgatgatattattgatgtcactcacactattgtgccatctttgatggctgatgacaagcttaaatga

SEQ ID NO: 37360 - DNA, 309 bp, Glycine max
  Peptide Sequence Number=SeqID_129045
atggcatatgggaagtatgctgacacattattgatggctatagcacaagacaatgttaaccatatcttccccgtagaagaagagacaacttcagtgtgggatgtctataaatctaccaatgttgatcgatctcatgaactatgtgtcgctactatttattttactgaacatcacgcctacgaaaacttctttggtggtttactagcacgtgaaaatgtgacaaaaattcaaaggagatcagtggggtatgatccaaggagaagtacaaagaattgtctgagttcacatctcgcattcccatcaaaatag

SEQ ID NO: 37361 - DNA, 153 bp, Glycine max
  Peptide Sequence Number=SeqID_129046
atggtacctatcagatggggaatcagagacaacactggtgaaaaagaaggctttctaccaaatttatttttgttaaacccatgccttttgaaggacttagagaaaggctttgagcaaaatcagtccacgaaggagacaattttgaaatcatga

SEQ ID NO: 37362 - DNA, 504 bp, Glycine max
  Peptide Sequence Number=SeqID_129047
atgggagatgctgggtttatgctggagtttgttaagtttctcaatgcaaagtcattcgaggttcgtgaaatggcagccgaggcactgtctggcatggttatagtgcctagaaatagaaagagttgcactagtgggaggaaaaagattgttagttctggatatgccaaaaacatagaaaaacttgcggatgctgaagtttcttctgatgctaacagacttgtcaagaaattttctgcaggatacgctgccattgttgttaggccattagccatggcagattgtaccaaagaatgttccaaaaatattatagtgtatgcttttgtgttgtgctaccacatgttgaagacatcaatccttggcaagcatatagtgatagatgaagtttccatctgtattgcttttccttgtagtaaggcaatgtcttttggctatagctacttcctagttgttaatgaacaatgtgagcacgtggcaattgccaattgttcatatcatgttgcctga

SEQ ID NO: 37363 - DNA, 498 bp, Glycine max
  Peptide Sequence Number=SeqID_129048
atgggtttcaatttgatagggagctccatttttgcaatgattttcataattggtgtgactgaagctacaaattacacggttggtgacagcttcggatggagcgttcccagcaacaagagtttctatacagactgggctagcaccaagaaattcttcgttggtgacaatcttattttcaactggaacgggaatcattcgataaaaattacgatgaagactattgactacgagagttgcaattccagctggtttgatgctctcacgtacctggtcacaaaaaatgggacggctatgtctatacatactattgatgctccaattgggtatcgctacttttactgcatcgttggtaatcactgtgaattaggtcagaagtttagtatcaacgttcagtctcattctggttcttctcctgctcctgctcctgcaccctctttcggaatcttatctgcatttttgtctagcttggctgtgtatttcttcacccttacccggtag

SEQ ID NO: 37364 - DNA, 243 bp, Glycine max
  Peptide Sequence Number=SeqID_129049
atgcagaacataagggaagagtttttcttgtctggttcaaactttgtaaagagtttttacaaagggagtgaaaaatctcaagtgggttgcttgagtattggacgtagacacggaatttatcgaaccaattatatacctatatctgtggacaatagatatgtgaaaacgcagacatcggggagcgaggttgtgtggtggcacggtgtcgctcaatcaagatcatgtggcttccgacaagtataa

SEQ ID NO: 37365 - DNA, 231 bp, Glycine max
  Peptide Sequence Number=SeqID_129050
atgtcatttgctactttgaggaaagcagttacagatgtcatcggaggtgacaattgtgttgagtacaattgtatggagcttaaatacaataatgaagtggggaagatgtttttcactttttcacagtttagttctaaaggtccgattgagttgtttgcaatggttggtcgatctccaatagaaatccttgtcctactgcataaaccaagaaaaccaagacctgctgaatag

SEQ ID NO: 37366 - DNA, 1254 bp, Glycine max
  Peptide Sequence Number=SeqID_129051
atgagatatttgcaatttttgagagaccttggagagtgcatcacttatgcgtggggagttgctcttttgggcgatttcactctcttgattcaattgtgggcatggaaacgatgcccaacgttagccccgtcgtttatttctccacaacaacaaaacgcaccacttgcctacagatggttgggaggtgaatttcatcacataggcaatgacaatttacttgattttcgtcgtaaattagatgtcatgaaacgcgacgagtttgtctgggtcccttattctggacatgtgaaaatgaatttgagccaatcggatagagtcatgagacaatttggaatgcaacaacctatttcgggcccagtaatgcaacccagcaacatacatgacttgacattaaagggaaaggaaggaagaaattggatgcaactaatgcaacccgcgcttcatgaatggaatagtcgctatgaaaggagagtagagcaaacgtcgccacaaacagggacccttggtctgaactctgaatatatgaggtggtacaggcgtaaaacaaaagtttatgtcgacccaaaacatgcaagaagaggactattgggtgaaatcgctgaaacactacattttatgatgttgcctgttgggagaagggtttgtacttttgacaatttactgccatgtatcgagaagatcactcttttgtctgacgaagaggataagatacttgaggcacatgaagatgctcccccttctcagccacaatttgaacatcaactatttaatatactacaacgaagtgtggagactcgaggcttagcgcgatgtcgaaaaactattgatgcagcaacatacaatttgcctccgatgccagaacgacaacatgaaatgtattacacaccgctgacattcacccaagaaccgtcgcagatgtcgtcgatgtattcatacccacatgattttcaaccagggtatattttggcagacatatttgggtcctttcctccttcaacaggaactccttcatttacccaaagtggtgaactatcaaccccaaatgccccacttggtggtccatggaatgtacctggagatatactcgacatggacgacttattaggggtcgatttacgtcatgatttctctgccgaggctgaccaagtggatgaaagggcgaatcatagaagaagaaatcctgatagggcagctagaaattgggaccgggcatgtgggacttcgtcgcggcatcacagacatagtgatgattga

SEQ ID NO: 37367 - DNA, 327 bp, Glycine max
  Peptide Sequence Number=SeqID_129052
atgtgggtttataaatggcaaagtaaagatactgttctggataacttgctttataaaccatttccccaaaactatgtaatatgggatcttcatggtgaaaagaaagcatcagagtcttctcaaatggaagatgttttgcaagaacatgttcatcctcaagatccaatggaaatgatgatcaacgatgcatttgagcattgcaagcagcaagacactaatgtaggtgtatcacaaccattaggttcagatgaaattttaaatgaagggctaagggatgaccatagtgtctttcatgatcttttcaatggcaaaagtcaaacattttaa

SEQ ID NO: 37368 - DNA, 2781 bp, Glycine max
  Peptide Sequence Number=SeqID_129053
atggcatcaaatgtggcagtgaagttagttagttctatacctaattcattattgcaattgcatatgttggatcttgtttattgtctgtcatccttgttatcttcgcatcaagtagaagttgcaacaccctgtgctattgctttgaatttggtaatctcaaatttgagtgctacaagtgagaaggcagttatggaagcattgaacgaaacagagacttccatacgtatagtcagaaatataaagttttttgctgaagatgcaaagaaaattgaatatttcaaagagatgactttgcttttgagcgcaatactgtggcgctggcctccatctaggttctctgttggtaatgatgttatacttatgaaaggcttagcaaacatccatacaaggacagagagttctattaaaattgcacttttaaagctgtacacatctctagcaagaaaacttatagaggatggagaaggatttccacagatggttgtgcaggcaatgggaaaatcaaaccctcatgctgttcagatagaggggtttaggcttgctcaatgtctattgagatcccaagagaattgtttagaagtggttggtctgtgtggtgaagcccttgttgatgcaataatttgtgggatgaaagaaactgggctgagttctaaaaaaattgggaacaaccatgggtctttgtcagtggaagcatgccagttggctctaataactcgctgggcaggtgatcatcatatcaatttttggaaacaaggaattgatagaattctccttaatcttctgattgaaaatattcaagaccaattgtctgagcctgtcttgtcattggaaaaacaaatatccatggcaaaagagggattaaaagccaattatcatcttggtcttaggagttatctgtgggacattcttgggtggcttactattcattgtggagaaaatttaaacccttatactcatggaagcaagctctgcatcaacttactaattacatgtgcatgcttgagttttgtggatacacttgaaaaatggtgccgaatatgtcaaaaggatattgatgatcattttcaaagtgaaccagtatcaagggctgttctaatgatgattcattctccatgtaataccatctcctcgtatgctagattcttattattagatgcacttgaggtgaaaggcttgtcatgcttgaaaagcttaatacatactctagattatacatcatccctagaaagctatggatcatttgataaacttcaactggttattaacttaattgggttgacttgtctttcaagtttaccagagtatcaaagctgtatcatagagagcaaagggataaaagcaattgttcttcttgtgaaacgatgcttaagtaatgatattcatgtagaaaggcgaaacttcactcctcatttgcacacaacattccaggaaaggtcttgttgctgtatggataaagaagattgggaaggttccaatgttctcttattttatagtttgttgggattgtctgaaattcttcgtcagtgtgaccttctacaagataattctcagcaatattctagagaggtgacaaatattagagctcagttagttagcaaacttcatgagatctgtagtggcaactctttcagtcctggagtgagatggtatgttttgtatattctaacttattttggattttacggtttcccaaatgagttagccaaaaggattgggaaatctctcaataaggaagaatactcagatatgcggctcgttgtagcaaatggggtgtctgtgagtgttcatggtgttattcttgctgttcgatgtccatcactgctgcctcctcaattgttacctagtatgaagaattctgaaaaggtaacagataagtttgtcagagagaccatgagagaagttcaattatcttctcatgttgattatgaagcattggtgttgttgttggaatatgtatacttgggatgtttacatgcaggagaagaaacagtgaagaagctgaaaattcttgctaagcgctgcaaactacagcatctcctgcaaatgctttatagacaacgtccaaagtggggcacacctttccccagctttaatcttactccatctcttggttcagccggaagttgtttttcgtatgatttccttgttgatcagcttcttataaaatatcttgaaattgcatgggatgctatattggaagctaaatcaaataaacttgttgggtggacatgcaacatttgttctgacacagtgccccatatgcatgttcacaaagttatattgcagtctggttgtgattatttacaaggtttattccggtcaggaatgcgagaaagtcattcacaagtcataaaagttgatattagctgggaagcattgatcaaactagtgcagtggttttattctgatgagctgcctaatcctccctctggatgcttgtgggataatatggatgatgaagaaaagctattcaatctacaaccatatgtggagctttgttggcttgctgagttctggattttggaaaatattcaggaagcctgctgggatgtgattatgtcttgtcttgattcttccagtcagttgcccattaaaataatcaaaatggcatataatcactctttgtggaagttggttgacgttgcagcaaatctcatggctccttcatatcgtcaattacaaaattctggtgaacttgaagaatttgatgatgcgctagtgcacttaatttattctgcttctattcaacttaaccaagaaggcaaaaattgctttaggtga

SEQ ID NO: 37369 - DNA, 1080 bp, Glycine max
  Peptide Sequence Number=SeqID_129054
atgccctctctcgccatcgaacccaccttcctcgactttgagttccctctagaccctcccaccaccatgctccccgccgaccagctcttctccgacggcaaactccttcctctccaccccctaacttccacaatcacaacctccaaatccccctcttcctccgccgttaacgccaccgcctccgccgctaccaccgccaccaccgctgacccttgcctcttctcccccaaagccccacgctgctcctcccgctggaaagacctcctcggcctcaaaaaattctaccaagccactaacaacgccaaagccgccccaccctcttcggccaaatccctaaaaaatctcctccaccgcaaaacgacgtcgccttcactctcctcggaaaacgcgccgctgctagcttcaaattcctccgacgctgaatccctctccatcacctcgtcgcgcctctctctttcctcatcctcctccggccacgaccacgacgacctcccccgcctctccctcgattccgaaaaacctaaccctaaccctaaccagatctcgctccaccgcaaccctaaccctagaatccgcctcgtcagaaaccgcacaaactcatttgacgctcacaagccctcatcggaccaacattattcccgcccggggaggagttcgatccggcgggaatcggagacggtgacatgcaggggagtttctgtggacagccctagaatgaactcttcggggaaaatagtgttccagagcctagagcgaagctcgagtagccccagcacgttcaacggtggtccccgcttcaagcaccgcggaatggaacgctcttattccgccaacgttagggttacgccggtcctcaacgtccccgtttgctccctccgcggctcgtcgaaatcgggttcggttttcgggttcgggcaactcttctcctcgccgcagataacaacaacgggtaaagggcaccaccaaagtgtgttttgggaaatgatgccaaagattcaaacagaggcaccagctctgctgaattattattatttatttgcacgtcagtctgatcccaaaaccttcatggcatacaattaa

SEQ ID NO: 37370 - DNA, 1446 bp, Glycine max
  Peptide Sequence Number=SeqID_129055
atgtcacggaagggtttgatggaacaagacctgagtaagttggatgtgacaaagttgcatccactttctccagaagtcatatctcggcaggctactattaatattggcactataggtcatgtggcacatggcaagtcgacagttgtgaaagcaatatcaggagtccagactgtgcgtttcaaaaatgagttggagcgtaacattacaatcaagcttggctatgctaatgcaaaaatatacaagtgtgaagatgaacggtgtccaaggcctatgtgctacaaggcttatggaagtggaaaggaagatagtcctatgtgtgatgtgccaggatttgaaaacagcaagatgaaattgctgagacatgtttcatttgtggattgtccgggacatgatattcttatggctacaatgcttaatggagcagcaatcatggatggagctttgctactcattgctgccaatgaaagctgcccacaaccacaaacctctgagcatttagctgctgtggaaattatgcgtctacagcacataataattcttcagaacaaggtagacttgattcaagaaaatgtggctatcaatcagcatgaggcaatttcaaagtttatacaaggaactgttgctgatggtgcaccagtagtacctatttcagcacagttgaagtataatattgatgttgtgtgtgagtatattgtgaagaagatcccaatccctgaaaggaactttgtttctcctcctaatatgatcgttattcggtcatttgatgtcaataaacctggttatgaggttgatgaaataaaaggaggtgtagctggtgggagcattttgagggtcaatcaattcattgaagttcgtcctgggattgttgttaaagatgagagtggaaatatcagatgcacgcccatatactcaagaatagtttcattgtatgctgaacaaaatgagcttcaatttgctgttcctggaggcctaattggtgttgggacaacaatggatcccactttgacacgtgctgataggttggtggctatgcctaattatccatttatgcctcctgccatgaatgaggataatgatccttataaaatatcttcattcatctcttttgcttgccaatctggtgggattgggtcagtggtaaactttttcctgcttcggcggctccttggtgtccgaacaaaagggtctgagagacagggaaaggtatccaagctggctaaaggagagatgttaatgttgaacattggatcaatgtcgacgggggctagagtagttgctgtgaagaatgacttggcgaagttgcaactcacttcccctgtgtgcactagcaagggcgagaagattgcacttagtcgtcgtgttgagaagcattggcgtcttattgggtggggacaaatccaagctggaatcactcttgatgtccctcccgccccccaactgagttga

SEQ ID NO: 37371 - DNA, 873 bp, Glycine max
  Peptide Sequence Number=SeqID_129056
atggctgatgcttctctctgtgtaacaaaagcaatgcagcatgaattggctcaaaactggggaataaatgctacagttttgtatgatcagcctcctgacatctttcatccagcttcactggaggagaggcataagttattttgcagattaaatgaggacttgtttcggtctcttggtgtcagagattgtgttagtaatggaaattcattggttgctagctgtcaccaaaacgagactctgtttgcaactgaggttggttcaaacatatatttgaagccaaatcgaccagcacttgttgtaagcagtacgagctggacaccggatgaagattttggcattctcttagaagctgctgtaatgtatgatagacgtgttgctgccatattaggtgaagatgattcagtagatgaggagttttgggtaatttcaggatcagctgatctaggtgtttgtctgcatacttcatcatcaggattagaccttccaatgaaggttgtggatatgtttggctgtggactgcctgtttgtgctgtttcatactcttgcattagggaactggttagagttgacaaaaatggtcttctcttctcttcttcttcagagctagctgatgaacttctgcttctcttcaagggatttcctgatgactgtgatgctttgaaggtcctcaaatatggtgcattagaaactggttcttcatcaaggtgggctactgaatgggaagaacatgcaaagccgctgataactgaggcaagttcattcttctattctatgcactatgtcattatcaggtcatctactcttgtggtagttgactttttgtgtctcagtgatcagttcttgatttataggaatagacaaaatcttgaatag

SEQ ID NO: 37372 - DNA, 450 bp, Glycine max
  Peptide Sequence Number=SeqID_129057
atggctacgccaagcattgagaatctgaatattaacgaagatgacccagttctcaatggaggcctatggagttttgacaaaaacatgtccatatttggagtcattgaagaaggaaaagacccaacaactatcccattattctacgtcccttttttgattcaaatgcataacctaccggtggagtttatgtctcaaaaggttgaagaaagcctcagaaattacactatccagttcttggagtatgatgagaagaacaacgtcaatttcttgtgccttttcatgcgcatcaagttaatgttaacggtagaagcggaggacttgttcttctttggcgtaaaccattcaactgtcaccttttctccttctcttccaacttcatcaatgtccaggtgcatcattgtgattatccaaccgagattaattggattctacagataccctgatcgctaa

SEQ ID NO: 37373 - DNA, 414 bp, Glycine max
  Peptide Sequence Number=SeqID_129058
atgttcctaattttgaaagggagatgggggaatactcaattcagacagagtgcgcgtggggcacaccttcgagccgagctagagcatgccgctgaaaccggtgtcgatcccagggaccggtatcgcggcgctgagcaagagctaggtgaggaggcagaagaaactgcaggcagaggagtcgaggaggaggaaagaattggtgccgaccctggtggagttgagcctctcgaactcacagattcggcacctgaccaagctagggtttacgacaaagaaaaagggagatacaaggcaacaatgagagagaggaaagtgaagggtgagtggaaaatgaagggtcagcaaaagtgtacccgagaagagaagataaataaaagagagaaaaaacataacaattcaaagacgggtttttaa

SEQ ID NO: 37374 - DNA, 483 bp, Glycine max
  Peptide Sequence Number=SeqID_129059
atgaaggggtgggtcacaaagatcccaagattgtttgatcaccccctggttgtgaaccatggcatccctgtcactgttctagaggatttcaaagatggggtgcaaaggttttatgaacaagatactgaggtgaaaaaggagctctatacccgggatgagatgagaccttttgtgtataataacaattatgatctctatagttcaccaacactcaattggagggacacttttatgtgttacctggctcataatcctcccaaacatgaagacttaccactagtatacaggtgtacccctcgaatctccccaacaattggtatcagagccaggttcgaccaggttccggttcagacgagtatgcaagtaccgcaggtggccagaatggctagcggcacagcgtgccccgcaggtgaagcggggtggccagaatggctagcgggcagggcaagtaccgcaggtggccatggctatactcgtggatga

SEQ ID NO: 37375 - DNA, 957 bp, Glycine max
  Peptide Sequence Number=SeqID_129060
atgggtgtgaacgaagatttcaaccaggatattgattatgatcatcatgagtatgtggatgatgatgatgttcctcttccggggtttcgattccaccctacagatgaagaacttgttagtttctatcttcaaaggaagcttgacaagaaacccatcagcatcgagctcatcaaacagattgatatttacaaatacgatccttgggatcttccgaaaaccagtgccactggaggagagaaagaagggtacttcttttgcagaagagggaggaagtataggaacagcataaggcctaacagagtcactggctcagggttctggaaagcaactggcatagacaagccagtgtactcacatggaggagaaggcaatgactgcattggcctcaaaaaaacactagtgtattaccgtggcagtgcaggcaaaggcatcaaaactgattggatgatgcacgagtttcgccttccttctaacacagacaacaacaacaccaaccttcgcagctccaagaattacgtagatgttccccaagaagccgaaatttggacattgtgtcgaattttcaagagaaatgtctcacagaggaagcacacgccagacttgaaacaaatatcagctaagcgccaatccattcatgacaagagttcaagaatgagcaatgtggagttcaatactactaatcaagaatcatatataaactttggtggccactatcacaatgagcagaaacctaccattaactacacaaacagtgatcaaaggaatcagtatcatgtgatgactcatcatcagttgtgtgctccggtggcacagcagcatcagcaacctcaacaactaacttcaccatcttctaacttttggattaacaacccacctgggaacgacttcttcacgtttgataactgggatgagcttggatctttagtgaagtttgcggttgattcgcctagcttgtag

SEQ ID NO: 37376 - DNA, 498 bp, Glycine max
  Peptide Sequence Number=SeqID_129061
atggcctacagttcaatctttcttgttctcaatcaaattaaagctttagccccctcaccccagcccagcccaccccatcttgtgggaagtattgacgcattggatggtggcatgatagaaatggttttggatcctgatttgaacaaaactcgagacatttggcacatatgtattgagcttttctttcagtatgctgtaaaagataaaatcatctatcctgtcaaagtcgaggacgatgcttacgtaagcaacgtctttgaaagttcgcaaacaaagacggtgtttacacgttgctggcgtaaacaccgtctttgtttgcgaactttcaaagatgttgcttacgtaagcaacatctttgaaagtggatccctttcgacaacgtatgattttgacccgtcgttgaacagttttattttccacgacgttggatacaatgacggtcgtccaccgtcgttgtatcctgttttccaccgtcttagaatcgcgtttttgcagtag

SEQ ID NO: 37377 - DNA, 222 bp, Glycine max
  Peptide Sequence Number=SeqID_129062
atggaggtgtctattacatacgaaattgcaggcactttagagctcaaccctgataggctgcgtgagctcaaagcatttgatgactcaaaagctgatgttaaaggccttgttgatggaggggtcacaaagatcccaacattgttttatcatcccctgatgcaaagaaccaagttcacgccaccaagagattgttggcagaatacggaagcagatgagaaatag

SEQ ID NO: 37378 - DNA, 270 bp, Glycine max
  Peptide Sequence Number=SeqID_129063
atggtggctagggttggagaccaaaagaagtccctcaccatgggaaagtttgtccaatggcaacctcgtaaagggaaagggaggagatatatatatgcggctagtgctgagcaatgttctgaaggtgtcaagtgcaatgacggagaacacaccgacgacactgtggaccattgtttgctttgcattctttgtgtgacccttgcttctgtggcaaagatgtttgcaatgaagaagggttacgatagtgaagaagagtacacaaagtggtga

SEQ ID NO: 37379 - DNA, 1122 bp, Glycine max
  Peptide Sequence Number=SeqID_129064
atgtcaagaaaccgagcaaaatattgctccttatctttctttggtggcatcaagggatatgggatgtccttcactgggactgaggttattcctggggtgggatctccaaccttcgccttaagagaaatttcccccctggttgtatatatcttggaggtcttccttgatggaacccttgatggctcgatcacgaaggatgacatagtcactggctaccatattttaaatcaactctatagcttcatcagtaaaccatggaagcggtcaagagctttactcagtgattcatcagggaattggtggaatgaagagatctccacctttcccttagaagtgtcggactctggaaaatatttcttcaaaaatttctccaccaccttctctcatgtctgcaagctatttcctttgaacaagtgcaaccatcttttatcttcaccagccaaggagaaaaagaatgggttgaggcggatgacatcttcaggaactccagctattttcattgtgttgcaaatctctatcttcaactttggggcgggttatgcttttgaaatactggggtgtaaaggtactagagtagtcctccaaggtgatcctccatggccggtcttctgccatgatgtgttcttcaaagttgggatatggaaaaaagatgatatagaggatgatgttgtacttgactatttgaagttgtcatccaaggtggctagaaacattgtggaagtcttgataggaaagcttggagtagaacccgatgcatcaaatattgagggcattcttggtttgaagaaggttaccatgaactactaccctgcatgccaaaatccagagttcacagtgggtgcagggcgccactcaaacatgggaactctcacagtgctattccaatatggcattggtggcttgtatgtcaaagtggaaccagaaaacgatgatgatgctggaaattccaccaacccctggagctctcctacagagaagattggtccattgccagagctggtgaaaaaagatgggctggctcgttatacggaagttgtgtacaatgattacttgaacaatttctttgggaatgctcttgcacgaaagaagtctcttgattttgcaagattcaactttgcctaa

SEQ ID NO: 37380 - DNA, 447 bp, Glycine max
  Peptide Sequence Number=SeqID_129065
atggaaggcagcggggggcggatcacgggaagtgccatttttgcaagtgggagcccatttcctcccgttgagtatgagggcaaagtgtttgtgcctggccaggccaataatgcatacatatttcctggatttggtcttggtttaataatgtctgggaccactcgagtgcatgatgacctgctttgggctgcctctgaggctttggctgcacaagtgagccaagagaactttgataagggactcatatacccaccattcaccaacataagaaagatttcagcacacatagctgccaatgttgcttctaaggcttatgagcttggcttggccactcgtgctcttttatcactcactctccttgttgcttctcttgaatctttgtcgtgtgccactgctgagacacgaagaggaactccttcacaatgccaccctcgctgcttcaactga

SEQ ID NO: 37381 - DNA, 171 bp, Glycine max
  Peptide Sequence Number=SeqID_129066
atgacgatcaaactcatgagggttgggcctgaaaatgatgtcgaagcggtcaagatcgtagcgagcggtgctggtgtgcatcatttcgatggcgcaacatgcaaggctgaaggagaggaagtacgagtgaaaggaaaatgtgagaggagagagctgcgcatgagagaatga

SEQ ID NO: 37382 - DNA, 679 bp, Glycine max
  Peptide Sequence Number=SeqID_129067
atggttcagccaacatggttattttcacttttgatactaacgcttcaattatcagcatcaggggtcaattccacgaagttcactttggttaaccaatgcaactacacggtgtggccagcgttaatgggaaatgttaatctttcaacgttaaagggaaatgataatctttcaacgactggcttcgttttgagaagtggcgaatcttccactgtgactccacctgcaaaatggaacggtcggatctggggccgcactctctgcaccaacagttcaggaaatttctcttgtgtcaccggtgattgcggttccggaaagatagcatgtgacggaaaagcaggttctatgccggtcacggttctagagttttccttaaggcacacccattatgctgactattatgatgtgagcctagttgacggattcaatgtgccgttcgataattgttcccataagcagcagcagcaagtaacccctgtggtcggcggtcccaagaacgatatttttgttgtattggtggtgatgcgagatccaactgcaaaccaagcgtgtactactcgaaaatattcaagacttcatgcccgcaagcctacagccacccaaaaggcgaccaaaccagcatgttcagctgctacgatcctgtcgattacaacattgtcttttgtcctacatctagcaacag

SEQ ID NO: 37383 - DNA, 273 bp, Glycine max
  Peptide Sequence Number=SeqID_129068
atgcagacggatgggaaaattgttgaattaaatcagattggaaaaaaagatgagaacctgactggggagtggaaccacacctctggtcaatggaatggagatgctaatgacaaaggtattcagaccagtgaggattacagattctatgttatttcagctgagtaccctgaattaggattatttgtgtcacctgatttgaatcaggattatttgtttgatgttttgatatgggagttcaagggggtgattgtttggttagaggtgcagtggtga

SEQ ID NO: 37384 - DNA, 354 bp, Glycine max
  Peptide Sequence Number=SeqID_129069
atggggcatcctctccaagcttcttatccaaggctcatcttggtggtgaagctccttcttcttggcttattccctagtggatggtgcctcccctctcctcttctcctttgccttccactgcatctccatggtgtaaaatcaccattgaaggacctcattgaagctcaaagatccagcctccttaaaatccctacaagcaagcttccatcacatcatttcaccaaagtattgtcagcagttctttcactaatgacttcgtccaggaagagaaacttgatgttcctgatgaacaacttcaaccacaagaaatggacgagtatgtcgacaaccgacaagaaacaagcaacctcctag

SEQ ID NO: 37385 - DNA, 543 bp, Glycine max
  Peptide Sequence Number=SeqID_129070
cttaaaagacatcatgcataatgatatatcttttggagggaaggtcattgtttttggtagtgatttccatcaaatactaccagttgtgtcaagaggtagtcggtctgatattgtgcatgcaagtataaatgcatcatacatatgggatcattgtcaaattcttaaattgaccaagaacacacgtttgcaaaccaatgctgccgataccaatagtgacgacctcaaacaattttctaattggctattggacataggtgatggcaaacttggagaacctaatgatggttatggcgaaatcagcattcctgatgagtttcttatcaaggactttaatgatcctatgcaggcaattgttgagacaacatatcctaactcattacaaaactatagcaatgtggatttctttgaggagaaagaatattgtagtgctgatagtgttgataaatctaatgaactactcaatcctgcatttggagttcttacagctgaatttttgaattcattgaaaatatcaggaatacctaatcataagttaaaaatcaa

SEQ ID NO: 37386 - DNA, 459 bp, Glycine max
  Peptide Sequence Number=SeqID_129071
atggagtcaaaggaaggaagaagaggtgcttaccactccatggctcagccaaacaacattaaagggagaggagaagggtatcctttgatcgccaataccaaacctcaagtttctaggatttgggcttacggaagggtttatgatccttacaattctccttttcacacccagactttctctgagcacacccaccccttaacatacatcaaggcccatctgctcaagcccaaactcactaagcacacaaaaacatacgcacgacatcatcattgttgccgctacaaatctgcaaccttacctaaccccccgacacctatcacaatcagtgggttcaagatcaacgaagacaacatgagggatgtgcttaccgaatccaattttgacgaagaagttgttgaaggcttcatggagttgaatgccatgtgtttcgaagaagatgaagaaggtttgcaaagataa

SEQ ID NO: 37387 - DNA, 255 bp, Glycine max
  Peptide Sequence Number=SeqID_129072
atggggattcaagggaagcaacaagggagagtgagtgacagaagagaacgagaactccaagaaatcatggactcaattttgggagtggaaattaaaaagagcaaaaaatccaagtatgaaggtccaaacgaaatcagctacctacctgatgtcattcttggaagcattctctcctttcaccaaaaaaagaagcagtttgaactagtgttttattcaagaggtggatatacctctcgacattcatcgccaagctag

SEQ ID NO: 37388 - DNA, 243 bp, Glycine max
  Peptide Sequence Number=SeqID_129073
atggcacttcctggtggagtggagagggatgcaatgctaggagaggaaagcaaagtaggcattggaagggtcattgatgaacgtgatgggaaggaggcaagggcacgtgaggttgttgaaggggtctgtgtggatgtaaatgttgaggaggaaggcaattttgggaaagggttgtttggaggagaggcggacaaatttggaagggttggaatgagaattggtggaatgggaaatggcatttga

SEQ ID NO: 37389 - DNA, 412 bp, Glycine max
  Peptide Sequence Number=SeqID_129074
gatgcaagagttagagacaatcaaagaatactcaacaaattgttggatattgccaacaagataaagttgttgggaagtgattttgttgatttgagaattgtagagaaaattttggtaacagtgccgaagaggttgatgaggcaagattgtgttgtcgaaggtgctttgcccaccaaacatcatgaagttgatgaaagcaaaaaggattttttcaagaagaatcaaccaacaagcagcgaaaatagtgcaaacaaccaaaacaaagatgcaaaatgtaacaagtgcaaccagatagggcatgaagcggtgatctgccccaacaaaaatcaccatgatgagggagctcagattgctaatcaagaagaggaggaccaactgtttgtggccacatgcttcttgagtagtgaatcaa

SEQ ID NO: 37390 - DNA, 255 bp, Glycine max
  Peptide Sequence Number=SeqID_129075
gaggaggcaccatctaagatggcacttcctaatggagtagagagggatgcagtgcaaggagaggaaagcaaagtaggcattggaagggtcattgacgagcgtgatgggaaggaggcagtgaatggcagagataagggttggggaggcacgaaaggggtctgtgtggatgtaaatgttgaggagtttgtgaggggagaggtggaagaatttgggagggttggaatgggaattggtggaatgggaaatggcatttga

SEQ ID NO: 37391 - DNA, 246 bp, Glycine max
  Peptide Sequence Number=SeqID_129076
atggcactttctggtggagtggagagggatgcaatgctaggagaggaaagcaaagtaggcattggaagggtcattgatgagcgtgatgggaaggaggcagtgaatggcagagataaggggggagaattagatatcaatgtgggtgaggaagaggaaggctattttgggaaagggttttttggaggagaggtggaaaaatttggaaaggttggaatgagaattggtggaatgggaaatggcatttga

SEQ ID NO: 37392 - DNA, 594 bp, Glycine max
  Peptide Sequence Number=SeqID_129077
atggaattagcaccattttgggaacctatagaagaggtaagaaacctcacgactttctctcttgcacttcttcccttagcgcgttgggaaatcctagaagaggatcaatcagtaggttccatgttcagcgcaccaccagctcgcccagcctggaggtggaactcagaagaacttaatccatggaagacattgcaagagttactcccttacaatcaatatgaagaagaaagaactcctaatcttgaaggtgtgttcgcggaattcatggcataccatgctagctctaaagccaatcaaaactcaatgcaaaaacaggaaattcatgttggcaagagctactccatagaaaattatcagtgggagcaagagttacaaccctacaatcaatatgaagaagaaagaggttctaatctagataatctattgaagcaattcaaggaaacaactgaatctactcaacaagcatttaaaagtttagaaattcaagttggtaagctagcaaaagaagtggccaaatttgtggccacaagtgaagaaaactttgtagaagttgaagctcatgaggaaagccttgtagaagagcatgattcataa

SEQ ID NO: 37393 - DNA, 480 bp, Glycine max
  Peptide Sequence Number=SeqID_129078
atgggtatcatcattcagttgctgttgttgttgttgtttttcttcttagagaaagatgatgaaaaatatttagttattgtcaactctagaccacgggttataagttgggaaattggggaagagattctgaaattccctaatggtttgggaaatgtagagcatatttctatatcgagtgatgccaaaaatttagttacatcagattttaaggatcaacatgaggctgctgaaggagtccttcttgatgatgatttgaatgagccaacaatgggagagaaacttgccagtctaagtgttctggatgggaacaaatcaaggagtgatatagagcaagaatcttctatcccaacaaagcctccaagtgcagactctgtacatgttttgcttaagcaagcattaaatgctgatgatcgcacccttctgctagattgcttgtttacacaaattgagaaggttctctttctctcctatttctattga

SEQ ID NO: 37394 - DNA, 213 bp, Glycine max
  Peptide Sequence Number=SeqID_129079
atgaaggaattctatgcaaatctatatgaccctgaggacaagtctcctaagcaagtttgggttcgagggcaccttataaaatttgatgctaattccctcaacacctttttggagactctagtggtcttggagcaaggggaaagcttaccttattactccagatttcactcattgctcaatccaactcctcgcggcatggatttccaaccctga

SEQ ID NO: 37395 - DNA, 438 bp, Glycine max
  Peptide Sequence Number=SeqID_129080
atgttttatatgtgtgtgtgtgtgtgtgtgtgtgtgtgtgtgtgtgtgtgtgtgtgtgtgtgtgttagtattcatgtggcccagctaatctcgaacgccatttaccaatttgcacggatcacacctccaagtggtcccaaaaaagtccaacagagcactggggtttccggccttgatcatgggtctttgccagttctatgggtgccgacacaattgaatgagattttttaccggtacaccttgcatcaaccaagccaggatcccagcccttactcatggcctactcccgagcagttcggggccatagttgcatggcctggagataggcccagttttcaggcaagggcaggacccgcagtgaccccaagagatgaagatggaactcgggaagacaatgacatggccgatgtgatggactacttccttcgaggaggctga

SEQ ID NO: 37396 - DNA, 90 bp, Glycine max
  Peptide Sequence Number=SeqID_129081
atggatgtccttttttgcgtaacgctctgcaagatgccaaacttgctcccttggtggtatcgaaagaggcaacgaagggatgaaaactag

SEQ ID NO: 37397 - DNA, 1392 bp, Glycine max
  Peptide Sequence Number=SeqID_129082
atggtgtttcttcaccttgccaattcaagtatccacaatttctctctttgtttaacacgttatcagtatgattcaaccttgataagtgcatggatctcctttatctttaaaaggggtgtccataatcttcatattcagtatgctgataatgtccactttccttcccattcactctttagttgcaactctctggtacaattagtgcttcaaatgaaatgtactattagtgttcccatcttttcttttctcccaaatcttcaaaaccttagcatttctgggatcaggttagtgagtgaatcctccaattattcagaagatctaattcttaacttcccagttctcaaagtgcttgaagctagaggatgtgagtggttaactaagcagaacattagtatcaaagcacctcaacttgaaaggttttccatagcaatatggaactccctatcaaatgaatcacataaatctgccatcaagatttttgctcctaatctaacagatttctcttatgagggtgatcttgagcaacatatcattctgttgaattcagcatcaattcgtagtgcgtctgttgtggttgttattgatgaggacaacaaagaaagaatggaaaatcttgggtttaaagtgcataatcttcttgcacaaatccgtgaagtggagcgattgaaactattgttttacaaggtgtcagtgaaggtcaataagtacactcgttctagtgcaccaacactttcaccctcactcctcattttcgagcgaggatttgtagaagttgcaactgatatcgggtgtgaaagattttcgagcgagcaacaagggcttattattaagtggaaaaaaagaggttcaattagcctcatcgcgcgctgttggaagccatttgggcacggtgacgacgccgataatgctaccattgtcggaagagaatgcaaggacgacctcctctggtactacgacatcgaaaagttcgccgccaactatttctccatggggatggtggacccgaagcaggttccgttggaccacgttctcttccaacccaacaaggggatggtggacccctccagtaacctccactatgataacatgcttttcacgcagatcgatgcggtgtattccgcgttggactccttggcctacaggaagttgccagttcacatttcagaaaccagttcgccttccaaaggggatctggacgaaaccagtgtgaacctcgagaacgccaagaactataacgggaatcttattaagatctctctctctctcccccctttcaggcattacttggttgttcctgtggtgcacattcctactgttaaatatcttcagaggaaaactgacgactattatttgggtaaagaaactgatagttgttgtcacttcggaatataa

SEQ ID NO: 37398 - DNA, 429 bp, Glycine max
  Peptide Sequence Number=SeqID_129083
atggctcgtgttctaagaagatacaacaagatgagaccctgtaagtctaaccgttgggattttgaaaataaaaactattggtctcttgctaagcacgaatggagcactaagcgcaattccaaccgagaagaagttgcgctgagtgcccagaggtgcattacgcccaattacaaccaagaggaagttgcgctgagtgcccaaggcgtgaaaaacacgatttttcactctcctcttctccaaaaatgccacccaaaccctaaaacctcattttcaccacccaagaccaccggtttccgtcgtaagccgtcgttgcttgccgttggacccccacaccaagaggagcactttaatcggagcggaatcctcagaatcctcctcaaagcttcggtggagaaaatgcttcaatcctctatttcaaagtttctctga

SEQ ID NO: 37399 - DNA, 273 bp, Glycine max
  Peptide Sequence Number=SeqID_129084
atggtgaatatcatggcttggaactctaacaaatccttttggagcattgggaatgaaaacaagaattctaactggagttttgggggtcctagaaataaagattctaattggggcaagaaaagtaattggaattatggatctagtgatgctaatcaaagcaccatttggagaagaaatagtagctggaacatagcaaatgcctcaagcgatgaaggttccaatgaaaattccattggagtaggtggtgggaactctcagtggttaccaaagtag

SEQ ID NO: 37400 - DNA, 252 bp, Glycine max
  Peptide Sequence Number=SeqID_129085
atgggttgggaagtgaaggaggaaggttggggaagggaagaagagagaggtgttaggaggagaagggttggggaagagagaagagagaggggtgagaaatttgaaatgggggtagaagggtcttttcctcttcaagtaggggccaagagtaattatgataagggcaatagtagtccccatatggatggttgtgtcctagttttttttgtcactttttgtgttcttaatctcgtgaattttggcaagcactga

SEQ ID NO: 37401 - DNA, 1242 bp, Glycine max
  Peptide Sequence Number=SeqID_129086
atgaattcaatcattgcaacaaaaaggttacctcctgagcaaactgtggttgaaggggaaggcataattagcaagttgcatgaaagcattcttggtaagattctgtctttccttccaactacagatgcagttcacactagtgtgttatcaaaagggtggattcatgtttggaaatccatcacaggcctacagtttaatgatgctttgcaccctttggggaaaaagatgcaaaaagaacactttgtgtgttttgtgaaaaagaatcttcatattcagtatgccgatgaaatcctatttccttcttgttccctctttagttgcaattctctagtgcaattggtgcttcaaatgaaatgtactattagtgttccaatcttttcttctctcccaaatcttcaaaaccttagcatttctgggataaggttagtgagtgaatcctccaattattcagaagatctaattcttaactttccagttctcaaagtgcttgaagctagaggatgtgagtggttaactaagcagaacattggtatcaaagcacctctactggaaaggttttccatagcaatatggaactctctatcaaataaatcacataaatctgccatcaagatttttgctcccaatctagcagatttctcttatgggggtgatcttgagcaagaaatcattctactgaattcagcatcaattcacagtgcatctgttgtgattgttgctgatgaagacaaaatgaccaatgttggaaaacttgggtttcaagtacacaagcttcttgcacaaatccgtgaagtgaagcaattgaaattattgttttacaaggttttgatgcatgccagagatattttcacccatctaccagcttttagtaggttgagttatctgcaactaaatgaggtcactggtgaagctctgctcaacattctgaacaattgcccaattcttagtagtcttgttttacaaaatggagtatcagaatcaaataaagatcatgtcttgacttctgcatcagtgcctcagtgcttcctgtctagcctcaaagtttttcagtttaaggaatttaatgtgcgcgagcatgagcttcttttggcaaaatttgtgttggcaaatgcagcagtcttggagcaaatgatcatatgtactgctttctggttgcggtattcagaaatcgacgtggagaaagtcaaggaccagatactatcttttccaaagtgttccaacttagtcatgatacaattctaa

SEQ ID NO: 37402 - DNA, 156 bp, Glycine max
  Peptide Sequence Number=SeqID_129087
atgggactcgatggtgcgtcttccaaggaaggaaaaatgcacagagtcgccaccaacgtttattcgaggaaaatgtcgggaaaaccaaaattggaaaaggttgaagggaaggtattagcacctcacgcgcccgtcacaagggacaacaacctctaa

SEQ ID NO: 37403 - DNA, 86 bp, Glycine max
  Peptide Sequence Number=SeqID_129088
atggttgttgagagcattaaatgcacgtcatttcctcatgtagaaagtcatttcttcaacgtccgcgtgctagcgaactacaacag

SEQ ID NO: 37404 - DNA, 735 bp, Glycine max
  Peptide Sequence Number=SeqID_129089
atgtggttaatattcaatttgtgtcctacaccactagcaattttgatctaccattgcaaggagcaagccctatggagtatacacggtggcttttgcttttgcacaatagggagtactttttccattagcttccaaaaaacacccaggccgatggctattccacccagctctcctcctcctcctcctcctcctcctccttctcctcctccttttattgaagcagcatcacagtcgccgtctagcatgaagcagacaagaaaagtcatacggctaagatcattggcgactagaccacctggggcagacagatcgattgtccacgtcgatccttcgactgggaaggccaacggtccccacaagaagaaattaaaaacatatttagggatcttcgctcgtgataaggtcgatgtgacatacaagaatcggaatcaagtctctgttgctcagaaggatttgatatgggaggatattaagattgtgggggagcggtggagacgatttaagtatgatttgacgtcaaaatgggcacttgcagccgataaggacaatgtggatgacactatttgtgaaaaatacggcattagcaaggagaaatgggctcagttttgtcagtcacagagacccctcatgggagaacagaagctgatggctgagaagacaaagaaaaaactggaggaagtttctcaatccataagcactaaggccatgattgaccctccatctcccattagatga

SEQ ID NO: 37405 - DNA, 321 bp, Glycine max
  Peptide Sequence Number=SeqID_129090
atgacgacagacgtgaattcaccatggatgtggttagcaccacgatgtcttggtcattccacaacgttcaagaacttcaatgtcatagttttcgaccacgaccgtggtgcattcaataggaccgcgatggatttcagtaggaccataattgtggacaacactgagagaacagatcgtgattatcattcctaccttgtgaaccctaacagagcaatcggaggaggagttctagagagcaccaaaaacgccacaattgctaacggagaatgtttgagcgactacatcgaggtaaggggtgagttactcacacttggagattag

SEQ ID NO: 37406 - DNA, 423 bp, Glycine max
  Peptide Sequence Number=SeqID_129091
atggtttttttcggacacgcaaagcctcacatatatgatccttgtctactagaccacctggtgctgaaagaccagtggtccatgttgatcctgctaccggcaaggctgacggtggacgtgacgtacgagaactggaaagagatccctactgctcagaaggacttgatttgggaggatattcaggcggaatttgaaatcttagaggcttctgactgtaggacgaaaaagaagttacttcagactgtcagtgagagttggaggcagtttaaatcagacctcacgaggaaatgggcccttgcagccgatcaggatggtgtggacgacactgtctgtgagaaatatgggataagcaaggaaaaatgggcccaacttttccagactcgcagagacccttcttgggaggatgtgctgaaaaaggcatag

SEQ ID NO: 37407 - DNA, 1586 bp, Glycine max
  Peptide Sequence Number=SeqID_129092
ggattgatcactctctcactagtagcaagaaagcacatgggggagagaaaatgaatgagagaaagctaaggggtattggtttaatatgggacaaagtgaggttgactaggtcgaaaggtgatgagggtgatgagggaaagggcattgaattggttccagtgcttagaactgtggacaagggtcatgatttggctagtgttgaagcatgggttgttggggatgtttcagatttacttttcagaaaatccatgagctctagtgtgactgcatacacagaaggtgtgagggagctagcatgtgagattttggagctaatggcagagggtctgggggtcccggatacatggtttttcagcaggttgatcagggaggttgacagtgactcagtcctgaggttcaatcactacccacctattatacttaacaaagactgctttaaggacaaccacaaccacaccaaggtaattggctttggggagcattctgaccctcagattcttaccatcctcagatccaacgacgtggctggcctccaaatctctcttcaagatggcgtgtggaacccagttgcccctgaccccttagctttctgtgttaatgtgggtgatctcttacagccctacaacttggcatggtttcattttcctgagcacaacacaatagtgcagtcagggcacgctaagcgagatgggcttgcttattcccgcttctacaacacttatccagaccctcaggagctcgccgctaaattatgtattccagggcaaggatttctgctgaatgcagaggaggccccatggaagcagctcaggaaggacctgactacactggctcagacttggagtgtcctctgctactccaaccttgcccctacttctcccacttctgatctaaacatggatagggtgaggttggtatacgggctcgtgatgaaggtggatatggatgtgggctcgatcatctcaagccagatctcccagatggcccagtctaactcctctaggcttggatttcctgcacttatcatagcattgtgcatagccagaggagtagtatctgactcactcaccttcgagtccctcagcccaatcattaatttggcctacatcagaaagagctattggaacccaaatgatccaactatcacatttcctgggtcccgcaaggccagggctagggctccctccgatgcttccacctcagctcctgctcccacaccaacactagtaccagctctagcacctccagcaccagccgacccttccatgcagagcacaaatgccatagtgccgatcatcaacatagaggacttcatggctcaagtggcctggcccggagtccagccttcctctaaggggggcggggaggcaggggcggaggctgaggagacacctaaggagacgccaatagacacacctgtggaggagcttaaagagggaggcgcaacagatgatgatccatggtggagatgtcactatgtagcagatgtcactacggtgcagaggacttgggacccatggcccactccagctcaagatactcctattccaccttatgatgatccaacaccaactcaggaggagtga

SEQ ID NO: 37408 - DNA, 177 bp, Glycine max
  Peptide Sequence Number=SeqID_129093
atggttttgaaagcacaaaaaagtaagtttaagtgggagattgtgaagtcggagaaaaaagaatcgcatgaagatagtacaaatggaggctttgatcccttctccgtttctctgacgtttgggaactctatcggagtagtcggaggaaaaacaggaggaatcttagggaaccgctag

SEQ ID NO: 37409 - DNA, 789 bp, Glycine max
  Peptide Sequence Number=SeqID_129094
atggtaactaaaaatgaggaagatgaagcagcttgtgcaaggaaatggggttgccttctactgctcttgtgtgaagagaaatgcataggggtggctgataagagtgagaaagagtggtcattgctgaatggaagtgttgaatttgagattcttttaagaacaacaattctggtggagtttgtggatggtgaaaagtatagcgatgtggaagctgctacagctccaagcattttaaggactaggattgttgacaacaataatgattatggtgatgtcaacaacaacgataatggtagagatacgagtgatggttgcagtgacaatgaccacagtagtggtgacaatgacgatgtgatgataatagtggtggtaatgatggtaatgataaaggtggtggtggcagtgacgttgatagtaatgtcgatggtgatggtggtgacaccgcgtgatggtggttgtggtgacaatgatggaggtggtattgttggtgttggtggtaacaatgccaatgatgatggtgattggagttgtagtgacagtgacagtaaatgttatggtggtgggggtagcaatgttagtgatgatggtaatgccaatgacgatggtggtgatgatagcggtgttgatagtcatggtagtgatggtgacaatgacagtgatagtgacattgatggtggtgattatgatgataataatgttggtggtgatggtgatgtcgatgatgatagtggtgtcaatgatgatggtgataatagtaggagtgctaatggttgtagtggtgacagttag

SEQ ID NO: 37410 - DNA, 53 bp, Glycine max
  Peptide Sequence Number=SeqID_129095
atgtctaatgtgtcccttctccttttccttgagatacttgtctctctcatcag

SEQ ID NO: 37411 - DNA, 390 bp, Glycine max
  Peptide Sequence Number=SeqID_129096
atgacaggtgagtcacaccaacaagaatggcagaataagggtttcaccaacaggaatagcgaaacacctttaaaaaacagactccctcaagcaaatctgcctttgcgaaaactgaaagagaaagacggatttctaggtgctcaagatttctttttgaaggaggggcttagacaagaggttggaagcggtagcttgatcggagaagcctatgatagtaagggagaaaaaatatattgtgaaaggtgtactataacaattgtggagttcacgatcaatctaacaggagacaaaattagtggtgttggaccacttataaagatgttcatcggtttatctacaaaattaggaactaaaccatcattgaatatgttcattacgtttgtgacatga

SEQ ID NO: 37412 - DNA, 816 bp, Glycine max
  Peptide Sequence Number=SeqID_129097
atgctcactacatccaaaggacctacttcatttgaggatattagaacagttgcaaatgttctatatcctacatatagagaagcatgttttgcaatgggttttctgcaagatgacagaaaatttgtggaagcaatcaaagaagctaaagaatggggaacaactaactatttgaggaaactatttgtgttaatgctattaacaggtaccattaccaaacctgaagaactttggaaccaaacttggcattggttagctgacgacattgcatatcattatagaaaatcaacagcaaacacagaattacacattaatgatgaacatcttaaaaatttgacattgctggaaattgaaaaactactgcatgcaaatcaaaaatcacttaaagactatcctccaatgctatatcctgatgatgcaaattctacaccgtctctagacaatagcttgatattatcaaagctcaattacaacaatgatgagactagatcagaattcgaacatcttttttcatccatgacagatgaacaaaaaggaatttataatagaattatggaagttgtcaacaacaatgaaagtgacatgtttttcctatatggatatggaggtacaggaaaaacatacatatggagaacattagcaacttcattaagaacaaacaatcaaattgtcattatggttgcctctagcagcatagcttctctcttgctgccaagaggcaggactgcccattctaaatttaagatacctgtaccaatctttgaagactcaacgtgcaacatacatcaaggaagtcaattagcagacttgctaaactaa

SEQ ID NO: 37413 - DNA, 432 bp, Glycine max
  Peptide Sequence Number=SeqID_129098
atgctggatgaatacaacgtgcatgcaaaaagtttcaggatgacaagaaataaattcaaagacggtcaagtgcataatgtcaggttgaaattgattgttaaccgtgaaaatgatggtcgtacatataatgtacctattgttctagaagttgttgcactaattgtaggcgatttagatgcaaattcaaaaggagatattattgttgaaactcagcatggacaattacaaaggatccatgaattacattctagctatctagttctacaataccctttcatgtttccttccggggaagatggatatagacctgatatcctccatagtagtacaccagaaaggctttcttacatcagaaacaaccaaaaaaactttgagttgacaatttttgcagcttacaacactcattggatgatggatgcacgaaaggcctaa

SEQ ID NO: 37414 - DNA, 351 bp, Glycine max
  Peptide Sequence Number=SeqID_129099
atgcctcttggccaaagcagttcacaactttcaggatccactcagttatcatcaaaggatgcatttctttcaaaggctgaagcaaaaagcatttcccagattaatgccatttcggaggaccgtgaatgtgcagagttgattggtcaatcagccgatgaagttaacagcctaaaaatggcaggtggtgacgttgatttaaacgcttctcctcaagcacttgataggctactgggttgtgtacttgcatttaaagtcaaggttcaatcaaagttcagcaatgttattgttcttaaatattcaaatgaattagatttgatcaatgttgtgcaagatatgttgcctgatactgag

SEQ ID NO: 37415 - DNA, 816 bp, Glycine max
  Peptide Sequence Number=SeqID_129100
atggcttcagagttatcgactaactcaacgggcacaagcaccagttctaactcatcatccgctacaagcaagattcaatatccgattaacacaaaaccatcaatcctgcagttcacagcaatattccacaatgatagggaaattgtttgtgttactgtgggcacgattacaaagataatgatggataatcattcatggtgttacctagcttgtagtcgatgccacaaaaaaactgacataggtgttgtgccattcacatgtggatttgggaaacacaatgatcaacctgtcttaaggtatcaagttgaagtgatggttaaagacaaagacgaagatacaaaatttttactctgggaccgtgaatgtgtagagttgattggtcaatcaaccaatgaagttaacagcccaaaaatggcaggtggtgacgttgatttaaacgcttctcctcaggcacttgataggctactgggttgtgttcttgcatttaaagtcaaggttcagccaaagttcagcaatgttgttcttaaatattcaaatgaattagatttgatcaatagtgtgttggatatgctgccagatactgagtcatgttccaagatcgatagtccaatcgttgagtccagggatcctacacaagttgaatcttgtgatgtattttgctatcatctcatgaaaacagatcatgacccacttctaagggttccattaacacccacaaagcgtctatcagctgatgaattggatgatgaaccaagaagttctgaaatttcacctgtgcaactttcctctaacaaattaacaagaccttctaactga

SEQ ID NO: 37416 - DNA, 864 bp, Glycine max
  Peptide Sequence Number=SeqID_129101
atgttgttgaaagattacattttcatcttccaggccaatagtgttgtctatgaagacaatgattatattgatgatgtgttgtctaagccaagcatcactgattcaaagtttattttatggatgaacaccaaccaaaactctgttgaaggaagaagtcttacttatgcaaaatttgtttctaagtttgtatataataaaaagaaaagatgttggcagcttaggaagaaaggttacaccattggcaggttactatgggtcccaccaattacaggaaaattattttacttaaggatgatgcttactgtttgcaaaggacctacctcatttgaggacttaagaacagttggtaatgttcaatatcctacatatagagaagcatgttttgttatggggttattgcaagatgataaagaattcattgaggcaatcaaagaagcaaaacactggggctcagcacattatatcaggaaactatttgtgttgttacttttaactagaacaatgaacaaacttgaacaagtttgggaccaaacttggcattggatggctgatggcattgtctataattataaaaaatcatcaacaagtccagcattacagcttaatgataacagtcttaaaaatctggtgttgcttgaaattgaacaactattacaagcaaatcaaagatcacttaaaggctatccttcaatgtcatatccagaagatgcgaattgcccaacctatctagacaatagccttatattaactaaactcaattacaacaatcaagaactcatatcagagtttaaacatctatttcctcatatgaaaggtatattaactacagagcaatttagacctctgaaaattgttatttgttag

SEQ ID NO: 37417 - DNA, 345 bp, Glycine max
  Peptide Sequence Number=SeqID_129102
atgcagtttcttcttgatctgttgcttgcatgttgttttctgcctctcggaatcactgacagaatctgtcagaaatctccaccaaagaccatgactttacctccaaagattttattgtcccttgagttgtgtttgattgtgatcaagtgtctcaaaacagaatttgttgagtcttcaaaaactggaacaagaattttgaattttgaatgtgcagttctacctccaggcaataatagagaagctatgctactagaagcaatcataattacaattttattgtcaactcttagtgaacttgcaaatattttccaaatgtatgtttttcctgtacctccatattcgtag

SEQ ID NO: 37418 - DNA, 114 bp, Glycine max
  Peptide Sequence Number=SeqID_129103
atggaggcgtggtgtcagctcaaaaagtggaggtttaggtgtaggtgcaagttcaacaacaactccgaacatagtcctccaagcttgttgaagattttgaagaacaacacctag

SEQ ID NO: 37419 - DNA, 186 bp, Glycine max
  Peptide Sequence Number=SeqID_129104
atgtcggcatctgaggcagactctatggaggagagcggtcccggagggatagcgactagtggagacctattgtataggaatttgatgaatggacgccacactccacagcctaaatcaaaggctcctgctaggtggattgtcgtcaagtgtaatagacaaaaaggaactactgagtgcggctactga

SEQ ID NO: 37420 - DNA, 171 bp, Glycine max
  Peptide Sequence Number=SeqID_129105
atggggaaaagaaacaaagcagaacctgaaagaccaagaaattgtctcccagagggattcgtcgatgtggtactcgctggtgatggtgcgagaggtggtagactaggcggacgaaggctcttcattaatatttatattataatattctcagttcaaagatttatcacatga

SEQ ID NO: 37421 - DNA, 1206 bp, Glycine max
  Peptide Sequence Number=SeqID_129106
atggagaaacatgcatcagaggcatggcagcaagaaaagaaaagaaaagcttgctgggaaggaaaaccagaggcatcaggcagcaagaaaagaaaaatcagagatgaaataagaagcaaagcttacccgcgcggggaaggaaaccaatgcggcaatggaggcgcttgtgggaagaagaaggagaagacacagaacggcaggagaggggccgcgacgcgcgtgtctacgtggtgggctgcgtccaaccagaggtgtcctcctgttcaaccgcgtccggtgacggcgccggcgacggacaccgcgtcgcaccggagtcgtacacgtatgggtgtccggtgcgagtctgacatgggacacaccggtgatgagccgcatccgtgcttcataggaaatgcgcctaagaaatcattcaagcccttattgccccctgaggccttgctgtccattggtcactatcacacaacatgtcctgatgttgaaggcatcatctcacaaaaggttgcagcttgggttaagaaggaccctacattggcccctgccatcatacgccttcatttccatgactgtgctgttgggggatgcgatgcatcaatattgctcaaccatccaggaagtgagaggactgcattagagagcagaaccctgagaggcttccaattgattgataatatcaagattgagttagaaaaaaggtgtccaagaatagtctcttgtgctgacattctcactgctgcagcaagagatgccactcttatggctggaggaccattctgggaagtcccatttggcagaaaagataacaaaatttccttagccagagaggccaatatggttcctcatggccatgaaaacatcacagcccttattgcattctttcaagaaaaagggttagacattcttgacttggtcactctctcgagctcacacacaattgggaggagcatttgctcttctatcatggataagatttacaacttcaatcggactggaaagcctgacccttcgctcaatgtctatttcttgaagttgttgaggaaaaggtgcaaaagggtgatggatttggtgcaccttgatgtcataacccctaggacttttgacacaacctattacactaaccttatgaggaaagtggggttgttgtcaacagatcagtcactgttttcagatgcaaggacggctccttttgttgaagcatttgcaacatag

SEQ ID NO: 37422 - DNA, 459 bp, Glycine max
  Peptide Sequence Number=SeqID_129107
atggatgatattggagtttcaaatgatgatatgacagttagtttttctctcaggcattcttcccgagcagaagggtctttggatgacccaataagagaaatggagggcatgcttgttgatttgtatggaaggttcgaagctcgagctttgtgttgcacttgcatctgttctcattattatgttttccttgtaagagtcagtggtatcggtaatgctacatttcagctgcctagctttttatcttctcatttgtttgaagaagatgaagacaatgattttccgagtaacttatctctagtagatgccagtcgcactgttgtggattcagaaacttctacggttaccccgagtgacaagcaccattgtatcttggaggatgtggattgtgagctagaaatggaagatgtttcaggtcactttaaaggaggaaaagcctgtattattgaacagtccttctga

SEQ ID NO: 37423 - DNA, 612 bp, Glycine max
  Peptide Sequence Number=SeqID_129108
atggagtcctccctaccgggcaaccaaatagttcaaatggctgggaattcttttcctggaggtcacaatagttatgtcgtcaagaatgacatattgcaacagccatttgcttgctttcctccaatggcaggttgcaactctcaggaaccttgtggttataaccctccaaggcagttggaatatgggcaaaatgatatgtatctaaattctcaaggccctcaacctgatctgcaacttcagccggctaacccatcatttgctccaagacacatgcatcctgccctgcctcaaaatccatccaatcaatattcatatccaaatcctacaattcagcaacatcttccacattcttcgcatcctttcttctcatttccatcacttccaaatggccagaggcaatatgttgccaacgagcaatggaggatgtcatcaagtgagggtctatggataggttattttcggccaccacttgaaagaccaccaataaacaatgtaggttttcagcatgcaaaccctagcaacatgcctgctcatcctatgtcaggatacggtgttcctcagatgtcatgtagaccagatattcctgcacttaattgttggaggcctacgtga

SEQ ID NO: 37424 - DNA, 444 bp, Glycine max
  Peptide Sequence Number=SeqID_129109
atgcgagcggggaattctgatatctatggattcctcgagcaacagtccattcagaggtctgggcaatcgcagtttgagtctgaaagttacataaagacttggatgcagagttcaaaacgcgatgtttatcttggagcctacctaaatgggccagacaactaccttaaggggattattaatagtgctttaaaaggtcttgatgatgctccacaacctaaatcaaaggctcctgctaggtggattgtcgtcaagtgtaatagacaaaaaggaagtactgagtgcggctactatgtgatgcactggatgtccaccatcaatttaggaacttttaggaataattgggaagcgtattttaacgatcctagaccattggagccagagagattaaaggcattgcggatccagtggacacagttttatctccgagttagagatcaggcctag

SEQ ID NO: 37425 - DNA, 1833 bp, Glycine max
  Peptide Sequence Number=SeqID_129110
atggcggtggacggtgataatggccgtcgtcgaccctcaccctcaccacccccttttgtaaatcagcacaatcgcgtctctcacagagaagataggaatggaggagaaggatttgatggaagaagtaagagtatgagtcgagaggagaagaggaaggcaatgaagaaaatgaagcggaagcaggcaaggaaggaggcctcggagagggagcggcgggaggaagaagagcgcctgatcgaccccgaggagcagaggcaaatgcagttgctggagcagcaggaggctgagaggatgcagagggacatgatcctcttccaggagagagagaaggagtggatggacacggttattgcccgaaaacaacagcagcagcagcaccaacaacaacgagaagaagaagacgaggacgatgaattcgattgcgtggaggaagaaggccctccagagatcatttggcaaggaaatgagatcatcttcaagaagaaacaactcagagttagggttaccgacaaggacaagccaaagcctaatgagactaatcaaaacgaccaccaggaggataatagacctacatccaatcccttacccccggattcgacgctcgagaatgttgctcaacaaatacccaatttcggaactgaacaggataaagctcattgcccttttcatctaaaaacaggagcatgttgttttggcatacgctgtagcagagtccatttttaccctgataagtcgtccacttttcttatcaaaaatatgtataacggtcctggccttgcttgcgatcgggaccaagatgagggccttgagtataaagatgaagaggttgaacgctgttttgaagaattttacgaggatgttcacacagagttcctgaagtttggggaagttgtgaacttcaaggtgtgtaaaaatggttcatttcactggcgaggaaatgtctatgtacagtataaatctcttgattctgctctgcttgcttataactcggtgaatggtcgctactttgctgggaaacagagaaagttcagctctatactgaaagcttatgtcaggtttaaagttcagagtgagtttttccaaaggatggttgttttggttcacagatgttttacgatcaagtgcagaagacttgaattgcttgacgttgttcatatgtttttctcattattctcatctggctatgatttatggcagacttgttctcatggaacagcatgcaattttatccactgttttcgtaatcctggcggagactatgaatgggctgattctgacaaacctcccccgaaattttgggtaaaaaagatgatcactttatttggtttttctgatgattatgagacttcaagggagcaaggaaatttgagtttgtcaaaaacagattctgacagaaaacagcaagatgaaacaaagcatagaactcctgataaggattggaatgccaactttaaaaggaaatccagaggcagaactcctgattccgattcggattctgactgggaatggttagaaaaggaggaaaatagggaaaggcaccatgtatacactctgaatagtagaagccatgaagaagattctgatgtggaatgggatagtaggggtggcggtgatgcttctgaatccgacaaagatttgcttggtagaggagagatggaaacacaacatgattattactctaggaaaaggtcaagacacagaagaagatcaggtcttcaggatgagtataaataccatgagaatgaaaatgacaaagtttatggagattggtctcgtaaggactgttcccagcgagaagagcatcatcataaaaagaagacatcaaaacattag

SEQ ID NO: 37426 - DNA, 430 bp, Glycine max
  Peptide Sequence Number=SeqID_129111
ggattcagattggtgtggtgataaggatgataggaaaagcactgctggcctgtcaagctctatagctggaagctttaatggaagaactaaactcgagaaattgcagtcctatgaggaaaagcttgaattggagttttgcaggtctgaagatcaagttgtagacatactaactaagacattgaagtctatcaagttcaaggaattgagagacaaggagaaaaatagttttagaaagtatttagtgagactcgtgagggtgggagacaaggaggttgtaaaggataacgccgcaggagtaggagttgggcttcgagctgtcgtagtggacaaagcggaggatcttcggcacgatgaagacggggtccacatgttgtgtggaggagcttgtcacagaggtagtggtgggcgacgccgcagcggtggcatctag

SEQ ID NO: 37427 - DNA, 168 bp, Glycine max
  Peptide Sequence Number=SeqID_129112
atggctttaaaaggtcttgatgatgctccacagcctaaatcaaaggctcctgctaggtggattgtcgtcaattattttaacgatcctagatcattggagccagagagattaaaggcattgcggatccagtgggcacagtattatctccgagttagagatcagacctag

SEQ ID NO: 37428 - DNA, 138 bp, Glycine max
  Peptide Sequence Number=SeqID_129113
atgaagggaggagagcataaatatgggtttaacaacaataaacgtgagaagccacagaaggtgttcatgttattccttcatcattcaacgtcttcatgtcattccttccccgagagtttcaagtactcttctgaatga

SEQ ID NO: 37429 - DNA, 519 bp, Glycine max
  Peptide Sequence Number=SeqID_129114
atgactaatgcaaactatctgcaagaatcattgcattcaatctcaaacgggaatctaagacttggtctcaagtttgctttcactcatttcaatactgaaaacgaggatggaatcaagagcaaaccctacatatttctcctgggactactaatgagtcaatataccctaattgggtatgatgcatcagctccatatgttactagcatcccttacattttgagtgaaagtaatgatgctggtggctatgccattgctgaaatgttttatcaggctttcaagacaagatatggaaatggaattgggggtattatttgcttgtggctatctaattggcctgattcttcacaacatgtaatccaaagggattttttagaccagtgcccaattatttgtaaaacagatatggtggactggggtcctaagccctttaggacttttccaagagtatcaaacacaaacagtatgaaagaaagatgggaacaacagatatgcacaacaattcctagcatctgcttataa

SEQ ID NO: 37430 - DNA, 369 bp, Glycine max
  Peptide Sequence Number=SeqID_129115
atggggctaccacccactattgcaacatgctttctcatattggtgctacctcttgttgtgctatgtttgtggaagctgctaaactgggtgtggttgaggccaaagaaattggagcgggcattaagggcacagggtcttcagggcaatccctacagacttttggttggagacaatcgggaaaagtttaggattctcatgaatgcttccaaatctcaacaatccacgagttctctctcagatgataagaacgtagcaccgcatatcgtgacctttaaccatcacattgtcaacaaattcggtacgtacacttttttaccatcgcttagtctatggtgttatatgcaatatttgctccttcgatattcatga

SEQ ID NO: 37431 - DNA, 105 bp, Glycine max
  Peptide Sequence Number=SeqID_129116
atggcgtgttgttgggtgaatggagtgatggctggatggaatgatcatgcgatagcggatgcccttcaagacttagctcaggctatagagaatccaaataggtga

SEQ ID NO: 37432 - DNA, 588 bp, Glycine max
  Peptide Sequence Number=SeqID_129117
atgggtgtcgtcaagtacatgaccatggatgaattaaagtgcctaagcatcccctcagaaatgcttaaattctttaaccactctagtttcccacacaagggacatccgacaaggaaaatcaacatgcaacaaggacagatatatattctcgtagctacattccctgaccctaactatggtgttaaaactgtaaattttataataaactcccctcacctattggtttttgcaaaggaagcgcaaaacatacaatggtggttccaaagtcagaaaagatgtaaagacaagttgaaactaacaaggaacaagcatagaatcatgggttcctctcagtgtggggtttcaacggagaacaacggcggtccgtggtggccaccggtggttgtgggtgatggagaagaagcttgggacattggaaatggttttggaagaaggaaggagaaagaaaatggtgtttttccaaggttacacgaaatacaaaggctgaaacactcaaatgcttatgctctcgggaaacgaagcgtttctcacacaccagaagacatatcgcagatcgcaacgattaggttgtggaaatctgtcctatga

SEQ ID NO: 37433 - DNA, 975 bp, Glycine max
  Peptide Sequence Number=SeqID_129118
atggtgttggaaactcctaaattgggtgtggacgaggccaaagagattagagaggatattatgggcccagggccttcaggggaatcttttgataggggactattaggaatcaagcttgggaacgagaaccacctagcttcgagggctaggaacctccatagaagaagaggcagagagagactaagggagaacttgctgttggaacaaggccccacaagcaaaatagaaaagctaacaaaatggaatatcctaacaaccatattcccttattccactacctacatatcttctagaaagcacgatgctagtgctgtgcgcttccttcacgattatgccagctgcatgggtctcatgctttttgcttcttgcaacccccttacttcctgcagacctccccctatttccacacgtatcattccacggcccttggaaattcaccttgccttcaaggtgatacgctcaaccatgactaccaaggtaataccagggtcccagggtctgtggcggcaaaactcactcagcttagcacctgcccgtagtgccaagacagctggtctgcacttgcgtgagaccatgatagacccaaagaatccagccggcaagattgtgggtcgcggtgaggttatggactggagctgtatgggtgcgaaaggtggcgacggaggcgtcgtggctggtggaggtggcggcggaggcgtcgtaacgggcggaagtggcacggtcgtgaatgcgtcgttgaagaaggttgtcgatggtggtggccaaggtgtcaatggaagtggtgaggttgtgttggctgaggagggtggtcttgcagttgtggagggcagccatggaggcttcgtacgatgggtagtgtggatggtgggtggtatggcagccatggaaggcagccatgaactcaagcttgggaacgagaaccacctagcttcgagggctagaacctccatagaagaagagggaaagagagactaa

SEQ ID NO: 37434 - DNA, 535 bp, Glycine max
  Peptide Sequence Number=SeqID_129119
atggcagaatcgtcaaagaagagaaagggatcatcctccaccgccgctgctgctgcccatcgccgccacggaccatccgaatcacccacaacacctatccatccttctttgtcatctccaagatcatccattctgttttcttccgatgatcagcgtctacggtacctttctccattttcttctaggatcattttagaccctaagtacctagacgtagatttcttcaatgatgagacatttgactattatcaagtgtttcaaaattttggcttggttgatttcatgtcattaaaattgccttattatcctgaacttgtcaaagtcttttactgcaatttaaaaattcaggatggcattttttcttctgaggtgcatggtattcccatgatcattgatcaatcattgttcttttctttgactaaattacccagtcaaggtgcaccttttgagggcaccatttttgatgattggaaatttgattactctagtcatgatgctcgccgtatggtttgcaatgaccaggctgaaatgaccg

SEQ ID NO: 37435 - DNA, 144 bp, Glycine max
  Peptide Sequence Number=SeqID_129120
atgacaacggtagatctttggacatggaatataagtgaagacctggagatcccttgtatcgaaagtctttctacagtgggttcaagcgacatatcccgtaggtgtagcggcggtacaagtatcaagagcgcatgtgggctctaa

SEQ ID NO: 37436 - DNA, 135 bp, Glycine max
  Peptide Sequence Number=SeqID_129121
atggaagggaaaatggagccagacaacacagatcttatgaacccactttctcaaaattgggtgccagttacggaagtgcccttgcttttgggtttaataacggaaaacggatcctcaggcagcgatgaggtataa

SEQ ID NO: 37437 - DNA, 294 bp, Glycine max
  Peptide Sequence Number=SeqID_129122
atgacgccagtggagatggcgcctttgacagggacgagccacgtggcatgtcgtcactgtgactggcgacaaaggactgcatatcgcagctcctattggcgcgtccaaaggctgcagcacctgcagctgcagggtcgtagctggaaggcgctactcgaggtggcgatttgggtgaaaaagaaggtggttgctgttgagagagaggtagctggtggttgcttgtgtgttgagagtggtgctgatcagtttgtcttcttccattttataaaagcttttttaggtagtataagataa

SEQ ID NO: 37438 - DNA, 1452 bp, Glycine max
  Peptide Sequence Number=SeqID_129123
tacaccccctgcgaggacgtgcaacgctccctgaagttcccgcgcgagaacctcatctaccgggagcggcactgcccgacggaggaggaattgctccggtgcagggttccggcacctttcgggtaccgcgtgccgctgcgatggccggagagccgcgacgctgcgtggttcgcgaacgtgcctcacaaggagctgaccgtggagaagaagaaccagaattgggtccggttcgaaggggaccggttcaggttccccggcggtgggaccatgtttccacgtggcgccgacgcgtacatcgacgacatcggaaaactcattgaccttaaagatgggtccatcagaaccgccctagacactggctgtggggttgcaagttggggtgcttatcttctgtcacgtgacatattagcagtgtcatttgcaccaagagatacacatgaagctcaagttcaatttgctcttgaacgaggagttcctgcattgattggagttcttgcctcaattaggcttccttacccatcaagatcctttgacatggcccattgctcacgttgcctcattccctggggtcagaatgaggggatttatttgaatgaagttgatcgagttctacgtcctggtgggtattggattctatcagggccacccataaactgggagaatcactggaatggttggaagaggactcgtgagagtctcaaagaggaacaggatggaattgagaaagtggcaaaaagcttatgctggaaaaagttggtgcaaaagggtgaccttgcaatatggcagaagcccaccaatcatattcactgcaaaatcacgcgaaaggtctacaagaatagacccttctgtgaggcaaaggatcccgacacagcatggtacactaaaatggatatctgcttgacaccactgccagaggtgaatgacatcagagaagttagtggcggcgaattgccaaagtggccccagagactaaaatcagttccaccaaggattagtagtggaagtttgaagggaattacagagcgtgggagataccgtaatctgcttgatatgaatgcttacttgggaggctttgcagctgcactgattgatgatcctgtgtgggtgatgaacactgttcctgttgaggctgaggtcaacacacttggtgccatatatgaacgtgtgaagccatgtccacttaccctcgaacttatgacttcatacatggtgactcagtttttagcctctaccagaacagcagtggaatttttcatgcaaatcgctagcatgaacagcaccacactcaggcatgcgacacgtggctgtgtcgcctctgccacaggcgacagcagtgatgtcgccacctgcaatggcgctttggccatgcaggctggagtcgctggtcaaaccagcgcttccctacgcgtagcagcagcttttgcaggtgcagcagtgaaggtgcagcactga

SEQ ID NO: 37439 - DNA, 8364 bp, Glycine max
  Peptide Sequence Number=SeqID_129124
atggacccaattacctctgttgctgcccaaagtgccctagaaattgcaaaacaagtggtcaatcgacaagtgggttacatatttcattacaaagacaaattgaaagaggtggaacaatacattgagaggctgaatgatactaggaagagggttcaaaatgaagttaattctgcagagaagaacggagaagaaattgaagatgacgttcagcattggttaaaaaaggtggatgaaaagataaaaaaatatgagtgttttattaatgatgaacgccatgcacagacaaggtgttccattagattgatctttccaaataacttgtggttgaggtatcggttaggcagaaatgctacaaagatgatagaggaaatcaaagcagatggacattcaaataaaaggtttgataaagtttcatatcggttgggcccatccttcgatgctgctttgtcaaacaccggttatgtgagctttggttcgagaaatgaaattatgaagaagattatgaaagcactggaagactcgacagttaatattgttggagtttatggggctggtggtgtgggtaagactactttagtcaaagaagttgctaacaaagctcgagaaaagaagttgttcaatatggtggtcatggcaaatgtaacaagaattcctgacatacaaaaaattcaagaacaaattgctgagatgttgggaatgagattggaagaggaaagtgaaattgtaagagcagatcgcattcgaaagaggttaaagaaagaaaaggagaacacccttataatcctagatgatctctgggatggattgaacttgaatatattggggattccacgtagtgaggatgacaatgggagccaacaagatgccaatgatttatctgattttggttacaataatatggaaaaagaagtattttctgccgatttcaatatgatgaaaaaagacaagttatctgttgattccaatacgataaaaaaagaaaagttatcaggtgatcacaagggatgcaaaattcttctaacatctagaagtaaagaagtaatatgtaataaaatggatgtgcaggagagatcaactttctcggtaggagtccttgatgaaaacgaggcaaagactttgcttaagaaagaggctggaatacatgtccaaagttttgagtttgatgagaaagtcattgagattgccaaaatgtgtgatggattgcctatagcattagtttccataggaagaatgggaaatgatgctttgattatgaacttggtgaagttctgtattgggttaggtttgcttcaaggggtccacacaattagagaagcgagaaacaaagtaaatatactgatagaggagctaaaagaatcaactttgttgggggaaagttactctcgtgaccgcttcaacatgcatgacattgtgcgggatgttgctctttcaatatcatccaaagaaaaacatgtattttttatgaaaaatggcatactagatgagtggccacacaaagatgaacttgaaaggtacactgctatatgtttacacttttgtgatatcaatgatgggcttcccgagagtatacactgtcctagacttgaagtcttacatatagacaacatagatgattttttgaaaataccagacaacttttttaaggatatgattgaactcagagtcttgatattgactggtgttaatctttcatgcttaccttcttctattaaatgcctaaaaaaactgagaatgcttagtttggagagatgcactctaggagagaacttatcaatcattggagagttaaagaaattacgaattcttactctttcaggatctaacattgaaagtttgcctcttgaatttgggcaattggataagctgcaactttttgacataagcaattgctcaaaactaagagtaataccttccaatatcatatcaaggatgaacagtttggaagagttttacatgagagacagcttgattctgtgggaggctgaggagaatatccaaagtcaaaatgctagtctttctgagttgaggcacttgaatcagttgcaaaatctagacatacacattcaaagtgtttcccattttccgcagaacttgtttttggacatgttggatagttacaagattttcattggtgaattcaacatgcttacagtgggagaattcaaaatccctgacatttatgaagaagcgaaatttttggcattgaacctaaaagaaggtattgacattcattctgaaacatgggttaaaatgttgttcaagagtgttgaatatttgctgctgggacaactcaatgatgttcatgatgttttttatgaattaaatgttgaaggatttccatatttgaaacatttatccattgtaaacaattttggtattcaatatattatcaactcagtggagcggtttcaccctttactggcttttcccaaattggagtccatgtgtctttacaaactggataatttggagaaattatgtgttaataatcagcttgaagaggcctctttttgcagattaaaaatcatcaagattaaaacatgtgatagattggaaaacattttcccatttttcatggtaagacttctcaccctgcttgaaacaattgaagtgtgtgactgtgattctctgaaggagatagtttctgttgaaagacaaacacatactatcaatgatgacaagattgagttcccgcaattacgacttttaacattgaaatctttaccagcatttgcttgtttatataccaatgacaagataccttgtagtgcacattcattggaagtccaagtgcaaaacagaaacaaagatattatcactgaagttgagcaaggtgccgccagttcttgcatatcactcttcaatgaaaagtttggactctttgataataagagagtgccacaaacttgttacgatttttcctcgttatatggggcaaagatttcagagccttcaaagcttgataattacagattgcaagcgttgccaaatttggtgcatatatggaagaatgacagcagtgaaatacttaaatataataatttgcaaagcataaggattaaagggtgtccgaatttaaagcatctctttccactttctgttgccactgacttagaaaaattggaaatccttgatgtgtacaactgcagggcaatgaaggagattgttgcttgggataacggttcaaatgaaaatcttatcacctttaagtttccgcggctaaacattgtatcattaaaattatcatttgagcttgtgagtttctatagaggaactcacactttagagtggccatcattgaataaattgtccatagtcgattgtttcaagctggaagggctcactaaagatatcacaaactcacaagggaagccaattgttttggctacagaaaaggtgatatacaacttggaatctatggaaatgagcttgaaggaagcagagtggttgcagaaatacattgttagtgttcacagaatgcacaaactacaaagacttgtcttgtatgaattgaagaatactgaaattctcttttggtttcttcatagacttcccaatttgaaaagcttaacattggggagttgtcacttgaaaagtatttgggctcctgcaagcctcatttcacgtgataaaataggtgttgttatgcaacttaaggagttggaattaaagagtttgttgtctttagaagagataggattcgagcatgacccacttcttcagaggatagagcgcttagtcatttatcgatgtataaaattgacaaatttagcatcatccatagtatcttacagttacataaaacatttggaagtgaggaattgtagatcgatgaggcatttaatggcatcttcaactgctaaaagcttggttcaactcacaaccatgaaggtacgcttatgtgaaatgattgtggaaattgttgcagaaaatgaagaggaaaaatgtgacttcaaattcccattactggaaagtttagtagtgagtgagtgccctcaaatgaaaaaattctcgaaagtccaaattactccaaaccttaaaaaagtacatgttgtagccggagaaaaagacaaatggtactgggaaggtgatttgaatgccactctacaaaaacatttcacagaccaggtttctttcgaatattcaaagcataagagacttgttgattatcctcagaccaagggttttcggcacggcaaacctgcttttccggagaacttctttggctgtttgaagaaattggaatttgatggagaaagtataagacagattgtaattccatctcatgtacttccttacttgaagaccttagaagaattgtatgtacataactccgatgcagcgcagataatatttgacaccgttgacactgaggcaaagaccaagggaatagtctttcgtttgaaaaagcttactctagaggacttgtcaagtttgaaatgtgtatggaacaaaaacccaccaggaactttaagctttcgcaatttgcaagaagtggtcgttctaaattgtagaagcttgtcaacactgttccctttctcccttgcccgaaatcttgggaaacttaagacccttgaaatacagaactgtgacaagttggtagaaattgttggaaaggaagatgtgacggaacatggaacaactgaaatgtttgaattcccttgtttgtggcagttgcttctttataagctgtcactgcttagttgcttttatcctggaaaacaccatctggaatgccccgtattaaaatgcttggatgtgtcctattgtcctaagttgaagctattcacatcagaatttggagatagtcccaaacaagcagttatagaggctccaattagccaactacaacaacaacctctgttctcgattgaaaagattgttcccaatctggagaatttgacactcaatgaggaagacattatgctgttgagcgatgcacatttgccacaagacttccttttcaaattaactgatcttgatctatcctttgagaatgatgacaataagaaagacactttgccttttgatttccttcagaaggtacccagcttagaacatcttcgagtggaaagttgctatggtctgaaggagatatttccctctcagaaactccaagttcatgaccgttcacttcccgcattgaaacaattaacactgtatgatcttggagagctggagtcgatagggttagagcacccatggggtaagccatactctcaaaaacttcaattattaatgctttggaggtgccctcagttagaaaaactagtgagctgtgcagtgtctttcatcaatctgaaagagttggaagtgacgaactgtgatatgatggaatatttattgaaatactcaactgccaaaagtttgttgcaacttgagaggctatctataagagaatgtgaatcaatgaaggaaatagtaaaaaaagaagaagaagatgcttctgatgagatcatatttggaagcctcagaagaataatgttggattcattaccaaggctagtaaggttttattcagggaatgccactttgcatttcacgtgtttgcaagtagcgacaattgctgaatgccacaatatgcaaacattctctgaaggaattattgatgcgccattatttgaggggattaaaacttcaacagatgatgctgatttaaccccccaccatgatctcaacacgacaatcgagaccttgtttcaccaacaggtattttttgaatattcaaagcatatgatccttctcgattaccttgagacaacgggtgttaggcacggcaaacctgcttttctgaagaatttcttgggcagtttaaagaaattagaatttgatggagcgattaaaagagagattgtaattccatctcatgtacttccttacttgaagaccttagaagaattgaatgtacatagctccgatgcagcgcaggtaatatttgacatagatgacactgatgccaacaccaagggaatggtccttccattgaaaaatcttactttaaaagacttgccaaatttgaaatgtgtatggaacaaaaacccccaaggtctcggctttcccaatttgcaacaagtgtttgttactaaatgtagaagcctggcaacattgttccctttgtcccttgccaaaaatcttgggaagcttcagacacttacagtactgaggtgtgacaagttggtagaaattgttggaaaggaagatgcaatggaacttggaagaacagaaatatttgaattcccttgtttgttggagttgtgtctttataagctgtcactgcttagttgcttttatcctggaaaacaccatctggaatgccccgtattaaaatgcttggatgtgtcctactgtcctatgttgaagctattcacatcagaatttcaaaatagtcacaaagaagcagttatagagcaacctcttttcatggttgaaaaggttgatcccaaactgaaggaattgacactcaatgaagaaaacattatcttgttgagggatgcacatttgccacaagacttcctttacaaattaaatattcttgatctgtcctttgatgattatgagaataagaaagatactttgccttttgatttccttcacaaggtacccagtgtagaatgtcttcgagtgcaaagatgctatggtctcaaggagatatttccctctcaaaagctccaagttcatcacggaatacttgcgcgattgaatcaattagagttaaacaaactaaaagagttggagtcgatagggttggagcacccatgggtaaagccatactctgcaaagcttgaaatattaaatattcgcaaatgctctcggttagaaaaagtagtgtcttgtgcagtatctttcattagtctcaaagagttgtatttgagtgactgtgaaaggatggagtatttattcacatcttcaacggccaaaagtttggtgcaacttaagatcctatatatagaaaaatgtgaatcaataaaagaaatagtaagaaaagaagatgaaagcgatgcttctgaagagatcatatttggacggctcacaaaattatggttggaatccttaggaaggctagtaaggttttattcaggggatgacaccttgcaattctcatgtttggaagaagccaccataactgaatgccccaatatgaatactttctctgaaggattcgtaaatgcgccaatgtttgaggggattaaaacttcaagggaggattctgatttaacattccaccatgatctcaactccacaatcaagaagttgtttcaccaacatatcgaggtaagcaactgccaatctgttaaggcaatatttgatatgaaaggtacaaaggcagatatgaagccaggttctcagttttctcttcctttgaagaaactgattctaaatcagttgccgaatctggagcatatctggaatccgaatcctgatgaaattctcagccttcaagaagtgtgcatttctaactgtcaaagcctcaaaagtttgtttccaacatcagtggccaatcatcttgctaagcttgatgtgagatcttgtgcaacattggaagaaatttttgtagaaaatgaagcagccttgaagggagaaactaaactgttcaatttccattgtctgacctcattaacattatgggaattaccagagctgaagtatttctacaatggaaaacactcactagaatggccaatgctaacacaactagatgtatatcattgtgacaagttgaaattgtttacaactgagcatcatagtggtgaagttgcagatatagagtacccacttcgtacttcaattgatcagcaagccgttttctcagttgaaaaggtcatgcctagcttggagcatcaagcaatcgcttgcaaagacaatatgattgggcaaggacaatttgttgcaaatgctgcacacctcctgcaaaatttaagagttctcaaattgatgtgttaccatgaggatgatgagtcaaatatattctccagtggattggaagagatatccagcattgaaaatcttgaagtgttctgtagttccttcaatgaaatattctcctctcagatacctagcaccaattgtaccaaagtcctttcaaagctgaaaaaattacatttgaagagtctccaacagctgaattccataggattagaacactcatgggtggaacccttacttaaaacactagaaacattggaagtgttttcttgccctagcatcaaaaacttggtgccgtcaaccgtgtcttttgcaaatcttacctctttgaatgttgaagaatgccatggattggtatatttgttcacatcctcaacagccaaaagtctaggtcaactgaagcatattccatacgggattgccaagcaatacaagaaatag

SEQ ID NO: 37440 - DNA, 138 bp, Glycine max
  Peptide Sequence Number=SeqID_129125
atggtggtaatggaacaagtgtccaagtggaatttgtttcaagagcttagatttcctcatgcattgctcgacgccattcaggataaggaacaacttgatgatacaactgaggttcatagacagctgagatgtgattaa

SEQ ID NO: 37441 - DNA, 6426 bp, Glycine max
  Peptide Sequence Number=SeqID_129126
atggacccaattacttctgccactgcccaaagtgcactgcaaattgcagaacatgtggtcaaacgacaattgggttacatatttaattacaaagacaaatttaaagaggtggaacaatacattgagaggatggatgataataggaagagggttcaaaataaagttgatgatgcagagaagaacggagaagaaattgaagatgatgttcaacattggttaaaacaggttgatgagaagataaaaaaatatgagtgttttatcaatgatgaacgccatgcacagacaaggtgttccattagagtgatctttccaaataacttgtggttgaggtatcggttaggcagaaatgctacaaagatggtagaggaaatcaaagcggatggacattcaaataaagagtttgataaagtttcatatcggttgggcccatccttcgatgctgctttgttaaacactggttatgtgagctttgggtcgagaaatgaaactatggagaagattatgaaagcgctggaagactcgacagttaatattgttggagtttatggggctggtggtgtgggtaagactactttagtcaaagaagttgctgacaaagctcgagaaaagaagttgttcaatatggtggtcatggcaaatgtaacaagaattcctgacatagaacgaattcaaggacaaattgctgagatgttgggaatgagattggaagaggaaagtgaaattgtaagagcagatcgcattcgaaagaggttaatgaaagaaaaggagaacacccttataatcctagatgatctctgggatggattgaacttgaatatactggggattccacgtagtgaggatgacgatgggagccaacaagatgtcaatgatttatctgattttggttacaataagatggaaaaagaagtgttttctgccgatttcaatacaatgaaaaaagacaagttagctgtcgatttcagtatgacgaaaaaaggcaagttatctgttgattccaatatgataaaaaaagaaaagttatcaggtgatcacaagggatgcaaaattcttctaacatccagaagtaaagaagtaatatgtaataaaatggatgtgcaggagagatcaactttctcggtaggagtccttgatgaaaacgaggcaaagactttgcttaagaaattggcgggaatacgtgcccaaagttcagagtttgatgagaaagtcattgaaattgccaaaatgtgcgatggattgcctatggcattagtttccataggaagggcactaaagaataaaagctcctttgtatggcaggatgtctgtcaacaaattaaaagacaaagttttacagaagggcacgaatctatggagttcactgtaaagttgagctatgatcatctaaaaaatgagcagctgaaacatatttttttactgtgtgctagaatgggaaatgatgctttgattatgaacttagtgatgctctgtattgggttgggtttgcttcaaggggtccacacaattagagaagcgagaaacaaagtaaatatactgatagaggagttaaaagaatcaactttgttgggggaaagttactctcgtgaccgcttcaacatgcatgacattgtgcgggatgttgctctttcaatatcatccaaagaaaaacatgtattttttatgaaaaatggcatactagatgagtggcctcacaaagatgaacttgaaaggtacactgctatatgtttacacttttgtgatatcaatgatgggcttcccgagagtatacactgtcctagacttgaagtcttacatattgacagtaaagatgattttttgaaaataccagatgacttttttaaagatatgattgaactcagagtcttgatattgactggtgttaatctttcatgcttaccttcttctattaaatgcctaaaaaaactgagaatgcttagtttggagagatgcactctaggagagaacttatcaattgttggagagttaaagaaattacgaattcttactctttcaggatctaacattgaaagtttgcctcttgaatttgggcaattggataagctgcaactttttgacttaagcaattgctcaaaactaagagtaataccttccaatatcatatcaaagatgaacagtttggaagagttttacttgagagacagtttgattctgtgggaggctgaggagaatatccaaagtcaaaatgctagtctttctgagttgaggcacttgaatcagttgcaaaatctagacgtacacattcagagtgtttcccattttccgcagaacttgtttttggacatgctggatagttacaagattgtcattggtgaattcaacatgcttacagagggagaattcaaaatccctgacatgtatgacaaagcgaaattcttggcattgaacctaaaagaagatattgacattcattctgaaacatgggttaaaatgttgttcaagagtgttgaatatttgctgctaggagaactcaatgatgtttatgatgttttatatgaattaaatgttgaaggatttccatatttgaaacatttatccattgtgaacaacttttgtattcaatatattattaactcagtggagcggtttcaccctttactggcttttccgaaattggagtccatgtgtctttacaaactggataatttggagaaaatatgtggcaataatcatcttgaagaggcctccttttgcagattaaaagtcatcaagattaaaacatgtgataaattggaatacattttcccatttttcatggtcggacttctcaccatgcttgaaacgattgaagtgtgtgactgtgattctctgaaggagatagtttctattgaaagacaaacgcatactatcaatgatgacaagattgagttccctaaattacgagttttaacattgaaatctttaccagcatttgcttgtttatataccaacgacaagatgccttgtagtgcacaatcattggaagtccaagtgcaaaacagaaacaaagatattatcactgaagttgagcaaggtgccactagttcttgcatatcactcttcaatgaaaaggtttcaattcccaaattagaatggttggagttatcctcaatcaacatccagaagatatggagtgaccaatctcagcattgttttcaaaatttgcttacattgaatgtgacagattgtggtgatttaaaatatttactgtcattctccatggctggaagtttgatgaatctacaaagcctttttgtaagtgcatgtgaaatgatggaggatatattttgtccagaacatgcagagaatattgatgtttttcctaagttgaagaaaatggagatcatctgcatggagaaacttaataccatttggcaaccccatattggtcttcattcgtttcacagtttggactctttgataataggagagtgccacaaacttgttacgatttttcctagttatatggggcaaagatttcagagccttcaaagcttgacaattacaaattgccagttagtggaaaacatatttgactttgaaaatattccacaaactggtgttaggaatgaaacaaacttgcaaaatgtatttctgaaggccttgccaaatttggtgcacatatggaaggaggacagcagtgaaatacttaaatataataatctgaaaagcataagcattaatgagagtccaaatttaaaacatctctttccactttctgttgccactgacttagaaaaactagaaatccttgatgtatacaattgcagggcaatgaaggagattgttgcttggggcaatggttcaaatgaaaatgctatcacgtttaagtttcctcagctaaacactgtatcattacaaaattcagttgaacttgtgagtttctacagaggaactcacgctttagagtggccatcgttgaagaaattgtccatactcaattgtttcaagctggaagggctcactaaagacatcacaaactcacaagggaagccaattgtgtcggctacagaaaaggtgatatacaacttagaatctatggaaatcagcttgaaggaagcagagtggttgcagaaatacattgttagtgttcacagaatgcacaaactacaaagacttgtcttgaatggattggagaatactgaaattcccttttggtttcttcatagacttcccaatttgaaaagcttaacattggggagttgtcaattgaaaagtatttgggctcctgcaagcctcatttcacgtgataaaataggtgttgttatgcaacttaaggagttggaattaaagagtttgttgtctttagaagagataggattggagcatgacccacttcttcagaggatagagcgcttagtcattagtcgatgtatgaaattgacaaatttagcatcatccatagcatcttacaattacataacacatttggaagtgagaaattgtagatcgctgaggaatttaatgacatcctcaactgctaaaagcttggttcaactcacaaccatgaaggtattcttatgtgaaatgattgtggaaatcgttgcagaaaatggagaggaaaaagtacaagagattgagtttagacaattaaaatctttagaattggtgtctctaaaaaatctcacaagttttagcagttccgagaagtgtgacttcaaattcccattactggaaagtttagtagtgagtgaatgccctcaaatgaaaaaattctctaaagtccaaagtgctccaaaccttaaaaaagtacatgttgtagctggagaaaaagacaaatggtattgggaaggtgatttgaatgacactctacaaaagcatttcacacatcaggtttctttcgaatattcaaagcataagagacttgttgattatcctgagaccaaggcttttcggcacggcaaacctgcttttccggagaacttctttggctgtttgaagaaattggaatttgatggagaaagtataagacagattgttattccatctcatgtacttccttacttgaagaccttagaagaattgtatgtacataactccgatgcagtgcagataatatttgacatggatcacagtgaggcaaagaccaagggtatagtctctcgtttgaaaaaacttactctagaagacttgtcaaatttggaatgtgtatggaacaaaaacccacgaggaactctcagctttccccatctgcaagaagtggtcgtttttaaatgtagaaccttggcaagactgttccctttgtcccttgcccgaaatcttgggaaacttaagacccttgaaatacagatctgtgacaagttggtagaaattgttggaaaggaagatgtgacggaacatggaacaactgaaatgtttgaattcccttgtttgtggaagttgattctttataagctgtcactgcttagttgcttttatcctggaaaacaccatctggaatgccccgtattaaaatgcttggatgtgtcctattgtcctaagttgaagctattcacatcagaatttggagatagtcccaaacaagcagttatagaggctccaattagccaactacaacaacaacctctgttctcgattgaaaagattgttcccaatctggaggaattgacactcaatgaggaagacattatgctgttgagcgatgcacatttgccacaagacttccttttcaaattaactgatcttgatctatcctttgagaatgatgacaataagaaagagactttgccttttgatttccttcagaaggtacccagcttagattatcttcgagtggaaaggtgctatggtctgaaggagatatttccctctcagaaattccaagttcatgaccgttcacttcccggattgaaacaattaagactgtatgatcttggagagctggagtcgatagggttagagcacccatgggttaagccatactctcaaaagcttcaattattaaagctttgggggtgccctcagttagaagaattagtgagctgtgcagtgtctttcatcaatctaaaagagttggaagtgacgaactgtaataggatggagtatttattgaaatgctcaactgccaaaagtttgttgcaacttgagagcctatctataagtgaatgtgaatcaatgaaggaaatagtaaaaaaagaagaagaagatgcttctgatgagatcacatttggaagcctcagaagaataatgttggattcattaccaaggctagtaaggttttattcagggaatgccactttgcatttcaagtgtttggaagaagccacgattgctgaatgccagaatatgaaaacattctcagaaggaataatagatgcgccattattagaggggattaaaacttcaacagaggatactgatcacttaacctccaaccatgatctcaacaccacaatccagacgttgtttcaccaacagggggcatgctaa

SEQ ID NO: 37442 - DNA, 477 bp, Glycine max
  Peptide Sequence Number=SeqID_129127
gtgacagcggaggccgcggcagaggttcgggtcgtcggggcagtcggaggagaagggcatccagcagtcatggaagtggcgtatggtgagtggcagccattgaaggcggtcgtgggagctccgtacggcacgaggggttctctcgggatcgaacaagctcagcaaccgttggcgggtactctcaaaatcaatcccaagggattgagctggatgcgcaaagggaggagtggtgtgcagcaacgaagggtccagcacctccgagagaaagagagagtgagggagagagaagataaactaagggaagagctttcttttgcttttgatattttcctcatgacaattgccctctactttgaacgtggcactagacaatgtgtgtgggaaaggagagtttttggtatttggtgctgcgagttagggggagttacatggtgcaaagggaaatggttgaacatatatgctgccggagagccttga

SEQ ID NO: 37443 - DNA, 3093 bp, Glycine max
  Peptide Sequence Number=SeqID_129128
atggctttgaaggtattttttgaatattcaaagcatatgatccttgtcgattaccttgagacaacgggtgttaggcacggcaaacctgcttttctgaagaatttctttggcggtttaaagaaattagaatttgatggggagattaagagagagatcgtaattccatctcatgtacttccttacttgaagaccttagaagaattgaatgtacatagctccgatgctgtgcaggtaatatttgacatagatgacagtgatgccaacaccaagggaatggtccttccattgaaaaagcttactctaaaaggcttgtcaaatttgaaatgtgtatggaacaaaaccctccgaaggattctcagctttcccaatttgcaagtagtgtttgttacgaaatgtagaagcttggcaacattgttccctttgtcccttgccaaaaatcttgtaaatcttgagacacttacagtatggaggtgtgacaagttggtagaaattgttggaaaggaagatgcaatggaacttggaagaactgaaatatttgaattcccttgtttgtcgaagttgtatctttataagctgtcactgcttagttgcttttatcctggaaaacaccatctggaatgccccgtattagaatgcctggatgtgtcctattgtcctaagttgaagctattcacatcagaatttcataatagtcacagagaagcagttatagagcaacctcttttcatggttgaaaaggttgatcccaaactgaaggaattgacactcaatgaagaaaacattatcttgttgagggatgcacatttgccgcaagacttcctttgcaaattaaatattcttgatctgtcctttgatgattatgagaataagaaagatactttgccttttgatttccttcacaaggtaccccgtgtagaatgtcttcgagtgcaaagatgctatggtctcaaggagatatttccctctcaaaagctccaagttcatcacggaatacttgcacgattgaatgaattatacttatttaaactaaaagagttggagtcgatagggttggagcacccatgggtaaagccatactctgcaaagcttgaaacattagaaattcgcaaatgctctcggttagagaaagtagtgtcttgtgcagtatctttcagcagtctcaaagagttgcaagtgagtgagtgtgaaaggatggagtatttattcacatcttcaactgccaaaagtttggtgcaacttaagatgctatatatagaaaaatgtgaatcaataaaagaaatagtaagaaaagaagatgaaagcgatgcttctgaagagatgatatttggacggctcacaaaattaaggttggagtccttaggaaggctagtaaggttttattcaggggatggcaccttgcaattctcatgtttggaagaagccaccatagctgaatgccccaatatgaatactttctctgaaggattcgtaaatgcgccaatgtttgaggggattaaaacttcaagggaggattctgatttaacattccaccatgatctcaactccacaatcaagaagttgtttcaccaacatgtggaaaagtctgcatgcgatatagagcatttgaaatttgatgatcaccatcacctagaagagatatggcttggtgcagttccaatcccaagtaaaaattgtttcaacagtttgaaatctttaactgtggtggaatttgaatctttacccaatgtgattcctttttatttacttcgatttctatgtaacttgaaagagatcgaggtaagcaactgtcactctgttaaggcaatatttgatatgaaaggtgcagaggcagatatgaagccagcatctcagatttctcttcctttgaagaaactgattctaaatcagttgccgaatctggagcatatctggaatcctaatcctgatgaaattctcagccttcaagaagtgtgcatttctaactgtcaaagcctcaaaagtttgtttccaacatcagtggccaatcatcttgctaagcttgatgtgagatcttgtgcaacattggaagaaatttttttagaaaatgaagcagccttgaagggagaaactaaaccgttcaatttccattgtctgacctcattaacattatgggaattaccagagctgaagtatttctacaatggaaaacactcgctagaatggccaatgctaacacaactagatgtatatcattgtgacaagttgaaattgtttacaactgagcatcatagtggtgaagttgcagatatagagtatccacttcgtgcttcaattgatcagcaagccgttttctcagttgaaaaggtcatgcctagcttagagcatcaagcaaccacttgcgaagacaatatgattggacaaggacaatttgttgcaaatgctgcacacctcctgcaaaatttaaaagttctcaaattgatgtgctaccatgaggatgatgagtcaaatatattctccagtggattacttgaagagatatccagcattgaaaatcttgaagtgttttgtagttccttcaatgaaatattctcctctcagatacctagcaccaattataccaaagtcctttcaaagctgaaaaaattacatttgaagagtctccaacagctgaattccataggattagaacactcatgggtagaacccttacttaaaacactagaaacattggaagtgttttcttgccctaacatgaagaatttggtgccgtcgaccgtgtctttttcaaatcttacctctttgaatgtcgaagaatgccatggattggtatatttgttcacatcctcaacggccaaaagtctaggtcaactgaagcacatgtccatacgggattgccaagcaatacaggaaatagtgtccagagagggagatcatgaatccaatgatgaagagataacatttgagcagcttcgtgttttgtctctcgaatctttaccaagcatagtaggaatttactcagggaagtacaagttgaaattcccatccttggatcaagtgactttaatggaatgccctcaaatgaaatattcttatgtacctgatttgcatcaattcaagcttcttgagcaaatttaa

SEQ ID NO: 37444 - DNA, 523 bp, Glycine max
  Peptide Sequence Number=SeqID_129129
tgtcatatcagaaggtggtgttaggagtcttctggcttatcttgatggtccacttcctcaggaatctgcgtccggatccttaggtgctcagcaagcagctgcggctgcgatatgctgcgcttgcagttccacagacatgaagaaaatggttggtgaagctggctgcatccctctccttgtgaagatgcttgaggccaagtcaaacagtgttagagaggttgctgctcaagcaatagcaagcttgatggttgtgtctcagaatcgaagagaggttaagaaggatgataagagtgtgccaaacttggttcagttgcttgatccaagccctcagaatactgcaaaaaaatatgcagttacttgccttggatcactttcttcatgtaagaaatgtaagaagctaatgatctcgtatggggcaattgggtatctgaagaaacttactgagatggacattccaggagctaaaaagctgcatgaaaggttggaaagagggaaatttagaagtttgtttagcaagaaatag

SEQ ID NO: 37445 - DNA, 588 bp, Glycine max
  Peptide Sequence Number=SeqID_129130
atgttgggttcaggtaccaatttggtgaccacggtcattgggtttgggatgagtgccactttcattgtgtttgtgtgcaccagaatcatttgtgggaggctaagagggggtgttgaatctcggatgatgtacgagattgaatcaagaattgatatggaacagccagaacatcatgttaatgaccctgaatccgatcctgttcttcttgatgcaatccctactttgaagttcaaccaagaggctttcagttcccttgaacacacacagttaagttttagtctctcaattgtagattacagagaaagagaagtattgcgcatcatgcccaaatgtggccacacttttcatctttcttgcattgatatatggctgaggaaacaatccacctgtccagtatgccgtctgccgttgaaaaactcttccgaaacgaaacatgtgagacctgtgacatttaccatgagccaatcccttgacgagtctcacacatcagacagaaacgatgatattgagagatatgttgaacctacacctactgcagccagtaactctttacaaccaacttcaggagaacaagaagcaaggcaatga

SEQ ID NO: 37446 - DNA, 486 bp, Glycine max
  Peptide Sequence Number=SeqID_129131
atggcaatagagaatgagtcatgctccgtgttcacacctttcgaaacacggagtctccaggggaatgattcatgttctgtgccaaaagttgttgatatgcaacacagttttgaactatataaggccatgttcttcggttttggtgtttgtgttcattttggtgtcctccatggccttgaacactatgaaactccttgttgcgcatcatcaggttttgaagaagaacctgaattctcccaaggactccgtgattttgaaggtgtgaacatggagaatggctcgctcatagtggtgcttttgtcatgtttcaaagacagtaacagggaagtcctaatgtgtcaactaaagattcattcaccttcagcagatgaggacttgactctcaaacttagaaaacatcgtgttaatgaccctgaatccaaacctattctgcttgatgcaatccctactttgaaattcaaccaagaggctttcagttccatttaa

SEQ ID NO: 37447 - DNA, 1998 bp, Glycine max
  Peptide Sequence Number=SeqID_129132
atgggggttggtggtaatttctgggacctgctaaagccctatgcgcgcaaagagggttttgatttcttgaggaacaagcgagttgcagtggacctttcgttctggattgttcagcacgagaatgccatcaaggccacgcatgtcagaaacccccatctaaggcttaccttcttccgcaccatcaatcttttctccaagtttggagcacttccggtgttcattgttgatgggactccatcaccgttaaaatcacgggccaggattgtgagatatttccggtcttctggcattgaattggctagcttgccggtgcctgaagaaggtgtttcagctgagaggaaccacatgttttcaagtcatgttcaaaaatgtgtggaactggttgaactacttggaatgcctgtgctaaaggctaaaggagaggctgaatcactctgtgctcaattaaatagtgaaggtcatgtagatgcttgcatcacagccgacagtgatgcattcctctttggggccaactgcattataaaatgtttctgtcccaacttcaaagaaccatttgaatgctacaatatgtctgatattgaagctggacttggattgaagaggaaacacttaatagctatctctcttttggttggaaatgatcatgatataaagggtgttcgagggattgggcttgatactgcacttcgttttgttaaggcttttagtgaagaagatatattgaataggctgatgaaggttgccagagaaaaccagaggattttaaatgtgattgcttctcctgtgatatggtatgaccttacaatcagaaagtatttcagaaagccatcaagtgatggcccacacattgtatggggaaaaccgaatattgagatgctgattgattttttaaacttccatcagcattgggaaccagcttacgttcgacggatgatgtttcctatgatgtcaaccatctttttgagagatatgacaacaactacagaagagactatgttatttgggcaatatcagtttgattccatagaacgtgtcaagatgagatatggataccaattttttgtggtcaagtggaaacatgcaggggttaacatttcctgtaaagttccattgaaggaatcaagtgtgcaacaggatgctataatagagcttgatgaaacggtggatctactggatgactgtgatgttccagagattcatgaagacagtgggtgtcgttttctgcttacagatgaaaatatggaccttgtaggtgctgcttttccagcagaagtcaaaaggttttggcaagaccaggaactgaaaagaagaaagaactcaacatcaagatctcaagaaaatgaaaaatcaccatcaccaaactcaagaagtattcagctaaacattacagagttctacccatcaaccaaagttaaacatcgtcaatcaaaacaaggaggaggagagtcatccaagattgctgatagtcaaggcaatgagggctcaaaaatgaaaaggaaaatgtcaagtcctgataagattccaaaatctgtgaggcgtcgcctttttggaagtaacgaacaaccaaacatgtctccttcatcattgtgctctcttcaaacgttcccgccaatatctcacgcattgcttaaccgccaccacaaaccggcgcacgatagcaccgccggcgtacggagaagaacgccttacgtagtttgcgctgaaaaaggcagcagagcttcgacgcgaagcgcagatgattaccacgccactctcaaagctctcaactccaaaggcagattcccaagaaaatcacttggccagcattatatgttgaatgctgacataaatgaccaacttgccggtgcggctggtgttgaacaaggtgatgtggtgttggaaattgggcctggaactggttccttgactaatgttcttttaaattcgggagcatttgttcttgcagttgagaagtttgtcaacaacgagccagttagttgtacatgtttgcacatgtga

SEQ ID NO: 37448 - DNA, 1560 bp, Glycine max
  Peptide Sequence Number=SeqID_129133
atggcgagcccagaagaagcaaagctcgaaactttcatgcagtggctacaggcaaatggggtggagctacgaggttgcaagatcaagtggtgtggttccaaacgagggtttggcatcttttctgataaagatgtttgtgatggtaatatcaatatggatagagttgtaggagttggtgttattgcttgggttatgttggttgttccactagatttagcaattactccaatgagggtgttgcaagatcctcttctaggaccagcatgtagagcaatgtttgaagaaggagatgtagacgacaggttattaatgatgctgttactgactgtggagcgtttgcgtaaaaattctctatggaagccgtaccttgatatgctaccaaccacttttggaaatccactttggtttagtgatgatgaacttcaagagctaagaggaacaacattatatcgtgcaactgaattgcagaagaaaagcctgctttctttgtatgaatctaaagtgaaggatatagtgaagaaacttttgactcttgatggaaattcagagattgaggtgtgctttgaagatttcctttggtatgtagtttacctctgtcgtgctttgaacattccaatgcctcattcttatgtatttccagaaatgcaagatgctcaagacatttgcgatccagaagctgatgaaaaaagaagccagattgagcaatctgacaatctgaccaaagaagggacatgtaacccaatgacaggagacactgtttgggttgaaggtcttgtccctggcattgacttttgtaaccatgatctgaagccaatagcaacatgggaagttgatggaactggtttagcatcaggagttcctttctccatgtatcttatctctgctgctcaaagtcccttgcagattgatcaagaaatctacattagttatggaaacaagggaaatgaggaacttctgtatctgtatggttttgttattgatgataacactgatgactatctcatggtccactatccagcagaagcaattaatacaatttccttctctgagtccaaaaaccagcttcttgaagtgcagaaggctgaattgagatgtcttttacccaaaacttcactggataatggattttttccgttaaacacccaaaacggtgaagaaaataacaagtccaaagctgaccaagtttgcaactatagttggagtggtcagcgcaagatgccatcttatgtaaacaagctggtgtttcctgagaaatttatgactactttgagaaccatagccatgcaagaagatgagcttttcaaggtttcctcaatgctggaagagcttgctggacctgaaagggagagacaactatcagatacagatgtccaatcagcagtgtgggaggtctgtggtgattctggagctttacaattgcttgtcgatcttcttcgtgtgaagatgatggatcttgaagagagttctggaacagaggaaaatgaccttgatttgctcaagaaagcccttattattgatagccatgaagatagcaaacaatgcctgagcaatttaaggtag

SEQ ID NO: 37449 - DNA, 270 bp, Glycine max
  Peptide Sequence Number=SeqID_129134
atggtgttggtgcgaaagaaagggtacagttcgtacctaacattacaactgggatttaaaattctccctcctagtttcattcacggtttcgaacatcaaacacgtgaagtttgcttgtttctgcgttgcgtttataatgcattgtccacacaactgaaatgggacatcacccttgcacatgaaaagtccatagacaatgtcaaaggggtttgttcccgtcactgtggagttgtagaatacattgttggtgacgacgttggaagattgtga

SEQ ID NO: 37450 - DNA, 1416 bp, Glycine max
  Peptide Sequence Number=SeqID_129135
atagaaaaaattgttttatttctgcttgaacaacaaggagtacttgcacataggctgtcaaatattggacaagatcaccatactcttttccagcagtcaaatagtataaacatctctgaacttcaagaagcatatagagacgttggacgagatcttttaaggcttcttaattttgtggaaatgaatgctattggtttgagaaagatcttgaagaagtttgataaacggttcggctataaattcacagactattatgtcaagacacgtgcaaatcatccttattcccaattaaggcagggcattggggctgttgttggagtcttatctcatggtctggctgaccttcaggatttacaacaatctctaggaagctacatttctatatatgaccagccttcttatactcatcaggatcctattcttgattccatcaaagaagctgtagccagattgtcaaactcaacaaacttccttcagtttttgggaagacatgcttttatcatgaaagaggagctgccatttccaagtgaagatcatattgttgatgaaagatatcatttcatgtcgcttcttttgaacttggcaaatacatttttgtatatggtgaacacctacattattgtacctacggcagacaactataccttgagccttggagctgcagcaagtgtgtgtggtgtggtcattggtatgatggctgttgcacaggtgttttcttcagtttatttcagtgcatggtcgaaccgttcatatctacgaccactcatcttcagtagcattgttcttgtagttgggaacaccttgtatgcattggcttttgatatgaattcaatagtagttctactgatgggacgtcttttctgtggaaaaataccatctttcttgactgactatctgaaatgtgagactatgttaggctctgctagggctgttaataggcgttatatcagtgactgtgtaccattgaaacttcggatgcaggcctcagcaggttttgttagtgcaagtgctctgggaatggcttgtggtccagctcttgcttgtttgttacagacaaattttaggatttacaggttcaccatgaaccaagacactctgcctggctggataatggctcttgcttggcttgtctatctactgtggttgtggatttgtttcaaggaacccgcacatgagaatcaaggaaatcttgtgctatatcatgcagatacagaaccagtagtacaagttgcagtagggaacgagcgtacacaaccattactaatgaactcagaagaaaaggagctggatgaagatggagaagaagaaaatgacaatactgaagaaactaagaaacctgtgacttctattgtggtggcatataagttacttactccatcagtaaaggaagggaaaggaaaggaaaagagacattaa

SEQ ID NO: 37451 - DNA, 966 bp, Glycine max
  Peptide Sequence Number=SeqID_129136
atggacaagaaagagcatattgcaatttttactactgctagccttccatggttgacaggaaccgctgtgaaccctttgtttcgtgccgcgtatctcgccaaaagtggggaaagagatgtcactttggtgatcccttggttatctctgaaagatcaaagacttgtatatcccaacaacattacatttgcttcaccctcagagcatgagaagtatatctgccagtggctagaggagagagttggatttacatctggtttcagcatacagttttatccaggaaagttatttggtcatagatatgagcatctgtcagcttttactcttaagaatcctctgatttctgttttatgcaaaccttattgttatttttctagagataaaaggagcattcttgctgttggggatatttcagagattatccctgacaaagttgcagatattgctgttctagaggagcctgagcacttgacttggtatcaccatgggaaaagatggaagactaaattcagactagttatagggataattcatacgaattatttggagtatgtgaagagagagaagaatggagtcatgcaagcatttttgctgaaatatttaaacaactgggttgtaattagattatctgccgccacccaggattacactggctccatcatctgtaatgttcatggagttaatccgaaattccttgagattggcaagaaaaagagggaacaacaacagaagggagaacatgcctttaccaaaggtgcctactttattgggaagatgatatggagcaaaggctacaaggaactgctccaacttcttaaagatcatgaaaaggaattatctgctcttgaggttgatttatttggcagtggagaggactcagatgaagttcaaaaagctgcagaaaagttggaactagcagttagagtccacccagctcgtgatcatgctgatgctctatttcatgagtaa

SEQ ID NO: 37452 - DNA, 138 bp, Glycine max
  Peptide Sequence Number=SeqID_129137
atggcagctagcaatgttgatgcttcgacttctgctatgagagctgtgcctataagaactgaagatgtagcagttaggaattcaccttctgagtttctaaggactgcactcataccatataggatggatccaacttaa

SEQ ID NO: 37453 - DNA, 1596 bp, Glycine max
  Peptide Sequence Number=SeqID_129138
atggtgaacccaaatctcagaacagacccttccaccatttacaaccttctcaaatcctatgcactttccccctcaaccatcctcaaagcccaccacctcttccaacaaatccaccgacccacgttgcccttttggaacctcatgatccaaggctggtccctcagtgaccaacccaccgaagcaattcgcatgtacaacctcatgtatcgccagggcctgttgggtaacaacctcacataccctttctcttcaaggcctgtgctcgagtccctgatgcttcttgcgtctcttctctttgtttccaactccttgatccacatgtatggctcttgtggtcatttggaccttgctcagaaggtgtttgttgaaatgcctgagacggacttggtttcgtggaattcgttgatttgtgggtattgtcagtgcaagaggtctagggacgtgttgggtgttttcgatgcaatgcgggtggctggtgtaaaggatgatgtggtgactatggtgaaggttgttttggcatgcacttctttgggcgagtggggtgttgctgatgccatggttgactacattgaggaaaataacgtggaaattgatgtttacttggggaatacactgattgatatgtatggacggcgtggtttggttcatatggctcgtggagtttttgatcggatgcaatggagaaatttggtttcttggaatgccatgattatgggttatgggaaagcagctaacttggttgctgctcgggagttttttgatgctatgccgcatagggacgtgatctcgtggactaatttgatcacaggttactctcaagcaggccagtttacggaggccgtgaggcttttcaaggtaatgatggaagctaaggtgaagccggatgaaataacggttgccagtgtgctttctgcatgtgctcatattgattcacttgatgtcggggaggctgttcatgactatatacggaaatatgatgtgaaagctgatatttatgttggaaatgccttgatagacatatattgcaaatgtggtgtggttgagaaagcattagaggtgtttaaagagatgaggaagaaggactctgtcatggacttcgatcatttcaggccttgcagtgtgcagccatctcatggagcatttgttggaattttgctagcctgtgctcatgccggattggttgataaaggattggaatattatgaaagcatggagaaggtttatggactgaaaccggaaatgaaacattatggatgtgttgcggatcttttgagtcgctctggcaatttacaaagggcatttgaattcataaaagagatgcctgtgactccagatgtggtagtatggaggatattgctgagcgcttctcaggttcatggaaatatatccttggctgagattgccacaaagaagcttcttgaattggattcttctaatagtggtaaatatgtactttcatctaatacttatgcaggctccaatagaagggaagatgctattaaaatgagagaactgatggagcaaagtaatgtacagaaaccatcagccatggacagaataaaccaagggtctgaaaattttgaacctgacccctga

SEQ ID NO: 37454 - DNA, 273 bp, Glycine max
  Peptide Sequence Number=SeqID_129139
atgggcggcggcggcggcgatcacggccatggacacggacacggcgatttcaggaacaaggtctggagtatgagcggtggcccttactgccgtcccaagcactggaagcgcaacaccgccattgccatggtcggcgtcgttctcatctgcatccccatcgctatgaaatccgctgaactcgagcactataggaaacacattgcaccatgtttctgtgttgtgaggatatgtggtgaaattgccgctgaatatgagcaaaattgcggaggatag

SEQ ID NO: 37455 - DNA, 213 bp, Glycine max
  Peptide Sequence Number=SeqID_129140
atggggaagtttgggtccatggggattgtgaagagaaaaaggggacaatctctatctacgcgccctgcttgtaatctagtgtgcatcagtcccactgagattgtggtgttgcctaaaagcttggcctcaatatcatcgaaaatatctactagtatatttaactttggagaatctatatcatgtgcccacattattatatataaaagaatataa

SEQ ID NO: 37456 - DNA, 3663 bp, Glycine max
  Peptide Sequence Number=SeqID_129141
atgaacaacctcaagctaggagtagaagttgcgagtgctcatgaccttgttcccaaagatgggcaaggctcatctagtacttatgtggaactccactttgatggccagagatttcggacaactactaaaaacaaagatttgagtcctttttggaatgagagcttttacttcactattacagatccaagcaagttaccaagtctcactcttgaagcctgtatctaccactacaacaaagacaatggctccaatgtactccttgggaaggtccggctcaccggaacctcatttgtttcatattctgatgctgttcttttgcactaccctctggaaaagaaaaacattttttcgcgttccaaaggagagattggtttgaaggtttttgttacagatgacccttctgtaagagcctcaaaccttcttcctgctgtggaatcctttttcaatacagaccaaaatgaaaatctaacagaataccaatcaccgccaccagtatcatttacaaactcaatccaaaacaacatgtctagaaagaaaactgagccaaggcacacgtttcataacattgcaaaatctagtaatgaacaaaaacagcagtctaagcctgcagcagatgccaagccaagtgtaacctttgggattcatgagatgaaatcatcacaggctcctccaaaagttgttcaagcatttgcaggtccacaagagttttcagtgaaagaaacaagccctactcttggagggggaaaagttgttggtggaagggttattcgcgggagcttgccagcaacatccagcagctatgaccttgttgaaccaatgcagtacatttttgtaagagttgtaaaagcccgagaccttccttcaatggatatgacaggtagccttgacccctatgtggaggtaaaggttggaaacttcaaaggaattaccaatcactttgagaaaaaccaaaatcctgaatggaacaaggtgtttgcctttgccaaggacaatcagcaatcatttattcttgatgttacggtcaaagacaaggatcggatatcagatgatgttgttggaactgtgaggttttatgatctgcatgatattcctaaacgtattccacctgatagtccattggctcctcagtggtattggattgaaaacaagaatggagaaaagagaggggagttgatgcttgctgtttggagaggcacacaagctgatgaggcttttcaagatgcttggcattctgatgcagtagtgtcccctgatggaagcactatatctaactatgctcagattcgatcgaaagtttacatgtctccaagattatggtatgtacgcgtcaaagtgttggaggcacaggacttagtttcatctgacaagtctaaagttccagatgtctatgttaaggtacacattggcaaccagattacaaagacgaagccactaagagccatgaacccgcagtggaatcatgaagcgttgtttgttgctgctgaaccttttgaagagcctttggtcttcacagttgaggaacgcgttggtggcaacaaggatgagactattggcaatgttgttattcctttaagcagaattgaaaagcgtgctgatgataggcctatccgtgataactggtatcttcttgaaaagtacatgtcatctgctatggaggagcaagcaaaaaagcaagagaaagagaaggagaaggacaagttcttcagcagaatccgtgtcattgcctttcttgatggtggataccatgtgctagatgagtcaacttattacagtagtgatcttaggccaacctcaaggcagctatggaagaagccaattggtgtcttagaacttggcattttgaatgctgatgtattgccagttccaaccaaaaatagggatggaaggggaacagcagatacatactgtgtggcaaagtatggccacaaatgggtgcgcactagaaccattgctaacaatctaaacccaatgttccatgagcaatacacttgggaagtttatgacatagctacagttctcaccctgggagtatttgataatgcacagattaccaattcttcaaatggtaacaaagattccaagattggaaaggttcggataaggatatcaaccctagaagctggccgcgtttacactcactcttatccattgttatcagtgcaaaactctggtctcaagaagaatggtgatgtgcacttggccatacgcttctcatacacctcgatgtttgacacgatggctttgtatttcaaaccccatttgccaaagatgcactacacaaagccccttaacatcatggaccaggaaaggctgagactccaggctgtgctcattgttgcatctagactaggcagggcagaaccccctcttagaaaggaagtggttgagtacatgtctgactcagaatctcatttgtggagcatgcggcgcagcaaggccaacttcaaccgtctgaaggaggtgttttctggcctatttgcatttggaatttggtttggacaaatcgccaaatggaagaacacttttgtgacagtgctgctgcacattctctacttaatgtttatgtgtttcccagaacttattctaccaaccgtgttcctatacgtgtttgtaatagggatgtggaaatggaggttccgcccaagataccctcctcacatggatgctagtctctcttgtgcacatgtaacaagccctgaggattttgatgaggaaatggacacttttccaaccacaaagagcatggatatcgttcgttggaggtatgataggttgagaagtttggcagggaaggttcagagtgttgttggacagatagcaactcagggagaaagattacatgctcttataaattggagggatccgagagccacttcgatattcatggtgttttgccttgtgactgctatagttttgtatgttacaccaccaaagatgttgtttattctatctggattttacctaatgaggcaccctaagtttcggggcaagacaccaggagcaccagtcaatttcttccgtaggttgccttctctcacagatagcatgcttggagcttatacgctggcacttataaaaactggaagaaaattggaatactatacttatgcattcactgctttcaggattgggtttccgatggagactgacagacctgacggccggactcccaatcaactgagacccctggtctgctcctgctccatcctacatcgatcccatggctcggccagttgggctcaaggtgaaactaaagtgcttgctgcagtttatgggcccaaagctggaaccaagaagagcgaaaaccccgaaaaagcatccattgaagttatttggaaaccgaagactggacaaattgcatgcgctgcacttgtggatgccggaattcccctaaaacatcttgctgtagcgatatgttgttctgtaacagatagtggctgtattatattggacccgaccaaagatgaagaggagggatcactgcaggcgggtagtgagcctatggcacatggaatcatgacatctattacacagggtgctatgtcagtggatgattatcttcactgcctagagcgagggcgtgctgctagtgcaagattgtctgaatttgtgaggaagaacatagaactgaaatctacaagtgaggcatctaaagctgggtga

SEQ ID NO: 37457 - DNA, 153 bp, Glycine max
  Peptide Sequence Number=SeqID_129142
atgatcaagcgatttgagccgaagagaaaaaattgtcctccaacaataagttctcaggctattccaaagagtgcttggatgcttggaagaagaatctcaggatacgaggcccaaaagaaggagcaatattcctgggcacttgaaggactatga

SEQ ID NO: 37458 - DNA, 243 bp, Glycine max
  Peptide Sequence Number=SeqID_129143
atgacgttctggataaggagtggccatgaagaggacaaggtgtgcacgccgaggttgtggtacttgccagagcactcactaaggttgtggtgcctgttggagcattggttcgatgacaacaacggagactcaatgaggaaggagggaaagatggaatgcttcaatgtgagaggttccatgatgacactatctaccttgatttatctaacggccgtaaaaagtggtgtgcggtggaccacatga

SEQ ID NO: 37459 - DNA, 303 bp, Glycine max
  Peptide Sequence Number=SeqID_129144
atggagttgaagaaggtggcattggtgaaggtagctttgttgcttttcctgttagggttcagtgcaaccactgcagatgctactcgcttcgacccacgttccttcattactcagatgagagcgagacaggctgccactcatgttgcaaaaattgcatttgcaataagaaatttcctcggacgtaaccttagatgcaataatatactcatgagtcttgaggatagtcttcgcttgcctcacagagatgaccattcagggaacgtattggtagatatcatcgaggacaaaaaactatgtggatga

SEQ ID NO: 37460 - DNA, 399 bp, Glycine max
  Peptide Sequence Number=SeqID_129145
atggttaaattcaaacttccattatccaaagtatttgtagctacaacaattatctggtacaccaccacagcattgcttgttggtgacaaaaaaaggataaacacccatagtaatgatagtatggaaacgcttctggtaaagaaagacataatcctttttcttgaagatattaagataaatgtgtctgtgagaggtaaggcttctaccaattcatctcatgctttttattctcaattttgtcgctatatgtttatgaatgctattgaatcctttcactctgtcactttactgtctgcgaatgatgccaccgatgctgacccacttccattgaccgaggacactccttcatcagtttgctcagttgttcaccaaaacatcttttcaggcaaccatgaatga

SEQ ID NO: 37461 - DNA, 138 bp, Glycine max
  Peptide Sequence Number=SeqID_129146
atgctaacttgcaccgacccacgattgtttaacgcggaatttttatgcgggcagccattaaagactgagaaaaagtggcagaaagaagagagagaagaagaggaagaagaatacgtgagagttgggacagtatactag

SEQ ID NO: 37462 - DNA, 201 bp, Glycine max
  Peptide Sequence Number=SeqID_129147
atggtgaaaggtgatggagtgagttttttgtatcaggggatgaaaagttgttgtgccaaggatctacgggtgctattagctgttatattttcattgctagacgatgtagcagggggagaaagtggaggatatataattgtatctctagagatgttggaagggctacggaaatggatacttagcttcatcaaggtgaaataa

SEQ ID NO: 37463 - DNA, 273 bp, Glycine max
  Peptide Sequence Number=SeqID_129148
atgacgctcactactgggtcaccacacccgattaatgaactacaagttgcacccaataattacgatgcgacattacggcccgacagtgtcttcagatttgaattgatggggactgttatttacgtggataccaccattggcgtgaagcttgtaacgccactggcaatgacgggaacgacgatgccgccattgacaacagcaggacagggtctgactaggagagataaagaagcccataccgtcattcgtactagcgggacaaggctgacttga

SEQ ID NO: 37464 - DNA, 372 bp, Glycine max
  Peptide Sequence Number=SeqID_129149
atgaactctcatagtgacgtgcaagatcttggagctcaccttggtcacgtccaccttgacgtggaacgtctccagattttgattgtggagaagtcattagagagattatcattagtggaggagcaggagaaggaggacgggttcgtatttcttgtggagaaggagccaaagaagaaagtggatgtatcgctttgcctggtgaggagattcttaactgagaagcctatacattttaatgtgatgaaggagagaatggcggtgatctggagactgagaagagacatcttgattaaggagatggagcgtgatctctatcaattccaattttattatatggtggacttcaattgcattcttcaaagtagtccatga

SEQ ID NO: 37465 - DNA, 453 bp, Glycine max
  Peptide Sequence Number=SeqID_129150
atgtatggctacaagtttgatgggatgccaaaccaagaaagttgtatccttagaagcagaaatgttacttttaatgagaacttattttataaggctgtcaaattttctgcagaatctacatgtgcaggcgtagaggttgagtcagaaccagaaccatcaactcctccaagaaaatctagcagaatttcagtaccaccagatagaaggaacagaaagcgttacagacatagggggtctataggcttaaaagctgaagatctgacaagttcagaacatgggatcagaattgattcacagactttctaccagttaagaacacctgagcaaaaaggtgttgtagaaaggatgaatagaaccttgaacgagaaagcaaggtgtatgcggatccaatctggcttgcctaaagcattttgggcagaagcaataaacacaagcagcatatctcatcaatag

SEQ ID NO: 37466 - DNA, 684 bp, Glycine max
  Peptide Sequence Number=SeqID_129151
atggtaagcatttgggacctagctagggtagaagtctccatggaaccaattgcctccctcacccagtattatgatcagccgttgaggtgcttcatctttggggacttccagctatcaccaatggtggaagaatttgaagagatcctaggatgtcctctagggggaaggaaaccatacctcttctcagggttctacccctcattggccagaatttctaaaaaaggtccaaatctcggcgcaggaattagaccgccaaaggcaagtcgaaaatggggtggtcggaataccaagaaaatatttggagtcctctttccaaatgtggatgggttggtggacctggcagcgatcgacgtttttctcgcctatcataaaccacaaggaaaagtccgctctctatgtggggctggtttcacacctttttctcctagaaaggtaggcccgtctatccgctacaaggaaggaagaatcaagattctatcttcatgcgaaggatgtccaaatgttcccttgatgggaacaaggggttgtatcaattataatcccgttctcgccataagacagcttggctaccccatgagaggagcgccattagatgaaagcatcacgcctttcatcgcacggggttttagggaccacaacgcgagggtactccaaggagttcgcaaggcatggaatgcggcgtga

SEQ ID NO: 37467 - DNA, 462 bp, Glycine max
  Peptide Sequence Number=SeqID_129152
atgaaagccgacagtccccacaaaaagaagttaagaacatatttggggatcgtcgctcgtgataaggtggatgtcacatacgagaattggaaacaagtccttgctgcctataaggatttgatatggggggatattcagactacggaggagcgatggagacagtttaagtttgatttgacatcaaaatgggcacttgcagctgacaaggacagtgtcgatgacactgtatgcgaaaagtacaacattagcaaagagaagtggacccaattttgtcaaagtcgtagagaccattcgtgggaggccattcagaaacaaaatattgcccctcacctgttgtcacgtgggggttatgaatttctagaaaacaagttgatggaggagaagaaaaagaaacaactagaggaagctgctaaatctggaagcactgatatcgtcattgatccttcatctcccattagatga

SEQ ID NO: 37468 - DNA, 778 bp, Glycine max
  misc_feature (188)..(188): n is a, c, g, or t
  Peptide Sequence Number=SeqID_129153
gtatatcatgaaggcaattattacagtgttgtatttcaacggaagagtatatgaagacaatgatggtgtaatatttgaaggcagaaaatatgttgcgttgcaaatttgtgatgacgaagatgttgaaactatgatcgaaagttttcaacaacaacaacaaatgtcagttctagaattgtacgtagaanaggatgttgctggtggttcgatgtttcatgctgcaaattctgttacgtcatgtggacgtaatgtatctcatcatgaatcggaactgccaagaaatataagtaatttacatgatgatgaagatgatgatgatgatgattaccttgcatctaactcatacgttgaagagtcttttgatgaagatgatagtgatgatggaatatctgatacagacgatgaagtcactaacatcgttgaaccagtttcaattgttcacccaaccgaaggtgtaccacaaattcaaaatccattttggaatgatgctatgcattataataatatcaattggagtcatccggacgaggaggacatttgtggtctggacatgccaacgacttttaatgttggacaagaattatatgttggcatggattttgacagtaaagatgcggtaaaaaatgcactgaaacaatatgtcatgaaggtgcatcaaacttttaaggttgttgagacgaaatcacacaaatatatcgtttgttgccccaacaacaccgaagagtctccttgccctttttatatgagggcaattttatccaaaaaaactgatgcatag

SEQ ID NO: 37469 - DNA, 1025 bp, Glycine max
  Peptide Sequence Number=SeqID_129154
aggactacacgtcctcgccttcagaggacaatgtgtcctcgccttcgccttcgtagggctacacgtcctcaccttcaaaggactgcacatcctcgccttcagaggactgcacgtcctcacctttagaggactacacgtccttgcctccagaggactacatgtcctcgcctccagaggactccacgtcctcgccttcagaggactccacgtcctcgcctttagaggactccacgtcctcaccttcagaggactgcacgtcttcacctttagaggactacacgtcctcgccttcagagggctgcacgccctcaccttcagaggactacatgtcttcgccttcagagggtcatgtaccttcaccttcagaggactacatgttctcgcctctagaggactacatgtcctcgccttcagaggactgcacatcctcgccttcagaggacttcacgtcctcaccgttggagggctgcatgccctcaccttcagaggactacacatcctctccttcagaggttcatgtaccttcaccttcagaggactacacgtcctcgcctccagaggactacatgtcctcgcctttagaggactgcacgtcctcaccttcagacgactgcatgtcctcaccttcagaggacttcacgtccttgccgtcagaggactacacatcctcgccttcagaggacttcacgtcctcaccttcagaagggcgccaactgtgcgaatacaaccagagaggaaggctatcacgcagctactatgcataccggggcaagatttcacccgtgccgctgcaaagagacaagtgcggatcgtgcgcaccaacatgaccacttttgcacagatatgtatgacattgctacttagcaacattctgcccagcgaccgtaatgccgatctccccctgcggaagggtcgcgcccacaagacacccagtggacccggagaagtccaacagggccctggggtttccagctcaggttacgggcctctatcagtcctacagggtgcccgtactccccggcaag

SEQ ID NO: 37470 - DNA, 519 bp, Glycine max
  Peptide Sequence Number=SeqID_129155
atgccgtatgtggaatctgcagaggagtcattggaaacggctttccaatcttttaaggtagtaagcatcgcttccgtagattccctccctaggaagccctgcctgtctggcgcggcaatgatagtggcctgggtgatgttagggcacggctatgagcccggaatgggtttgggcaagaataacggtggcagggccagcctagtaagtgtcagaggaaaccataggaagtttgggttaggctataaacctacgcagtctgacataaggaaaaacatctcagaaaggaagaacaaaggccaaggcccacggtcgggacagcaagctaaagaggttccactatgccacatcagtaagagcttcgtgagtgcaggtttaagacgtaaaggacaagtcgccgtgatatgcgatgatgactccccgaggagatcagatttggtacagtcatgccctcccggtttccaactagggaattggcaggtggaggaacgcctggaggtttacacgacaagcataatgtaa

SEQ ID NO: 37471 - DNA, 418 bp, Glycine max
  Peptide Sequence Number=SeqID_129156
tcctccacaacaacaacaacatgtccctccgttccagaatgctgctggtccaagcaagccatatgttcctcctccaatacagcagcaacaacaacatctgtcacaacaaagacaacaagcaactgaggctcctcctcaaccttccttagaagagttagtgaggcaaatgaccatccagaatatgcaatttcagcaagagacaagagcctccattcagagtctgacaaatcagatggggcagatggctactcagatgaaccaagctcagtcccaaaattctggcaaattgccttcacaaactgtgcagaatccgaaaaatgtgagtgccatcaccttgaggtctggcaaccaaattcaagtgcctccaccagtagcagcacctgcacctaaacctctcaagcttcattctacaccttaa

SEQ ID NO: 37472 - DNA, 60 bp, Glycine max
  Peptide Sequence Number=SeqID_129157
atggaatttttgaactacgaatcaagcttatcgataccgtcgacctcgagggggggcccg

SEQ ID NO: 37473 - DNA, 171 bp, Glycine max
  Peptide Sequence Number=SeqID_129158
atggaaaatgattctactcttgaagatgacatcaaggttgaagaacttgagcaaaacaaagagatctctatgacaatgcctaaagaatttcctagagagtggagaactcagaaagatctctccttagataacaattggagaaatctcaaagggtgtttctacgcgctctag

SEQ ID NO: 37474 - DNA, 476 bp, Glycine max
  Peptide Sequence Number=SeqID_129159
atgtctcctataggagatcattactcttgcaagagtttaagtgaagaacttagcgattattatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattcccgcttcctcgctcactgactcgctacgctcggtcgttcgactgcggcgagcggaaatggcttacgaacggggcggagatttcctggaagatgccaggaagatact

SEQ ID NO: 37475 - DNA, 168 bp, Glycine max
  Peptide Sequence Number=SeqID_129160
atgaccaagaaaaagatcgcccctctcgcatgcaagagggaaatcacccgaatggatgctcaaaagtcgatccgactaaatgatcaacaactaaatttgtgctccgctcctatcacggatctccaagtcaaattgttggagccaaagcatccatcagcgatcaactag

SEQ ID NO: 37476 - DNA, 420 bp, Glycine max
  Peptide Sequence Number=SeqID_129161
atgttcaagatagaatcaagaacacttcaagactcaagaggaaagttgaagaacacttcaagattcaagaggaaagttgaattcaagaatcaagaatcaagattcaaggatcaagcttccaagaatcaagatcaagattcaagactcaagatccaagaatcaagagaagacttaatcaagataagtatgaaaaggttttttcaaaaactgagtagcacatggatttttctcaaaacatgtttaccaaagagtttttactctctgagggtacatctacttgggtttttgactgagaacaagagagggtacatctcttgtggatcaattctagtggagggtacatccactaggttcaaagagaacaagggatggtacatccattatggatcttcgcttgttaaaggatttttgcaaggttga

SEQ ID NO: 37477 - DNA, 627 bp, Glycine max
  Peptide Sequence Number=SeqID_129162
atgcctcatagtgagatagaaaaagattttgaagcgaaagaggtagggggctcatgtgattgcaatgagataggggataacttgagtgtgggacctagtgaggttgggagcggtcaagaaaggtcggaacacttgaaaaagctcatattagaagaagaggagggtgatatttcacaagccaaatctgttatgggggaacatgaaggcacaaaaaataaccatggaggaggtaaacgtccttatgatattgaaattgaattttttaacaagggtgccaaggtgcatagggaggttgttcattgcttgtttggggaacataagatagaagacagggaggtaaggaagagggatagggaaggaaacaaaggtatattgacaaacaagggcgcaataccttcaagatcagtgatggcttcattttttaggagggtggatgggttagaagatgaagcagagaaggatggatctccaaagaagaacaaaggaattaaaataaaaaaaataaagggatgccaacctaaaaagtccttactggcgaaacaaggggagaaagttgagtggagacaatgcctgatagttgattcaagtggtggtttattatgtcattggaaaaaaggaggcttttga

SEQ ID NO: 37478 - DNA, 210 bp, Glycine max
  Peptide Sequence Number=SeqID_129163
gtattttgctacctgtcgcaacgtgcccttcgcgggcgagcgagggcgaggctcacgggtgcgctttccaaaggaggaaagatgcacggagtcgccaccaacgaaggtattagcacctctcacgtcgacaaaagcggggcttttgctcctacgtaccctcctttggagaggaaatcagacctacgtagttctcacttatgcgtgaatcaa

SEQ ID NO: 37479 - DNA, 263 bp, Glycine max
  Peptide Sequence Number=SeqID_129164
agcatgatggatcttggataaagaagggtgctagaaatgttggtgaagaaggacatgagagagaagattcatctcttctttctaagatattggaaaggtttgatggtcttcaaaccttttttagtgagaggtttgatactttggaactgcaagtgaatatgcgcttcaatgaaatggagtcaagaatgactaaggttgaagaagatgtatcttacatccggtcaagctttgatcttccaccaccgccgccatcatcatcatag

SEQ ID NO: 37480 - DNA, 285 bp, Glycine max
  Peptide Sequence Number=SeqID_129165
gaattttatgctaatctctacagctctgaagacccttcaccaaagcaagccagagttagaggccacttggtgaagatagatgctgacagcctcaacacatttctagagactcctgtagttctagaggagggggagacattacccacctattctaggtactgcagtttacccacagatcacagagagattgaggctgctctatgcataccagggagagggttcattttgaatgttgagggccatccggggaggattctcaggaaggatctgactaccttggcctag

SEQ ID NO: 37481 - DNA, 369 bp, Glycine max
  Peptide Sequence Number=SeqID_129166
atggaaatttatgtgagtaatcgactaggaaaaattgtcatcatcaaaaaaggggagattgtagaagcaaagcttcatgatgaatcaagaatgattcaaagatgttttgatgataacaaaggtgatgacaaaaagctcaaaggtcaatcaaagaatgagttcaagatgttcaagatagaatcaagaaagaataagttcaagatgttcaagatagaatcaagaacacttcaagattcaaggatcaagcttccaagaatcaagatcaagattcaagaattaagagaagacttaatcaagattcaagattcaagaatcaagagaagacttaatcaagataagtatgaaaaggttttttcaaaaactgagtag

SEQ ID NO: 37482 - DNA, 483 bp, Glycine max
  Peptide Sequence Number=SeqID_129167
atgtgggcctttcataaaggtttacaaattgattgggcacatcttgttagatatcgcatgcataaggcgttgcgattgaatgctccattgccttatcctcatcttgttacccttttccttcaacacttcaacatccctcttgattctgaaccctatgttccaatcaagagatccttccttataggcgcttcagtcataacatcctttggttatcaaaaagagcatgatggctcttgggtgaagaagggtgctcgacatgttggtgaagaaggacatgatggagaagattcatctcttctttcaaagattttggacagatttgatggtcttcaaacctttgttagtgaaaggtttgacactttggaactacaagtggatatgcactttaatgaaatggagtcaagaatcaccaaggttgaaaaagatgtgtcttacatacgttcaagctttgatctaccaccaccgccgccactatcatcttag

SEQ ID NO: 37483 - DNA, 651 bp, Glycine max
  Peptide Sequence Number=SeqID_129168
gatgccgcggtgagacggaatcagtatgggcagccgataggtgaagccctccctcattggcagccggcaggcatgcccggccacacgccactgcaagggcggttttgccgcctggaaccgcttaacctcgagcgctggggggatgcgctttatcaggcttatcaaaccgccgaggacgatcgcgactggacctatctcgcagacagaaacacgatggtggtgatcgatcgggcgaacgggcgtgcggtaggaacctgcgcttttttgcgcatcgatcccgccaacggcgtggccgaactgggcaccatcaactggtcgccgctgatgaagcgcagtgcgctgggcagcgaggcgatcttcctgatgctgcggcacctgttcgacgatcttggttaccggcgttgcgaatggaaatgcgatagcctcaatctgccttcacgccaggccgccgagcgcctggggttccgctatgaaggcacgttccgtcaggccgtcgtcgtcaaaggacgcacacgcgacaccgactggctgtcgatcgtcgacggggaatggccggcgcggcgcgcggcgtttgccgcctggctatcgccggataacatcggcgatgacgggcggcaagcacggcaattgcaggccttccgacgcgagtaa

SEQ ID NO: 37484 - DNA, 151 bp, Glycine max
  Peptide Sequence Number=SeqID_129169
agggtacatctacttgggtttgactgagaacaagagagggtacatctcttgtggatcagttctagtggagggtacatccactaggttcaaagagaacaagggagggaaaaagacaaggttcaaaagaactcaagctaagcgtgataagtaa

SEQ ID NO: 37485 - DNA, 357 bp, Glycine max
  Peptide Sequence Number=SeqID_129170
aaaaggatgtggctggtggttcaatgtttcattctgcaaattcccttacatcatgtggaaattatgtatctaatgatgacacacaaccgccaacaaatatgagcaatttaaatcttgacgaagatgatggtcatgatgattatcttgtgtctaactcatacgttgaagagtcgttagacgaagatgacagtgttgacggtatatcagatacagacaatgaagtccccgagatgattccaccagtaagaattgttcacccagcagaaggtgtacaaggaattcagaatccattttggaatgatgctttgcattataataatatcaactggagccatcctgatgaggaggacatttgtg

SEQ ID NO: 37486 - DNA, 354 bp, Glycine max
  Peptide Sequence Number=SeqID_129171
atgtcagtcttcgcatgctatcaggctttttgtcttacagatagcaagaagaatttttatacggctaaccactcgggtatttccgcctgtcaacgtgattcaaatgtcagcttgtcggccgcgattgacgaagggcacagaagacgacgtcagtctctgcgtgctatcaggcttttcgtcttacagacagcaaaaaagaatgtttatacggataaccactcgggtatctccgcccgtcagcgtgactcaaatgtcagtatgacagatcttgtgagcgcggaagatgacgtaaatctccgtgtgtcaatggccttgtcggccgcgattgacgaagggcgccgaagacgacgttag

SEQ ID NO: 37487 - DNA, 777 bp, Glycine max
  Peptide Sequence Number=SeqID_129172
atggatcgaccgtcgtgctggtcttcgccgaagaagcggccgacaccggcctggaaaccaccgcgcagtggcgcgccgatccgggtcggctcccggccatccagccaccagctcagccagtgctgctccgccgcattccatttgtgggcgcggatgcccatgccgcgcagcggtgctgccgtccatcacgttgtcacccacgttgccgaaatcctcccaggaccggccagttgtgctgatccgctacgaacgcgtcctccatcgttgccagccgagggattgaccaggcgcgatatcggggctcaggctaagccacactatggcccaccaggaaatcaaagtcgctgccgccatccgtgcagcttcgaggcggaggcgcggctgggcagcttcgcgcgtgccggagggctcgataccagtgcggcatcacttcccagtgcggcggcatcgtggagcccagaccggcacctgcctgttcctgcgccacgtcctcagcacgtggaactgacggtggcgggtgccagcgtcgcccaagccacccgggcattcgatgcactgcgcgccagcttcatgcgcgccgcagacatggatgcggcgcgactgcgcctgtctgtactgcccacgctgggcaccagttggttgacgccgcggctgggcaccttccgcgcccgccaccggcagctcgtgcatggaactggacctgtcggcagcgccgcaggatcctggccgccggtcacttcgatgccgccatccgcaatggccagggtggatggccag

SEQ ID NO: 37488 - DNA, 240 bp, Glycine max
  Peptide Sequence Number=SeqID_129173
atgacaagcagagaccaagtttggtcattctgcacccatgatacgcggagataccttacggttatccgcacccttttgtcattccagacagatcgtgccgttgacagcagagaccaagtttggtcattctgcacccatgatacgcggagataccttacggttatccgcacccctttgcctcagacacagtcgtgtccgttggacaagcagagaccaagtttggtcattctgcacccatga

SEQ ID NO: 37489 - DNA, 165 bp, Glycine max
  Peptide Sequence Number=SeqID_129174
atgcaaacgatcttggtcttcttcatgagactaagaaattttctctctagaaactttgaagtgaaagatatgggtgagtatgttttgaggctacaattcaggctaattggctgcgaaactttatttcagggcttggaattgtcgacagtattgctaggccgctga

SEQ ID NO: 37490 - DNA, 1248 bp, Glycine max
  Peptide Sequence Number=SeqID_129175
atggcccagaagaagagtactccaatcactcctgccacatccagaagaagcaaggttgctatcccctccaagaaaaggaaagaaatttcctcatccgattctgatgatgatgtcgaactagatgtctcgacatctaagagggccaagaaatctggaagaaaggtgcctgaaaatgttcctgatgcaccattggacaacatctctttccactccattggcaatgttgaaaagtggaaatatgtgtatcaacgcagacttgcggttgaaagagaactgggaagaaatgccttggattgcaaggagatcatggacctcatcaaggctgctggactgctgaagactgtcagcaagttgggagattgttatgaaggcttagtcagggaattcattgtcaacattccctctgacatatctaacagaaaaagtgatgagtatcaaaaggtgtttgtcagaggaaagtgtgttaaattctcccctgctgtgattaacaagtatctgggcagacctactgatggagtgatagatattgctgtttctgagcatcaaattgccaaggaaatcactgccaaacaagtccagcattggccaaagaaagggaagctttcagcaggaaagctaagtgtgaagtatgctattctgcacaggattggagctgcaaactgggtacccaccaatcatacttccactgttgccacaggtttgggtaaatttctgtatgctgttggaaccaagtccaaatttaattttggaaactatatatttgatcaaactgttaagcattcagaatcttttgctgtcaaattacccattgccttccctactatattgtgtggcattatgttgagtcagcatcccaatatgttaaactacactgactctgtgatgaagaaagaatctcctctatccctgcattacaaactgtttgaggggacacatgtcccagacattgtctcgacatctgtctcgacatcagggaaagctgctgcttcaggtgctgtgtccaaggatgctctgattgctgaactcaaggacacatgcaaggtgctggaagcaaccatcaaagccaccacagagaagaagatggagctagaactgctgatcaaaaggctctcagagagtggcattgatgatgaagaagcagctgaggaagaaggagaagcagctgaagaagaagaagaagctgctgaggaagaggaagatgcagcagaagaaacagaatcagatgatgattctgaagccaccccatga

SEQ ID NO: 37491 - DNA, 231 bp, Glycine max
  Peptide Sequence Number=SeqID_129176
atggatgcaaaggctaataacattcttatggcttctaatctagcaactggagcatatagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgccctttccaacagttgcgcagcctga

SEQ ID NO: 37492 - DNA, 944 bp, Glycine max
  Peptide Sequence Number=SeqID_129177
atggggacaaatcaaatcgaaaaaagattctatcaagtcaagattaagggcctagatgtcaccaaccttaaggagttgggacggttgatgggacccctccaaaggcaagccttccgcaaagtgtaccgaaagattttagatttgaccacagcggaggtatttacggaagccgttgtatccctcgcccaatactttgaccagccattgagatgcttcacgtttggggacttccaaatagtaccgactgttgaagaattagaggagattctaggatgccctcttgggggaagaaaaccgtatcttttctccgggtttcttccctccttgagcaagattgcagctatggtcggagattcggcgagagagttggatcgtatgaagcaaactcgaaacggcgtagtgggcgtaccgcggaaatacttggaaggcaaggcaagggatatggcgaatcaagaggagtgggtctcgtttgcggatatactagctttgctaatctttggggttgtcctctttctaaacgtggacggtttggtggacctagccatgattgatgctttcttggcatatcaccatagcaaggagagcccgacggtagctatcttggcggacttatgtgatacatgtgaccgaaggtgcgagaagaatagcacatggattgtctgctgcttacccgctctttgtgtgtggttggttgcgcacctattccaacaagacataaggcatccgtgtccgctccaaagttatcgctcgtgcgtcaaaaagagaagagtagattgggaccaacacttggctgggatagggggcagaacaatcaactggtttcctcgatggaaggaaggaaaggagggagttctcttctcatgtagggactacccaaacattccgttgatagggacgaggggttgtattaattacaatcccacacttgctataagacagttagg

SEQ ID NO: 37493 - DNA, 667 bp, Glycine max
  Peptide Sequence Number=SeqID_129178
ggaagaatctagtgaagaaatctacccccaagaagaagtacaacctttaaagtttaaggaggagtgtaaggaggtaagtgtctcctccaagaggttagctaagaaggaaagacattttgaaataaagacaaatattaaagttatttcccctcttagacaacctccacattttctcctttgtgaaaagacacttgttagcattgccacacctcttaggcttgagtttattcctcaagtaaaggagttgttggatgagggtttggttcgcaagagcttaaatccttgtgcattgttggtgcccaaaataggtattattaggcatcaaatccctaaaataggtggtatgatgaatgttttgagtggtgcaaccctcttttgtaaaatcacttgtgcacccaacatcttcatgatttgtgtacatagggactcattaggtagtgatcaaggggttcccatgaaccctaagagaataaagatcattcctgagtggcccactccaccaacaccactcattgagttggtgaggaaccatgttccttcatgggaagatgcccaggaaatgggttttcagaccttaccttacttcatgggaagatgcccaggaaccatgttctttttacgggtgttgaggaaaaaagcccagagtttgaaaaacctcaggatttga

SEQ ID NO: 37494 - DNA, 270 bp, Glycine max
  Peptide Sequence Number=SeqID_129179
atggctgacaagccaaggagagtgaccctagaagattactcaagttcaagtgtgccacaatttttcaccagcattgcacaaccagagaagtatttcccggagtctaagactgcagaaggaaaagcaaccatctcttcttttcaccaatttccagatgaatccctgagtgaggccttagaaatattccgtggtctattgagaaagacacccactcatgaattttccgaaccaattcagatcaacatttttattgatgggttaaggccatag

SEQ ID NO: 37495 - DNA, 642 bp, Glycine max
  Peptide Sequence Number=SeqID_129180
atggacgggatgaaaaaagtattttttctttcttttgtgctggtgttagttggcctgtgtgcatggtctgctcctaccatggctggcaaccagcaagaggaaccgctagccaatagcgtcaaggcgctaatgcaaaagtctgtcagcgacttggcggcacctagattgttatttgactctgagcaagcagcacagcagtggttgcaagagatgtctgcccgtctggccaagcgggttcctgatacgcaatatcgcgaagacttcctgaagtcagttcattatgaagcaacacgtgccgggttagacccacaattggtgctaggtttgattcaggtggaaagtggatttaaaaaatatgcagtttccagcgtgggtgcccgtggatatatgcaggtaatgccattctgggtgaaatcgataggtaccaatgagcataacttgtttgatatgcgtttaaacctgcgctacggctgcacgattttacgccattatctggatattgaacgtggcgattattatcgggcacttgggcgttataacggcagcctgggtaagcctgaatatcctaacctggtggtgggggcctggcgtaaccattggcattacgctccttccatcaagatggagattgctagccagtag

SEQ ID NO: 37496 - DNA, 157 bp, Glycine max
  Peptide Sequence Number=SeqID_129181
atggcacggagcgtgttgctctttgcccctatttgggaacctataggacaatatctaggggcgaggctcacgggtgcgctttccaaaggaggaaagatgcgcggagtcgccaccaacgtttatttgtggaaaacgtcggaaaaactgaaggaaaccg

SEQ ID NO: 37497 - DNA, 298 bp, Glycine max
  Peptide Sequence Number=SeqID_129182
atgaacaagtttttggcaccgttgccggggaacttctttttatttgggaaatctcccacaggcaatttagttcctctggactcagaaattgaagctacattgcgaaggaatagggccaagaggagaaggaaacttctgcaagacaaaacagttgcatccatttttgaggaggagactaatttctctgacttattatcacctgattcactatcatcaagggaatctgccactcaattaccgaaagccattaccatggcagaagagcatgaccagaggattacccttgaggattattcaa

SEQ ID NO: 37498 - DNA, 338 bp, Glycine max
  Peptide Sequence Number=SeqID_129183
tggcgtctcctctctctcttccttctccattccgctgccatttatcttccaagaagcaaaggaatccattgataaagaagatcctaggcctacaagctccaatggagcttacatcagagacatcctcaccacttgtgtttttgcagtctttcatcttgttcttctctttgttgtaaaggaggttttcggactatggaaagctaaatcctccgttggatcttccctgtgggtacctgatatgcatgctttgttaggttccttcaatagtgggaactggtctgattctaaagtccttggtagtacgggactaagttgttgtgctatcacgagggatcggg

SEQ ID NO: 37499 - DNA, 303 bp, Glycine max
  Peptide Sequence Number=SeqID_129184
atgggtgccaagcacctcacaaggaccaaagaaaggtcgcatgtcatcaagcaaaggtataggtcattccaagatcatgatgaagaccaagccaacttgtgtctcatgacaaaatctcatgagaacaacaaagaagaatctgtaaggaagaagtggtacatcgacagtggatgttcaaagcatataacgggagatgtatccaaatttacaaccatttctcccaagaaaagtggacatgttacatacggcgacaacaatattagtaaaatctcaaaagaggtaacatctaagccatctctatga

SEQ ID NO: 37500 - DNA, 255 bp, Glycine max
  Peptide Sequence Number=SeqID_129185
atggaggctttggaggaagactatggagatggaaatgggaaaaatgaatcaaggcaatatattgaggggttaatggatcttgaaaaaagaatcaatagactggagacacaaaatgcaaatggtaatgatgctgatgttgcacctgaattttctcctttgaaaacttttcaatttggaaatccttctcaagacactgttgacccaagagatggaggctttggaggaagactatggagatggaaatgggaaaaatga

SEQ ID NO: 37501 - DNA, 210 bp, Glycine max
  Peptide Sequence Number=SeqID_129186
atggcagtaggatacgatgtatgcatgattcatgaccttgagggggagttgtatgtacacgattttgagggggagactgctgctgatgacgactgttgtaagctcctagaagctgctagaagatgctgcagtaagagcatgaagacagggggagcagatagtggatgtcacatgagatgtctcgacatcctggaaaagactagtagctga

SEQ ID NO: 37502 - DNA, 1005 bp, Glycine max
  Peptide Sequence Number=SeqID_129187
acacctcatggtacccatcagtacgcgcaacatcacccgagcttctcgactcataccgggaacgcctctagttcagcacctgtgcagcctaaggcacccacccagagggaagctccccaagtgccaactccgaacacaactcgcccggccagtaattccaacacaacaaggaacttccctccgaggccatttcaagaattcaccccactcccaatgacgtacgaagacctcttgccgtccctcatcgccaaccatttggtcgtggtaactcccggaaaggtccaacatttaatagatgctggatggctgactttccaagaggatcggcccaatgtgagaaccaactcgctcgccaatcatggagggggagcggttaacgcggttgagtccgataggccgtgcaggtctaaacctttaagggatgtggcaacccctaggaggtttatctttgaggccctacaaaagggaggtgtgattcctcatagtgggcatcaaggtcgaccagaagttggcagtgaaggaagagaagagcagcatatatgcatgcagtccacggatgggagcagtgttatgaagcccaaacccttggtgatatacttcaccaagggcacagcttcgcaaaaacccggacaccccttagcagctaaacctgttcctttcccataccaaaatagccacgcggtcccatggagatatacacctccgagggagaaggaagaagaagccaccgatgtcagctcgttgtcggctaaggtaacaaatatcacgggactgagtggtgtgacccgtagcggtcgtgtgtttgcgcctccggacctaccagtccaacccgcgaacgtcaaggggaaaggaaaagtggtggaggaacaagatggtgaagcaccccacgcttcgaataaagatattccggttaaaggtcttccggagaaaaaggatggtaaaaaggaggtgtcgctagaggaagccagtgagttcctccgtataattcagcagagcgaattcaag

SEQ ID NO: 37503 - DNA, 655 bp, Glycine max
  Peptide Sequence Number=SeqID_129188
atggtggaagaatttgaagagatcctaggatgtcctctagggggaaggaaaccatacctcttctcagggttctatccctcattagctagaatttctaaaatagtccaaatctcggcacaggaattagacagcggaaagcaagtcgaaaatggggtggttggaataccgagaaaatctttggaggcaaaagcaagaatcttggcaggtagaggcgaatgggccccgttcatagacattctcgcactgttgatcttcgaaggagtcctctttccaaatgtggatgggttggtggacctagcagctatcgatgcttttctcgcctatcatgaccgcaaggaaagctcggttgtcgctatactagccgatctatatgacaccttcgaccgaagatgtgagaaaagcagtacgaggattgtttgctgtactctggctctctatgtatggttggttttgcacctttttcgccaagtgaggcatgcttgctcgctagaaagccaccgttcatgcacagagaaaggaggggcaaattgggaccgactcttagcaaacaaagaaggagcgtctgtcaactggttccctcgatggaaagaaggaagaaccggagttcttattttgtgcggaggattcccaaatgttcccttgatggggacaaggg

SEQ ID NO: 37504 - DNA, 295 bp, Glycine max
  Peptide Sequence Number=SeqID_129189
tctgtcagttctagggagtccctgtcgcccccagcaaggtcatcaggccccctaccaatcgagctttcatcaagaagtactgtgcccccaggcaggcgcagggcgaaacaccacatcagcattggcatggccggtagcgggcaatagacacaccaccaccacctctagagttcacctcagctcatccataaaaagtaggacacacctagttgctcatgatcctaagaatttaaataaaacgagcacaagctcagaaggtagtcatacctcacaaaatatatgtatgcgtgtttag

SEQ ID NO: 37505 - DNA, 129 bp, Glycine max
  Peptide Sequence Number=SeqID_129190
atggcacaacctccaccttgtgagaggactctaagggaaatggctgcacctgatttcacctacgaaagcttgtgcatccaataccctgatgaggatgtcccatatgtgaagacccgcacaaacatctga

SEQ ID NO: 37506 - DNA, 141 bp, Glycine max
  Peptide Sequence Number=SeqID_129191
atggggagaccagtcaggatcacgatattttgtgagaatgctccaaccatatgggatcagcataggcttaaaggaatattcaaacccgatgacccccaaggcctacacttcgaagagtccgtcaggatctctccctcctaa

SEQ ID NO: 37507 - DNA, 357 bp, Glycine max
  Peptide Sequence Number=SeqID_129192
atggaggccatgaaagagaaaatgaccacaatgatggaagccatgatgagtatgagaaaaatgatggaggtcaacacggctatagtcgttgtcgcaagtaccgccactgacgtggacccaactcaaccatcagacttcaatcaagtaaatcatccagtatcggatatggtccagagcaagcattctttcccaccaaatggcttgcctcccaactatacaccacccaatgttgtacatgctcccgatgagaatgtcgatatcccatacccattgggagccaacaaccccaatctggtcattcgcaggtccctcaacctatgggggagacacatgaagtacctcgagaccatgctctag

SEQ ID NO: 37508 - DNA, 576 bp, Glycine max
  Peptide Sequence Number=SeqID_129193
atgcgcctcgctgaccttgaagttctgccgttccagaatttccacgaggccggagcgcgcggtccgcgcatcatcgaccaccagaacggaaaactgtctgttggtcagaatcctgtcgacagttttgaccaccgcgtcgacggtgcggtgaccgtccttgacgatatagtcgatgatcttcttctcggcataacgcttgcgggcctcctcatccactgtcgcggtgaagacgatggcgggcactttgcgttcggagagcagcgccagaatttcacccttcggagcgtcgggaagattgagacccgtcagcgccagcgtgaaatcatgagcgcgcagcagggtatcggccgcggccatgctgtcgcagtggatcacctcggcctgcgtctcttccgaaaggcgcgtcttcagcagcatggacagagcaacggaatcttcaatcagaaggattttatcctgcatgccgcccaagccccccatggccgtcttcatgatgtctccacgaaacttcattctttcgccaccgcacgtcacggtattgaaaatcttggtaaccgcagaggaatgaatctctaa

SEQ ID NO: 37509 - DNA, 204 bp, Glycine max
  Peptide Sequence Number=SeqID_129194
atgactcactataatccttaccctcggaagcaaaaaaggaaagaaggaaaatttacaatcaaagagaaagcaaaaagaaaagaaaggaaattcccaatcaaagagtgggagaaagcaaaaagaaaagaaaggaaattcccaatcaaagagtgggagaaagcaaaaagaagagaaagaaaattcccaaccaaagaatgggagaaa

SEQ ID NO: 37510 - DNA, 130 bp, Glycine max
  Peptide Sequence Number=SeqID_129195
accacgggcagtttaacaaacgagcaagaggggatatcaaaatgaacgagagtcgatctaattccgtgactaaagcagacgaagtatatgagattcttgtatgcctgagtaaggttctgtggttcggcgg

SEQ ID NO: 37511 - DNA, 858 bp, Glycine max
  Peptide Sequence Number=SeqID_129196
cgccagcgacaagcttttcgcaaagcttacggtaagatctgggacctatccatggcagaggtctccacagagaccattgcctccctcgcccaatattatgaccagccattgaggaaaccatacctcttctcgggattttatccctctttagctagaatttctaagatagtccaaatctcgacacaggaatcagaccacagaaagcaagtcaaaaatggggtggttggagtaccgaggaaatgtttggaagcaaaagcaagagtcttggcaggtaaaggcgaatgggccccgttcatggacatcctcgcacttttgatcttcggaggggtcctctttccaaatatggatgggttggtggaccagacagcgattgacgcttttcttgcctttcatgaccgcaaggaaagcctggttgtcactatcttagccaatctatatgacaccttcgaccgaagatgtgaaaagaacagtacaaggattgtttgctgtactccgaccctctacgtatggttggtttcacaccttttccgccaagaggtgagacatgcttgcccgctagaaggccaccggtcatgcatagagaaaaaagaggcaagttgggaccgactcttagcaagcaaagaaggagcatttgtcaacttgttcccccgatggaaagaaggaagaaccgggattcttatttcgtgcagaggatttccaaatgttcccttgatggggacaaggggttgcattaattacaatcccatcctcgccataagacaactgggctaccctatgagaggggcaccattagaggaagacctcacacctattatttcacgaggtttcaatacaaccaacgtggaggcacttcagaag

SEQ ID NO: 37512 - DNA, 371 bp, Glycine max
  Peptide Sequence Number=SeqID_129197
gcagcgcctcggaaagcgcggacgagccacatgcagggaaacttgcacgtgtggttctggccggggaccccgcagaaactaatcgagctccgtttgatctcccagaagcggaagctgaatcagttgcaggctataatgtagaatatgcgcgggatgcgatccttaatagtccactgttggcggaagccaatgtcccggggtcccggggactcattctgactgaaacaaggggtgcttgctggggcagggcactcttcattcttcattcgaaactaatgaatgtcgggtcgggggtttctgccttgttatcaaaaagggagttgggtaaagcaaactccctccttggacgagcacggggcttagtcaagtag

SEQ ID NO: 37513 - DNA, 450 bp, Glycine max
  Peptide Sequence Number=SeqID_129198
atgcctcctaaggtgtctagctccttcgacagaggaggaagatccggtactaaaggaaaagatgttatattggctctaccagagccaataaccaagaaggcaactacatcatcttctgggtcacctactcagactgggtcatcaacccagaaaggaaagcttgaagggtcattgacccagataaaacctgagtcatcaactcaggaatccccaaaaccaacaacaacaaaacagattgtggctgactatgcctggtcaatacaaactctcctggccttagaagacataggcctcaccagagtaccaaaattggccaaaaagacctgggcagaaatggcctcagaatcagacgatgattctgaaatagacctacaaaaacaaatccaaaaggccaaacagaccaaaactgtctgtaaccaaaaaccaagccaatcgttggctcaacaataa

SEQ ID NO: 37514 - DNA, 411 bp, Glycine max
  Peptide Sequence Number=SeqID_129199
atgttgagtcagcatcccaatatgttaaactacactgactctgtgatgaagagagaatctcctctatccctgcattacaaactgtttgaagggacacatgtcccagacattgtctcgacatctgtctcgacatcagggaaagctgctgcttcaggtgctgtgtccaaggatgctctgattgctgaactcaaggacacatgcaaggtgctggaagcaaccatcaaagccaccacagagaagaagatggagctagaactgctgatcaaaaggctctcagagagtggcattgatgatgaagaagcagctgaggaagaaggagaagcagctgaagaagaagaagaagctgctgaggaagaggaagatgcagcagtagagacagaatccgatgatgattctgaagccaccccatga

SEQ ID NO: 37515 - DNA, 363 bp, Glycine max
  Peptide Sequence Number=SeqID_129200
atggcattgtcaaacttactattccctataatacaagggatttggggaacagatttaccaatcaatgcggagacatttctgcccatgctaattcgttcacttcctttaagcttccgcttattagtgcacaactccttcaagaatttagcatatcttgaaatttgctttattgcatccagcagagggaatggaagagggatatgctgcttctgcaaatcagaattaccagtgaaagatttacctgcacagaaattgttgggtaacttactctttaaatttttgtcatcatctttttctggtgcatttgtggatgaggaaggtactactggtgcatttgcggatgaggaaggtgctactggttga

SEQ ID NO: 37516 - DNA, 930 bp, Glycine max
  Peptide Sequence Number=SeqID_129201
cggtcgtgtatttgcacccccgacctaccaattcagcccacgaacgtcaaggggaagacaaaggtggtggaagaacaagatgataaaaccccccacactccaaacgaggatattccggcgaaaggtcttccagagaaaagggatggttatggcaagaaggaggtgtcactagaggaagctagcgagtttctccgcataattcagcagagcgagttcaaggttattgagcagctcaacaaaaccccggctagggtctcgctgcttcccgattgcattaataattcaccccaactcccaatgacgtatctccttgccgaaaatccctcatcgccaaccaggcgtaataaagctcgccgtggaaggtcttccaaccccgttgtccaagggtccaagatagatgcctggatggctgccttccaagaggatcggcccaacgtgaaaaccaacccgctcgcaatcatgagaggggggagtcggttaacctcccttagggcccgtacaaaagggaggtgtgattccccactcggtgggcataaggaggattcttgtttgctgcattccggcgagctgcataacatggaaacgtgtttggaagtggaggaattgttacagcagatgatagatcaaggtcgactggaagtcgacagtgagggaagagaagagcagcatatatgcatgcagtccacggaggagagcagtcttgcaaagcccaaacctttggtgatatatttcaccaagggcgcagcttcgcaaaaaccccgacaccccttggcacctaagcatatcccttttccataccaaaatagccacgcagtcccatggaagtacacacctccgaacaaagaggaagaagaaaccaccgacattagttcattgtcggccaaagtaaccaatatcacggggctgagcggtgtgacccgcagcggtcgt

SEQ ID NO: 37517 - DNA, 591 bp, Glycine max
  Peptide Sequence Number=SeqID_129202
atggataatgaagagggcgtgcaggaacagatgaaggccgatctatcggccttaaaagatcaaatggcttccatctcggaggtcatgttaaaactccagaaaaccatagaggataaagccactgcaaccgcctccagtacagttagggaagcggagccggtgctgcaacccgccttgaatccgggcctagacagaaacacggccgtgttcggtcgaaggtatagtccgcaagcttatccttatggcctgcctccagacttcaccccccgtgccaccccggaagatttaagccaagccccgacctttgaggggcaactcccaccttatgaagactatcccgggcaagacgatggggaaggagatacccatcttggccccctgctccacctcaaagatttgtccccgcatgaactaccccagccgaacatagtctgccatatcccggcctcacccacacccgtaaaagaatctgttcccttcgcggaagataagggaaagattgaggcgcttgaagagaggttaagggcagtcgagggcctcggcaattacccattctcggatttggcagatttatgtcttgtgcccaacatc

SEQ ID NO: 37518 - DNA, 1128 bp, Glycine max
  Peptide Sequence Number=SeqID_129203
atgccgtcattgctgccgcccgggccgtcaaaatcgggcgaggcggagctgatgattgccggcggcgtcgaaagcatgagccgagcgcccttcgttctgcccaaggcggagagcgctttttcgcgcaatgccgaaatctacgacaccaccatcggctggcgtttcgtcaacccgctgatgaaggcgcaatatggcgtcgattccatgccggaaaccggtgacaatgtcgcggtcgattatcaggtctcgcgcgaggatcaggatgccttcgccgtacgcagtcagcagaaggcggcggatgcgcaggccaatggccgtctcgacagggagatcgtttcggtaacgatcccccagcgcaagggcgatccacttgtcgtctcgaaggatgaacatccccgggccacaagcctcgaagcactggctaagctgaagccggtgaacaagcgcgagggcgctacggtaacggcgggcaatgcgtctggcgtcaatgatggcgcggccgcgcttatcatcgcgtcagccgaggctgcgaagaaatatggcctcactcccatcgcccgtatcctcggtggcgccgctgccggcgtgccgccgcgcgtcatgggcatcggcccggctccggcctccgccaagcttttggcgcggctcgggctgaagcaggaacagctcgatgtgatcgagctgaacgaggctttcgcgagccagggcctcgcgacgctgcgccagctcggcattgccgatgacgatgcgcgggtaaatgcgaatggcggtgccatcgcgctcggccatccgctcggcatgtccggtgctcggatcgccggcacggcggcgctcgaactttccttgaagggcaagcggctggcgctcgccaccatgtgtatcggcgtcgggcagggtatcgcccggcttcagtatcgtgataacggtgctaatgccgccgtaaaccggtacgaatgcccgctgccgcatcttccttggtgtgacagtggccattcaggttactcggcaggtgattttttcgctctgacacatcccagccccctcattcctgtgcttgtcacaggaatccagccgatacgcgtctgcgcggcaaaacaatccctcagcccaaagacttgggctggctga

SEQ ID NO: 37519 - DNA, 375 bp, Glycine max
  Peptide Sequence Number=SeqID_129204
atgcctcaaccacatgggatcaacatggacttaagggagcactcaaaccgagtatctttactcccaaggcctagactccgaagaatccgtttgggcctcaccttcctgattcagtttaaccctttaggatcctgtcgcaacgtgcccttcgcgggcgtgcgagggcgaggctcacgggtgcgctttccaaaggaggaaagatgtgcggagtcgccaccaacgtttatttgtggaaaacgtcgggaaaaccgaaggaaactggtcaaaatgaaaattctaagtccgggagttgtatttacgcttgaggaaggtcgacaaaagcggggcttttgctcctacgtaccctccattgaagaggaaatcagacctacgtag

SEQ ID NO: 37520 - DNA, 609 bp, Glycine max
  Peptide Sequence Number=SeqID_129205
atgaccggccctctcgatgagtcgatctcttgctttctcataagggtggacccttgggtactagtacctatcgcctttagaggactacacgtcctcacctttaggggctgcacgccctcgcctttagaggactacatgtcctcaccttcagagggttacatgccctcacctttagaggactacacgtcctcgccatcagcgggctacacgtcctcaccttcagagggctacacgcccttgccttcagagggctacacgtccttgccttcagaggactacacgtcctcgccttcagagggctacacgtcctcgccttcagaggaccacacgtcctcgccttcagagggctacacgtcctcgccttcagaggaccacacgtcctcgccttcagagggctacacgtcctcacctttagaggaccacacgtcctcgccttcagagggctacaagccctcgccttcagaggactacacgtcctcaccatcagagaatcatgtactgatgcaatcctaccccccaagggtattggatagaagactcctagaggcttgggctagagctactaaagaaggccctagggttctcatgaaccttagggtagatgtttga

SEQ ID NO: 37521 - DNA, 372 bp, Glycine max
  Peptide Sequence Number=SeqID_129206
atgccctttcggacatgtcgtccctttgtatttatcaaagtccggtactttgaactcgttgggaaggagacgatatctttcggggtacggctttcatccacgtcgggggcggactttggtgatgcatgggccgagagggtatctccttcctcatcgtcttgcctcgggatagtcgtccactactgggagctgctcctcgaatggcttggcttaaatcttcggggtggccacggagtgaagtccagaggcaagcataatatcaagcttgcgggctatacctttgtaccaaacactgtcgtgattctcctttctccgggccggattaaggacgggtgcagcaccggctccgcttccctaactgtacggggttag

SEQ ID NO: 37522 - DNA, 294 bp, Glycine max
  Peptide Sequence Number=SeqID_129207
atgtcgcagaacttcacggattgcttaacgatgggtgtcaagttcctcgaagtggtgaagatggatccactcctggaaatggtgcctcagctgatgctggcactggcagataagtctgctaaagctggaagtagggctgaagtagaagatgtagggatgccaactattggtgcaaaggaagagggaacatcagctgctctgagcttggaggtaagggcatcagatcccactcccctcgatctacaaaaggctatgattaaagctgggaagcctaagcgagaagagttagactga

SEQ ID NO: 37523 - DNA, 603 bp, Glycine max
  Peptide Sequence Number=SeqID_129208
atggagaggagtatgattgatgctgccagtggtggagctcttggagatatgacccctgctaaggctaagaatttgattgagaagatggcttccaactcccaacaattcagtgcaagaaatgatgttattgtccttagaggagtccatgagcaatctggagtcaatgagcaacctgaagcttatgctgcaaacatttataatagaccccctcagcagcaaaaccaacaacaacagaataattatgatctttcaagcaacagatacaatccaggttggaggaatcatccaaatctgagatggacaagtcctctacaacaacaacagcctatccctaccttccagaatgttgctggtccaagcaagccatatgttcctccaatgcagcaacaacaacaacaacaacaaagacaacaagcaactgaggcacctcctcaaccttccttagaagagttagtgaggcaaatgacaatccaaaatatgcaatttcagcaagagacaagagcctccattcagagtctgacaaatcagatgaggcagatggctactcatttgaaccaagctcagtctcaaaattctgacaaatttccttcacaaactgtgtag

SEQ ID NO: 37524 - DNA, 264 bp, Glycine max
  Peptide Sequence Number=SeqID_129209
atggataggtttaatagtcttcagacctatgttggagagagatttgactccttggagagtcaagtagacattcaattcggagagatggattataggatcacgaagattgaaggtttgtcatcatcaaaaagggggagattgtggaagcaaagctaccatgatgattcaccaagatgttttgatgatgccaaagctcaaagagttgtttcaagattaaaggaccaagcattcaagattccactcaaagattcaagaatcaaatga

SEQ ID NO: 37525 - DNA, 258 bp, Glycine max
  Peptide Sequence Number=SeqID_129210
atgttgctaagtagcaacgtcatccatatctgtgtaagagtggtcatggtgcacatgacccgcacttgtctctttgcagcggcacgggtgaaatcttgccccggtatgcatagtagctgcatgattgcctccctctctggttgtattcgcacagttggcgccctccaatatcagggggtggcccaggaactgataaaaggaaactactggccccttaaccgggagtgcaagtctcggttaagcattaagggcagatga

SEQ ID NO: 37526 - DNA, 158 bp, Glycine max
  Peptide Sequence Number=SeqID_129211
atgaattcattgcctagcgctgttcatgtgtcctccgttatcaagcgtgaagcctctgaaaaaatagaaggagcagagacgagagttgtcatcacggaaagggcaggacagacgaaatcagtgtcttatctttgctttcctcttatctccgatgagag

SEQ ID NO: 37527 - DNA, 527 bp, Glycine max
  Peptide Sequence Number=SeqID_129212
aagcttcattgcctaacaagccaacttacaacagcaagccccaagagactcagcataaggatgcacaggtcaaagttgagtatgagaaaagattgtatgaccaagtgaaggtgcaaattgcaaagaagaatgaaagctatgccaagcaagccaacaagaaaaggaaggaagtggtacttgaacccggtgatgatcctggacatttgaggacaaatgttttccaagaaggagggaatgatgagaatcatgaaactggccaaatacaggctaaaggcccaagtggagaaggacaaagccccggagaaggctacactataagtattggtaatccttgtggcgtctaccttgacttatcttccttcactggaagtggcgtctacccggacttatcttccttcaccggaagtggcgtcatccaaaccttcgtagcctgtatcaagcgatccgctcctactcagggaacgggcatggcagaatcagcggggaaagaagaccctgttgagctagactctagtccgactttgtga

SEQ ID NO: 37528 - DNA, 204 bp, Glycine max
  Peptide Sequence Number=SeqID_129213
atgtctctttcacctctaggatctcacaaccactcacaaactcatctcaagctctcagaacagcttcctcttcaagctctggtttctgcagatcttcacacaacaaaatctctcaaaatcgtttccgtaggtgatttcgtgaagattttcaaccgttcttcgacgttcttcgttcattcttcgtcgttcttcggtcttcaaccg

SEQ ID NO: 37529 - DNA, 524 bp, Glycine max
  Peptide Sequence Number=SeqID_129214
ttgaaaggaaagatattgacctggtagacgaggaagaagcacaaattggtgttgatcgttctagtgcaacctcgaataaagctgagatttataatgaggaggcacgaaagaaaacacagaaacataaaccaaagagggtggagagtgtcaatgatgatgcagaagcctttgctgaagcactagaacatacaaagaaaagagatacaggccatcaaagtgtgtcattggagaataagacaggagattcaactatgctgaagatgggagattcaactaaagttgtgataaaacaagacatgaagggaagaaagcataaatatgggtttaacaacaataaacgtgagaagacagagaataaaagggtggtggatgatgaaactggcgacaaacatcagctggatgaagtcctaaggaggcaaattgaaaacaaaaaattgatgcctcaatcagagaaaaatgtagttgtcactttacttgctttggtgacctctgtctctgcagaaaattacattagacgatgttaa

SEQ ID NO: 37530 - DNA, 642 bp, Glycine max
  Peptide Sequence Number=SeqID_129215
atggctacctcaccaaaagaaacttcagcttctggttcaccatctgtaccatcatctccgcaccaggaacaaccagaattcaacatccaacccatacaaataattcctggtcaagcttctgtccctgagaaactggttcccagaagacaacagggagtgaagattgctgaaaaccctagccttgcaacaagtcctagggaagtagacacggagatggacaagaaaatccgcagtattgtgagtagcattttgaatgacacctctgttcctgatgctgagaaagatgttccaacatcctccaccccagatgttgctgtccctgaagctgatgaagatgtcccaacatcttccaccccgaatgtttctgtgcctgatgttgagaaagatgttccaacatcttccggcccaaatgctgaagtactctcttcccccagcaaagagagatcaacagaggaagatgatcaagccacagaggagacccctgcaccacgggcaccagaacctgctccaggtgacctcattgacctagaagaggtagaatctgatgaggaacccattgccaacaaattggcacctggcattgcggaaagactacaaagcagaaaaggaaaaacccccattaagaggtctggacgaatctaa

SEQ ID NO: 37531 - DNA, 303 bp, Glycine max
  Peptide Sequence Number=SeqID_129216
atgaacgaaaacacaattcaaggttctccgaaaaagggtgagattggagaattgcactatgcaatcactacgcatggctccgaactcgaaggtggaggacacatgatcgaaaacgcaattcatggggctccgaaaaagggtggaggacacatgaacgaaaaggcaattcatggggctccgaaaaagggtgagaatggagaattgcactatgcaatcactacgcatggctccaaactcgaaggtggacacatgaacgaaaacgtaattcatggggctccgcaaagattgagaatggagaattga

SEQ ID NO: 37532 - DNA, 426 bp, Glycine max
  Peptide Sequence Number=SeqID_129217
atgaagggcaagtatattgttcaaagcttgttaaagaacttagaaaaaatcaagaacaagcttgttcgcacatcgttcgcgtgtatgacatccactccacaagcttgtgattacgtgagcctgaactactaccaatatatagatgttgtttatacaaatgagcacatcttaaaagcttactccgcacaatggtggcctcttgggaatgaagcggctattcctccttttaatgacgcatggacacttatccctgacccaactacaattcgtgcgaaaggtcgtccaaaatcaacaaggataaggaatgagatggattgggtcgaaccatctgagcacagacaaaaatgcagtagatgtggagccgaagggcataacaggcgtcgctgtccaatgcaatctgagcgtgggagttgttcaaatcattga

SEQ ID NO: 37533 - DNA, 459 bp, Glycine max
  Peptide Sequence Number=SeqID_129218
atgaaaaagaagttacttcagactgtcgacgagagatggaggcagtttaaatcagacctcatgaggaaatgggcccttgtagccaatcaggacggtgtggacgacgctgtctgtgagaaatacgacataagcaaggaaaaatgggcccaattttgccagactcgcagagacccttcttgggagaagctcctggctgagaagaccaagaagaagctggaggaagctacacagtcaaaaagcgttgatggcgtcatcaaccctccatcccttgttagacgccacgtgaagtggaagatggcccgcaccaagaaaacaaaggagatgacgactgaggctgccaaggaaatcgctaagaagatcgattcctttgaggagcatgcaacacagggttcctttgtcccccgtggacatcaggatgttctcacagctgctattggacgtccagagcaccctggacgt

SEQ ID NO: 37534 - DNA, 219 bp, Glycine max
  Peptide Sequence Number=SeqID_129219
atgtacaggatgaaatggccccgaggaaacttgcctcaaagagatccaggaaggataaagcggccgaaggaaccagttccgctcccgagtatgacagtcaccgctttaggagcgctgaacactagcagcgtttcgaggccatcaagggatggtcatttctccgggagcgacgcgtccagctcagggacgacgagtataccgatttccaggaagagatag

SEQ ID NO: 37535 - DNA, 432 bp, Glycine max
  Peptide Sequence Number=SeqID_129220
atggcggcgcagctaatccatgatcgagtagagatggagtgcctagagggagcttgggagaccctcgaaggcaacacgaggtgccgatttcggggcacgattcgatttacggtgacttctttggtgcatccagatgaacccgtgcgcacgcttcagcgcactgtggagtggatactacccacgcctacaccatatcgtctagtggagctagtccaagtgatcgaggtgatgtcatccgaggaagaccctgaggaggatcccgaggagctacctcctgagcctgctgtggatgctcttgactttctagagggcgatgaggacccacttcctgaggtggattctcccgaggaagtcatgttggcatctgaggcagactctacggagtatagtggaccgagagagatggcgaccagtggaggctcttcatcatag

SEQ ID NO: 37536 - DNA, 240 bp, Glycine max
  Peptide Sequence Number=SeqID_129221
gggaagtgtggttttcgaaatctgcactttgtgcagatttttgctgtgaaattgtgcagcagaattttgcacaagtgcagaaaaatgctatgcatttgctggctgtggaaagagtagtgcagaaggagttctggatgtttgctacttgggaggatttatggggacccggtgttgagagaaacgaggatatgggctacgtgggagtacgtgagctcagttggaggtgggcaacaggggatg

SEQ ID NO: 37537 - DNA, 264 bp, Glycine max
  Peptide Sequence Number=SeqID_129222
ttgcgatgaacaggctaagcgcagtaggcgcgcttagcgtgttcatcgcgaatcctagaaagatacacagggtttttaaaccctttttaaccacattgcccctaatgggcttcgtcgcaacgtgccctttttgcgggcgagcgaaggtgaggctcacgggtgcgctttccaaaggaggaaaggaaggtattagcacctctcacgtcgacaaaagcggggttcttgctcctacgtaccctccatcgaaaaggaaatcagacctac

SEQ ID NO: 37538 - DNA, 456 bp, Glycine max
  Peptide Sequence Number=SeqID_129223
atggaaaaatcaatcgggaaaataacaaagatcagcatttcccagtcaagagggtccgctcttgacggtgaagaacacattggagatttgaggaatcccatcgggaaaataacaaatataacatttcccagtcaagagggtccggtctttggcggtgaagaacacattggagaatggaggaatccatttgggaaaataacaaagatcacatttcccagtcaagagggtccgctcttgacagtgaagaacacattggagaatggaggattcaatcgggataataccaaagatcacatttcccagtcaagagggtccgctcttgacggtgaagaacacattggagaatggaggaatccaatcgggaaaataacaaagatcacgtttcccagtcaagagggtccgctgttgacggtgaacaacacattggagaatggaaaaatccaatcgggaaaataa

SEQ ID NO: 37539 - DNA, 448 bp, Glycine max
  Peptide Sequence Number=SeqID_129224
ggctgttcatgtgtcctccactttcgagtttagagctgagtttcatgattgcctaagtgcgaaccctcaaggcaatcctccatactccacctttgtccggagcaccatgaatatcggttccttcgccaaaagaaaaaaagaagaagtagagatgagagtcgtcatcacggcaagggcagggcggacgaaatcagtgtcctatctttgctttcctcttatctccgatgagagtcccgagacatctcagaaatcaaaaggaagcaggcttgcgcgatccgtgaaattccgtaatgtggcggaaatcaaaaagaggggggtgcaaatagcaaccaggcccacttgggccctccagaagattcctccagaaggttgttgcttctggaggaagcaacctggctcgcctgggcgagctggacggcaagcttctcccctattttgctataaatag

SEQ ID NO: 37540 - DNA, 570 bp, Glycine max
  Peptide Sequence Number=SeqID_129225
atgagtgctcttggggtagtcggtttggccctgaacctacgtgcctatgacttcgtttctcaagaaatccgcgcagcggaagatcctgaatttgagactttctacaccaaaaatattctcttaaacgaaggtattcgtgcgtggatggcggctcaagatcagcctcatgaaaaccttatattccctgaggaggaaactaccggtttcgcttggtgggccgggaatgcccgacttatcaatttatccggcaaactactaggagcccatgtagcccatgctggattaatagtattctgggccggagcaatgaacctttttgaagtggctcatttcgtacccgagaagcccatgtatgaacaaggtttaattttacttccccatctagctactctaggttggggggtaggtcctgggggggaagttatagacacctttccatactttgtgtctggagtacttcacttaatttcctctgcagtattgggctttggcggtatttatcatgcacttttgggacctgagactcttgaagaatcttttccattcttcggttatgtatgggaaagatag

SEQ ID NO: 37541 - DNA, 1674 bp, Glycine max
  Peptide Sequence Number=SeqID_129226
gctgcgcgtcgatcgcgcaaacaggcggcgatcgagatcgcgctccagccgctgaatggcggcgctgacctgaccgggcagcagcgcacaaacagggtgacatcttctaaacgaatcatcgacgttctcgccattatcgggattttcactctacgagtgaaagtgttgtcctgcaacaggcatttttcccggcgcgatgtctggctatgctgctgtcaacaccctgaaaatattcactcacctggagcctgttgcatgaaagcgattgtttatagccaaaacggtttaccgatttcagatgaaaatgcgttgtatgaactggacgtggcgaaaccgcagccaggcgcacgcgatctgctggtgaaaatcagcgcgattgcggttaacccggttgataccaaagtgcgtgctggcgccccgacggacacgccgcgtattctcggctgggatgccgtgggcgtggtcgaggcggtgggcagcgatgtcacgctgtttcagcccggcgatgaagtttactacgccggcgacatcacacgcgctggcagctatgccgagtatggactggtggatgaacgcatcgccggactcaagccgcgcacgctgagcgacgccgatgccgccgcgctgccgctgacgtcgctcaccgcgtgggaactgctgttcgatcgcctggaaattgatgctgccgacgaaggcacattgctgatcatcggcgcgggcggcggcgtgggttcgatgctgacgcagctggcgcgcaaactgacccgactgacggtcattggtaccgcctctcgcccggaaaccgccgactgggtgcgctcgctgggtgcccatcatgttatcgatcatcagcgtccgctgggtgatcagctggcagcgattggccataaagaggtgcgctacgtggcctcactgacccataccgacagctactatccgcagttgatcgatgtgctggctccgcagggcaaactggcgctgattgacgatccggaaaccctggatgcggtgccgctgaagcgcaaagccatctcgctgcactgggaactgatgtttacccgctcgctgttccataccgccgatatgcagcgccagcatcagattctgcagcaggtgagtcagctgattgacgatcaaaccctgcagaccaccgctggcgagcatcacggcagcatcagcgcggccaacctgcgtaaagcgcatgcgttgattgagagcggtcgcgcacgcggcaagattgagactctcatgacccttaatgatgcggttgcccgccgtcacaccgtaaaagctttctctgcgggcaaaacgctgccgcagcaggagatcgacacgctgcttaacctgctgcgcaacagcccgtcatcggttaactcgcagccgtggcactttgttgtcgcatcgactgcagaagggcgggaaaagatggcgcaatccaccagcggcgcgttcatttacaacaaccctaaagtgctgaacgcctcacacgtgattgcgctgtgcatgcgcaccgatctggatgaagcgcacctgcaaaatgtgctggcgcaggaagaaaaagacgggcgttttgccaaacccgaagccaaagccgggcaggataagagccgccgcagctacgtggatatgcaccgttatgagctgcgcgtcgtgccgcagtggatggagaaacag

SEQ ID NO: 37542 - DNA, 1476 bp, Glycine max
  Peptide Sequence Number=SeqID_129227
atgtcgatgacggagaagcgccgcgagcaggtggcgttcagcgatatgctatacatcacgcccagcgcgctgctgacgcctgccaacagcacgctgacggcggatatcagcacgctgcgcgggaagaatatcggcgtcgcgcagggcaccatccaggaaacctacgccaaaacgaagtgggcaccgcagggcgtcaacgtggtctcgtatccgaatcagatggagatctatccggatctggtagcgggtcgactcgatgccagcctggcgaatgcggtttcggccgagcagggctttctcaacacgccggaaggcaagggttatgtcaataaagccacgctggtggataaagcattattggggaacggcgtaggtatcgggctgcgtaaaggcgatacggccaatcttactttaatcaacaatgcgctggctgcgctgcacagcaacggcacttacgaccggctggcgcagaagaaaatcatgtctttactccctgattatacccagcagcgggcgcgattcctggccgccgtcacgcgccagcacggcgcgctgactgcctatcgccatccgctgaccgcgcccgacggggccgcgctgtacaccgacgttgcggtgatcggcgatccggcggctcccaaacgcatgctgattctctccggcacacatggtgtggagggctattacggttcagacagccagatcgcctggcttgatagcttcgatgtcgccgcgttaccgcccgactgcgcccttgtgctggtccatctgctgaatccatggggcgctgcgcatctgcggcgcgtcaatgaagacaatatcgatctcaaccggaatttcatcgatttcagccagcccgcacccgctaatccgcactatgcgctatggcacgatctgtaccacggcgaccgcgcacatgccgatcggctgctggcggagacactgcagcagtcaggctggccggcgctaaaacgggtagtggaagcgggacaatatcaggcagcagatggcctgttttatggcgggcagcagccggcctggtcgcaccgcacgctgcactccatcgtcgaacagcatctgcgtcaggcgcaggtcatcctgagtttcgacctgcacaccggtgccggcgcgtggggccatccgatgctgctggcgattgctgaacagcgctatccggcgcatgactggggcaagtcgttatacgatgagtggctgacgctgctgtttaccggcgccgggcgcgacagcgacaccggggtgactgccacggcaacgggctatgtctcgcagtttctgctgacgtcgctgcctgacacgcagctgctgccattggtggtggagtgcggcacttatccgggtgaggagatgcaccgccgggtgcgcgacgatcactggctgcatctgcagggcgatccggcaagccacgccgggcgcgctgaagcagcagctggtggaggggttctggcccgccgatga

SEQ ID NO: 37543 - DNA, 771 bp, Glycine max
  Peptide Sequence Number=SeqID_129228
atgtctgctttgattcgatttgatttgcacccactggccgacgccgactggcgtcggcactgtcgccagcagctggagcaacacggcgcgctggtgctgcgtcagtttttgcaaccggcggcgctgcaggcgatcgtggctgacgggctggcccagcgccatctggcttaccacaccgtcagcaagcacaacgtctatctgctgaagccggacgaggcgtaccgtgccgatcatccgcgcaatcgtgacgtaatcagcaccaaaggctgcattaccgacgatgtgattgcagcggaatcgccgctgcgtcagctgtacaatgacgaactgtttaaacgctttctgtgtgatgtgctggacgaagacgcactgtatccgtatgccgacccgctgtcgtccatcaatctgcattacgcgcctgacggccaggaactcggctggcattttgacaactcctctttcgccatcacgctgctggtgcaaaaaccgcgcggcggcggtgtatttgagtatgtgaaagatatgcgcgatgccgatgccggcgagatgaattacgacggcgtcgccgccgtgctcgatcagcgccagccggtcgaggcgctggagattgatgccggtgacctggtgctgtttcgcgggcgtaattcgctgcaccgcgtgacgcccaccgaaggcgatgtcacgcgtatgctggcggtgctggcctacaacactcagcccggtatcgcgctgtccgaaaccgcgcgcatgaccttttacggccggttgtaa

SEQ ID NO: 37544 - DNA, 648 bp, Glycine max
  Peptide Sequence Number=SeqID_129229
atgaacaaggcttcccgtgctttattgattggtgcttcacgcggcctcggcttcgcgctggcggagaatatgctgcagcgcggctatcagctggcgcagcgttacccgcagcagctgacggtggagagcgtggacatcaccgtgccagcagaggtcaacgccctgcatctgcggctaagcggccagcagttcgatctgctgctggtcaacgcgggcgtgaaaaatgacgatcgcgaaacccttgccgatgtgtcgacggaagagtttattcgcgtaatggtcaccaacgcgctgagcccgctgcgcgtgctggaaaccttcagaaacaatgtcagcgcgcgcggcacgctggcggtgatgtcctccggccagggcagtctcaccaacaacacccatggcaactacgaggtgtatcgcggcagtaaagcggcgctgaatatgtttatgcgcagcttcgccgcgcgtcacgacgatgcacgcacgctactgctgctggcccccggctgggtgcgcaccgacatgggtggcgccggggcgcgactgagcattgaggagagcatcccgaatctactcaacacggtggaaagccagaccggacgcggcggcctgcactatctcgattacctcggccgcgtagtaccatggtaa

SEQ ID NO: 37545 - DNA, 2610 bp, Glycine max
  Peptide Sequence Number=SeqID_129230
atgcctaagctgacgctctattcactgccggcgctggcgtcgaaatggctgctgccgaagatcaccgcctggcgggctcactgcccaggctgcgatctcagcctgcacggcactcatgcgccggtggatttcagcgccacaccggcagattttgtcatctgctttggtgaggatcgctacgcgcaactcgacaagcaacggctgttctgtgacgaggtgctgccggtcgccagtccggcgctgatacagcgttacccgggcgaatcgttgctcagccaggcgccgttgatccatctggactggggcaatgaagggcgctttctgcccgactggcgcagctggtttcaggccaaaggcagcatggagccggcggcccagccggcattcagctttaatctcacctcacttgcgatcgacgcggcagtagccggggccggtggtggatccgctcagcctgccgctgagcaaaccctatttcctcgcctggccacagcgttcccgcagtcaacccggcagcgaggcgctgattcagtggctgacgcagctggcgacgttctggctggtgctgagcggttttgtgctcggcgcggcgatccgcaaagtgggccttgcccaacgctgggccaactggctggtggtgccgttcagccagagctggccgcggatggtggcgggcacggtgctgctgagttatctgctggcgctggtgatgccgtcgaacatgggacgcatcgcgctgctgatgccggtggtgctggcactgggcgagcgggccggtatccggccgggcagtcgcggcagcattgggctggcgctggcggtgggcttcggcacctttcaactctctgccagtattctgcccgccaacgtaccaaacctggtgctgagcggcgcggcggaaagcgcgtaccagctgcatttgcaatggctgccgtggtggctgctgcacatgccggtggtggggctgggcaaaggtattctgctggttgcctgcattacgctgctgttccgcgctcagccgcagccggtggcaacgcgggaagcattgccggcgctcagcgggcgcgaatggcggctgattgccctactggccgtcactctactgttgtggatgaccgacagtctgcacggcttatccgctgcgtgggtcgggctggccgcggcgtcggcgtcaatttccgcacctgcatctatatcgccggcattctcggcgtcgccacggtggtggtggactctggcctggggcggctcatcgccaatgcactgcttcacctgctgccgctgcatgactcgccgtcattcagagctggctgccgcttcgggctttccgctactgagcgtggtgatgttgcaggtttttgcctacgccaccccgctgctgccatatcaggcgtcgcccatcgtggtggcaatggggctggggaatgtgcctgccagagccggtttgcagctgtgcctgctggtgtttgtgctgagcgcgctgctgctgttaccgctggattatctgtggttccggctgctaggctatgcctgatacgccgtcagaggtcacgaattcgctatgagacgggcatcgaaagtgttaacgcgcacttctgcggccacgcttacgatccgcatgaccacgacgaactgctggtcggcgtgacgcagcaggggctgcagcgctttaactgtcaccgcgcgctacacaccagcacgccgggccgcgctattctgattgagccgggcgcggtacacgatggccacgcgcccgatgccgccggttttacctatgtgatgctttatctgccgcaaccctgggtggcggagatgatgcagcgccgcgggctgggcgatgtggcgaatattcagggggcatttcgctccacgctcaccgatgatgcgcagctggcctctgcgattcagcaggcatggtttgcggtgcatcagcgggaagggcggctggcgcgcgatcagagcctggatcatctgctcacgctgctgtcccggcatctggaaaataaacccggcgtgcagctcagtgacgcccagcggcagatgcatctgctgcgtgattatctgcacgattttatggcgcaggatatcgggctggacgatctgtcgcgcctgtccggcatcgatcgtttccgcctgacgcgccagttcaagcaggcgtttggccagtcgccgcacgcttatctggttcggctgcggctgcgtagcgcgcgtgcgctgctggcacagggcgttgagccagtgcaggtcgcagcgcagcgcctgaatgtggtggcttttctggcgaccggcattgcggcagccgcgccggagatgatgggtgaaccctatgtcgacgcgcacggtcgtcagtacggcaacatggccggccagccgatgctggtgtttgccgccgatttagccggcctgcaacgggcgcatcgccagggcgtagagcgtgagttaacgctaattccttacgtcgaagcgatgttttccaccggccacgatgccgccaaccgcgcggtgtttctggccgaagacgccgataatctcaacctggtggggatcgcgctgcgcggcccgaaaaaggcggtggataaagccattaaagggctggcgctgcacggttga

SEQ ID NO: 37546 - DNA, 1005 bp, Glycine max
  Peptide Sequence Number=SeqID_129231
atggtgtcgcgagcggtgcgcaccacccagctatggatggatagctctgccggctgctgtgccagcgtgtcgctcatcgtctcgcggtgtgccggaaacagcgcagcgaaggggagtgagctggtctgctcgatcactttatcaatgctgcattcacctatgtgcagggtcatattgcctcctaaagcgtggtgcctgttactgcaggtcactatactgagggctgtttcattatttaaatcgattaaaatcatgaaaagcatcaatgaaaatgatttcagcaaaatcgaccttaacttattgattgtgctgctggtcatgtatgacgtgcgcagcgtaactcaggcggcaaaccggctttatctggggcagccggcggtcagcgcggcattaaaaagactgcgggcaatgtttgacgatgcgctgttcgtgcgttcctcgcaaggcatgacgcccacgccgcgcgcagagcagctggtgcgccagatcgcaccgctgctgcagagcgtccatcgcgttattttcactgccgatcgctttgatgccgcgcacgatagccgcagttttacgctcggcatgagcgactggcttgagcactggctgatgcccgatttactgctgcagctggccgactcggctccgaatattgatatccgggtggtggctgccgatccgtggcaggccattccgctgatggagcagcagcaggctgacgcggtggtgaccgtcggagaggaaaccagccgcgatcttacgcgggagcacattgcgcgcgccggcttccgcacgtgcgctggacgccgcgttagcccgcgaggggctgacgcgccgcgtgcgttatgtcacgccgcacttctcggtgttaccgctaatgttgcagcgtctgccgctgttcgcgaccgttccgcagggactggtgcaggcatggcaacagcgctatgcgctgagtacggcggcggtgccgatcggcatgccggattatgcactttcgctgctgtggcataa

SEQ ID NO: 37547 - DNA, 513 bp, Glycine max
  Peptide Sequence Number=SeqID_129232
atgttgttcaatgcgcgccagcagacagtggctggcgggtgtgacgctgccgtgactggcggccagttcaccgctgagaattttcagcagggtacttttaccgctgccgttgtcgccaatcaggccgatgcggtcgccttttttcaggctgaaatccagggaatggaaaagcgggccaaaggcattgtcgaagccgacggcatgtgcggaaaggagtgtgctcatctacttactctcaagttgcaggcgcaaaaaagcctgaccacgagtgcggtgaataagtcagccgataatagtggcggtgtgcggctttttccagcgatttgtatcagcgttggtatagaggatggctggcaggtatttcgcgtcgacgtgacagaaagaaaattctcacgaatgtttgatattgctattccagatgatatgccagaagacgaaattgcaggctggctgggtgatatctttcatgaagctgcaactgagcatcatcttgatgtgaaacgcatcgaatga

SEQ ID NO: 37548 - DNA, 411 bp, Glycine max
  Peptide Sequence Number=SeqID_129233
atgtcgaaagggatgttccggacatgtggtttcttggccttcctgtcattctttcagcactttgttgaactgttttccaaggagcacaactgcgttagtcagaccttcatcagtatccaggtcatactcatctcttctccttcatcattggacacgaacgccaggtcttgtcttcttttcatgttttccattcagagtcaaaccaatttctccaaaggtttgaagggaaccaatgagttcatctactcttcatgttgcaaatgtcttgctcagcctctattgcagatgatctttcatgtcaaatctcttaggcaaagatctgaggatctttctcaccagcttttcgatctgtctcctttctcccaaggcagtgcaagctgcaatttcaagaatgttcagtggaagtcatga

SEQ ID NO: 37549 - DNA, 130 bp, Glycine max
  Peptide Sequence Number=SeqID_129234
atgagagtccaaagaataagattaccgcagtacctactgaggaagaggaaatctagggtgcattcttcaagggaatcagtaatcagtctcaacagtaatataaggttaatgtcagttgagactgcattag

SEQ ID NO: 37550 - DNA, 527 bp, Glycine max
  Peptide Sequence Number=SeqID_129235
atgcctgagcggggcgaagccagaggaaactctggtggaggcccgcagcgatacggacgtgcaaatcgttcgtctgacttggtttccctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccg

SEQ ID NO: 37551 - DNA, 639 bp, Glycine max
  Peptide Sequence Number=SeqID_129236
atgctagctatcatcgccaagtaccaagaagagttaggtctagccacggctcacgagcatagggtcgcggacgagtatgcccaagtatacgcggaaaaaaaggctagaggaagggtgatcgactctttacaccaagaggcaaccatgtggatggatcggtttgcccttaccttgaacgggagtcaagaacttccccgattgttagccaaggccaaggcgatggcagacacctactccgcccccgaagaaattcatgggcttctcggctattggaaaaacaccataactaaacgcgccacaaggcatccctatcgcaccagatccaaatctagaacgatgggtgatcaagaggagacacaggaacagatgaaagccgacatgtcggctctgaaagaacaaatggcctccatgatggaggccatgttaggaatgaggcagctcatggagaaaaacgcggccaccgctgccgctgtcagttcggctgccgaagcagacccaactctgttggcaactgcgcaccatccttcctcaaacatagtaggacggggaagggacacaatggggcacgatggcaaccctcacctgggatacaaccgagcggcttacccttatggattgccgcccaactactcaccaccc

SEQ ID NO: 37552 - DNA, 332 bp, Glycine max
  Peptide Sequence Number=SeqID_129237
ttcgatttcgggaacttactggttgaagaccgaagaacgacgaagaacgatgaagaacggttgagaatcttcgcgaaatcacccacggaaacgaaaataggggaggagcttgccacccagcttgcccaagagagctcagctcgcacaggcgagctcagctcgcccatgcgagccaggttgcttcctccagacgttgactcatctaacacagtcatgtacaggaaaagaggtcttcttgttacaggtggcatgagcaccgggggattcgcgggggctctgtttgatttttttgaaggcctcttggcagtcgctgttccacagggacccgcctg

SEQ ID NO: 37553 - DNA, 195 bp, Glycine max
  Peptide Sequence Number=SeqID_129238
atgaatgtggtattgatattgatgcacgataactggccttctgtcagccgctcccagattgagttagatgagctggaaagtgtttccattctgtccatgacccttgcatgggatgaattttccttctctacttttcaagaagcccattattcacttcaagattctctagaccaggtgcctgacatgcctttttga

SEQ ID NO: 37554 - DNA, 540 bp, Glycine max
  misc_feature (36)..(36): n is a, c, g, or t
  Peptide Sequence Number=SeqID_129239
atggtttgcaccaaccaagcagatatgatcggaagncttcttgcctgttcattggcatttgaatgtcgcatcatgcactacttgattatgcgcatcctactccctagatcttccaaccttgcacaagtgtctgaggaagatttgataatcatgtgggttttcttaaccggtcgtcaaatcaactgggctcatcttatgagatatcgcatgcataaggcattgcgatcaaatgctccactcccatatccccatttgattactttgtttctacaacatttcaatgcccctcttgactctgagccctttgtcaaagtcaagagatccttctctataggtgcaaatgtagtttcttccttcgattaccacaaagagagggatggctcttgggtaaagaaggatgctccagtacaggccgctgaagactgctctccatcaccacattctcagagagatgactcttcatctcttatgcacaacattcttgaaaggtttgatggacttcaaacctactttggtgaaaggtttgatgctttggaatga

SEQ ID NO: 37555 - DNA, 189 bp, Glycine max
  Peptide Sequence Number=SeqID_129240
atgcagctaccgcaagagcccttgaacaagaaaccaagagggctcgcaaggaagagcatggccgagacaaattctgtggagctttgtggggcagcaatacaagtaccaagaagaattaaatctagccacggcccacgagcacaaagtggcggacaaatatgcctgagtgtacgcggaaaaggaggctag

SEQ ID NO: 37556 - DNA, 351 bp, Glycine max
  Peptide Sequence Number=SeqID_129241
atgtctcttgcaactttatttggaaaacttcaggaacacgaaatggaactaatgagactgaatcaacatgaggagaatgataagaaaaagaaaggaatcacacttaaagcttcatcttcaattcaagaaggaagtgataaagaagatttgaatgaagatttagaaaatgaagttgtgaatctgagtctgatgggtagaaattatgaaagcgatgaagagaaaggacatggtgcatctacatgctattttaagaaaaatagtaataatattaaaatgatatgggttccaaaaggatcttttatcaaaactaacactcaaggacccaagaaagtttgggtacctaagtcataa

SEQ ID NO: 37557 - DNA, 522 bp, Glycine max
  Peptide Sequence Number=SeqID_129242
atgccaatctccccctgtagatggatcgcgcccacaagacttccagtggacccgaagaagtccaacagggccctggagtttccagctctggttacaggcctctgtcagtcctacagggtgcccgttcccccagcaaggtcatcccatcgtgacatagggatcgcgcccacaagacaccctgtggacccaaagaagtccaacagggccctggggtttccagctctggttacgggcctctgtagtcctacagggtgtccgttcccccggcaagggatcgcgcccataagacgcccagtggacccgaagaagtccaacagggtcctggggtttccagctctggttacgggcctctgtagtcctacagggtgcccgttcccccggcaagggaccccgcccgcaagacacccagtggacccaaagaagtccaacaaggtcttaaagtttccaagctctaattacaggcctctgtcagttctacggagtgcctgtcgcccccagcaaggttatcaggccccctactaa

SEQ ID NO: 37558 - DNA, 384 bp, Glycine max
  Peptide Sequence Number=SeqID_129243
atgactatgcaaaacatgcagtttcaacaagagaccagagcttccattcagagcttaactaatcagatgggacaattggctacacagttaaatcaacaacagtcccagaattctaacagattgccttctcaatctttccaaaatcccaaaaatgtgagtgtcgtttcattaaggtcgggaaagcagtgtcaaggacctcaaccagtagcaccttcctcgtccgcaaatgaacctacccaacctcactctgctccagaacaagatgataacaaaaatttaaagaagaagcagcatatccctcttccattccctccaagagcaattcccaacaaaaaaatggaagaggcagagaaggagatcttggaaacatttagaaaagtagag

SEQ ID NO: 37559 - DNA, 342 bp, Glycine max
  Peptide Sequence Number=SeqID_129244
atgtcaggactcatacgcgattctcctcaaatttcagccaacccgcatcaattagactttgcaccttacgcttcgaggtcatacagtgctcaatggaatgtctcagaactcttccatgatatgcgcatgttgcattcgagtcatatcctcgaagaaatggaggttgatgaaccttggctggggttatggctaccattgaattatcaagtgggttttgtggctgatttggggatggcctttgtggataactgggtggtgggaacgacagtcacaacatgggtttctccttcattctcaccctcttcatttgccccagttttctcattcttccaagtaggatga

SEQ ID NO: 37560 - DNA, 534 bp, Glycine max
  Peptide Sequence Number=SeqID_129245
atgtatgaataccttgaagaggaaagagtccctgatcttgagagtattttggcagacttcatgacataccaagccagctctaaagggtcctgttatggaatgcaacaacagggaactcaatttcaaaggaaccagtctcctgtaggctatcactgggagtcatgttggcaaccagattatgataataaagtagaaggagttattaatctggatgacctgctaatgcaatttaaagacacaatagagtcaatgcaacaggcttttagaagaactgcaactcagattagtaagttggttgatgacatggctaacactgcggccagacaagaggaagagcgtgtagagattgaaacgtatcaagaaagcatttttcaagtgacctccatgcatcatcagatgccactgcagaggaaatgtctgaagtctccagtactccagaatactcttgctcggccgctgctggctatgttagaggaacagagaaagatatgggtgatgcttgttctgaggaggaagaggtggaacaagaaatag

SEQ ID NO: 37561 - DNA, 141 bp, Glycine max
  Peptide Sequence Number=SeqID_129246
atgatatcaactaagcctgttgatcgatatacaagaccagaatttacagagaatgggccgttggcaattgattctaaacaggctattaatcatattaagaggaagtatgagttggagaatatggaaagtgggatcctctag

SEQ ID NO: 37562 - DNA, 390 bp, Glycine max
  Peptide Sequence Number=SeqID_129247
cgcggcctgctcgcgggtgtcgctggcgccggcgtacacgcgggtgctggacaggtaggtgaggctgtcgaagttgtcccccgcgatcaggcgccgcagcaggcagacatgggcttccaccgtctccagcggccggccgcggaaatccgaggtcaggccgatggcgtagatcacgtgccccagggggcggtcgaacagcccggcgtcattgcgccccggcgcttcgcaggcgatgccgtcggcgcgcaggcgcgccagcaggtggcggccgatgaagccggttgcccccaggacggtgaccggcgcggtgttcatgcgtcgtggccgccgtcgatcgccaggccgggcacggccgtgaccagcttggcgtgccagccctcgcgcgcgtag

SEQ ID NO: 37563 - DNA, 861 bp, Glycine max
  Peptide Sequence Number=SeqID_129248
atgggctggctgcaaacgcttcttcctgatcgcttcgccgttctgaacatgaaacaacccactccgatttccgccttgctgtccctgctggcgcgcgtctgtgtcgcggcggggctgttggccggcgcttcggcggcgcatgccgaacggctcaaggacctggcttccatccagggtgtgcgcggcaaccagttgatcggttatggcctggtggtgggcctggacggcagcggcgaccaggtgcgccagaccccgttcacgcagcagagcctgaccaacatgctgtcgcagctgggcatcaccgtgcccgccggcagcaacatgcagctcaagaacgtggcggccgtcatggtgacgacgaccctgccggccttcgcccggcccggccagacgctggacgtggtggtgtccgtgcagatcaaccagctcaacggcggccgcatcagcggcggcgcgatcgtcgagcgcggcgtgccgaccaccttcgcgcgcgacggctacatctacctggagctgaacaacaccgacttcggcaccgcccagaacgtggtgaacgcattgaaccgcaagttcgggcagggcaccgccaccgcgctggatggccgggtggtgcaagtgcgcacgccgctggagcaggcgtcgcaggcgcgtttcctgtcgcaggtcgaggatctgcaggtgacgcgcgcgcccaccgtggccaaggtcatcatcaatgcccgcaccggttcggtggtcatgaaccgcacggtcatgatcgaagaggccgccgtcgcgcacggcaacctgtcggtcatcatcaatcgccagaaccaggtgtcgcaaccggacacgctcttcaccaaagggcagacggtggtg

SEQ ID NO: 37564 - DNA, 342 bp, Glycine max
  Peptide Sequence Number=SeqID_129249
atgagggagaaacccatgcttgactgccaagggggacggccaaatttcccaccaacccaacaatatctttactcagccaataacaaactttctccttacccaccacccagttatccacaaaggccatccctaaatctaccacaaagtctgtctaccgcacttccaatgacgaacaccacctttagcacaaaccaaaaacaccaaccaagaaccataaccctagccaaggatcatcaacctccatttctccgagaatacgacttgaacgcaatgtgtgcttgtcacgaggaagtctcggggcgttccattgagcattgtagggctctgaagcgtaaagtgtga

SEQ ID NO: 37565 - DNA, 75 bp, Glycine max
  Peptide Sequence Number=SeqID_129250
atgggtgccaagtacctcgaagtagtcaaacgagggttgcatcccaaaaacggacggtccccgaacgaaattagg

SEQ ID NO: 37566 - DNA, 385 bp, Glycine max
  Peptide Sequence Number=SeqID_129251
ggtacatctacttgggtttgactgagaacaagagagggtacatctcttgtggatcagttctagtggagggtacatccactaggttcaaagagaacaagggagggtacatcccttgtggatctttgcttgtaaaaggatttttacaagtgcaatgtcagatgtttacacttgttggacacattcagttctacaacaatgagtcactagataaaatgaaaagcataggaaactctttgcaatatcttgtggtggcattttcaatttatattggaaccttgttggttaatgttgtgcaccaactgactcggaagcatggtggaattgattggttgaatgatgacatcaatgctggaagattggactactattacttcctcatggctgg

SEQ ID NO: 37567 - DNA, 102 bp, Glycine max
  Peptide Sequence Number=SeqID_129252
atggttattactggtactattagtattgctcaagttgatgttatggatgagtttatacaatttgaagatcaagatatgtcacaagtgggtaatctcaactag

SEQ ID NO: 37568 - DNA, 327 bp, Glycine max
  Peptide Sequence Number=SeqID_129253
cggttttctgagattcctccagttattccttcgactgctccgatagaattttcaaacgtcagagagacggagaagagattgaaaatgctacaatgcgaaaggtatttctctcagctcaaatatgatatcacaattcccaacggtgagacttctcagaattggactgcgaacgtagtgctcaaatttcacgacgatccaacggtgaacgagtctgagatcgtcatttttctgagacatgttaggtggcctgtgggtaaaagagagggttttgggagaagagagaagaaacgaaattgtgaggcagaggaaactgaggagtcagtctga

SEQ ID NO: 37569 - DNA, 144 bp, Glycine max
  Peptide Sequence Number=SeqID_129254
atgcctcctatggtagtcataactcttgcaagagcctatgtgaagaacttcatgactattatgaaggaaggcatagaatttgagtcaagaagcgaggggaaaaccatcttaagagctattggactaagaagcactccaaattga

SEQ ID NO: 37570 - DNA, 322 bp, Glycine max
  Peptide Sequence Number=SeqID_129255
ccccacgaattgccctttcgttcatgtgtcctccaccttcgagtttggagctatgcgtagtgattgcttagtgcaattctccattttcaccctttttcggagccccatgaattgcgttttcgttcatgtgtcctccaccttcaagtttggagccatgcgtactatgcgtagtgattgcttagtgcaattctccattctcaatcttttcggagcccgcatgaattgcgttttcgttcttgtgccgtccaccttcgagtttggagctatgcgtagtgattgcttagtgcaattctccactctcaatcttttcggagccccatga

SEQ ID NO: 37571 - DNA, 844 bp, Glycine max
  Peptide Sequence Number=SeqID_129256
gatcccacgtattaactacaatcccgcgctcgctataagacaactagggtaccccatgaggggagcaccgatggaagaaagcatgtctcctttccttgtgagggatttcggcgcgcaaaatttcaaggctatacaaagaatccataaggcatgggaaaccccgttaaggaaagatcaagaacttaggggcattcgtaatggcatcattggtggttaccatgaatggctgaaagttcatatacgaggtttagattggctcgccaagttaaaagtcgtcagcgaagagagttttgaagcaccggaagaggacgaagaagtccaagctctcaaaagcgagttaggaaaggcaaaactcgccgaggagaagtccaagttggccgctacacacatccgaaagaagtgtgccggattacgggaagagaatgcaactaccgcaagagcccttgaacaagaggccaagagggctcgcaaggaagagtatggccgtaacaaatttcacgaagctctgtgggttagcaacagtgaactcaagctgtccaaaaggagcttgtctcagcgtttatgcgagacggagaccaacatgctagctatcatcgccaagtaccaagaagagttaggtctagccacggcccacgagcatagggtcgcggacgagtatgcccaagcaaccatgtggatggatcggtttgctcttaccttgaacgggagtcaagaacttccccgattgttagccaaggccaaggcaatggcggacacctactccgcccccgaagaaattcatgggcttctcagctattgtcagcatatgatagacttaatggcccatatatttagaaatcgctag

SEQ ID NO: 37572 - DNA, 291 bp, Glycine max
  Peptide Sequence Number=SeqID_129257
atgttatccttcagccagatgcaatcccaattacagtcacagatgcaatcacagggacttgcactgcctcctgagcctgaggttggttctttagctgcttatgtcagcacaaaggagagttgtgttaatccctcaaggaacgatccagacacaggtgacttagacaaatgcgggttgtacatcgcagaaaatcctcccagcttggttgccctaagaagagtttatgagggatccacaaccgttcacaacatctctttgttgcatgatcaagtgaaggtcggtgttgagtag

SEQ ID NO: 37573 - DNA, 639 bp, Glycine max
  Peptide Sequence Number=SeqID_129258
atgggtctgggcaaggacagccacgagaatgccgatgtggttgacgttaggcgtaacccgcacaaatatgggttggggtatgagcccgggaaacctggaagaaggaatgcaccatcaagactccgggcagatagggcatggcccggtcatgttagccagtgtttcacaagtgccgggataatgttcgaggaagaggtggcggcgataggagaagaggctccacaagatccgccgagtttcctgcgaccgtgcaatcccaatttccaattggggaattggcacgtgacgagccagtcagaagtctataccgctgattcaatatgtgagaatcgatcctttgaggatcctaacagcgagggtttgataatcgatttcgaccgagaagtaagtcaaacaataaacaaagaagaggaagaggacgtcctttcaccagagttggagagattgatcgctcaagaagaacgcgtgtcgcaacatgcccttttgcgggcaagcgatgcaagactcgcgggtgcgctttccaaaggaggaaagatgcgcggagtcgccaccaacgtttatttgtggaaaacgtcggaaaaaccgaagggaatcggtcaaaatgaaaattctaagttcgggagttgtatttacgtttga

SEQ ID NO: 37574 - DNA, 888 bp, Glycine max
  Peptide Sequence Number=SeqID_129259
atcgcgccgcggaatcctgcacgtctcccagccagcactcagccggcgtatccagaaactggaacaggcggtggggtcgccgctgctggagcgcaccacgcgcagcgtcagtaccaccgctgtcggcgagaacctgctgccgctggtgcgccgcatgctggaggaattcgatggatcactgttctcgctgcgcggccgcgaggacacccgcggcgcgacagtgaccatcgcctgcctgccgacggcggcgttctacttcctgcccagcgtgatggcgcgtttccacgaagcgcacccgaacgtgcgcttccgcattctggatatcccggccacggagggtctgcaggcagtggaacgtggcgaagtggagttcggcatcaacttcatgggcgccaacgatccgaatctcgatttcgacgtactggcagaggacccgttcgtgctggcgtgccgtcgcgatcatccgctggcgcgcaagcgcaaggtggaatgggccgacctggccgagcaccagttgatcaccgtgcatcgcaccagcggcaaccgcacgctgctggatggtgcgctggcgcgcgagaacctcaagttgagctggcactacgaagtgacccacctgtcgacgtcactgggcatggtcgaggtcggcatcggggtgtcagtgctgccgaagatggtcacgccagatgggggtcaccccaccctggtgacgcgcgcgatcggcaacccggtggtgtcacgcacgatcggtatcgtccgccgccgcggcgccctgctctcgctcactgcggagcgattcctgcagatgctgatgagccagtggcgcgcggaggcgtgagcagccacgcagttcacgcacccatccgttctggcactctgagcgctgacagg

SEQ ID NO: 37575 - DNA, 101 bp, Glycine max
  Peptide Sequence Number=SeqID_129260
atggcttcgatcatgtctttgccccacatggaaaatggccaaggtgctgccaagacgttcaacgatacaggtggagcattaacattatcaacgaaggcctg

SEQ ID NO: 37576 - DNA, 186 bp, Glycine max
  Peptide Sequence Number=SeqID_129261
atgaggatcaaaaggtcttttaaggttgtaatggggccaaggacaaggcttgtagtgagcttcaaaacaaggaaagggaaacaaggctcaaaagggctatcaaaggaattaattcaaggaagcatcaacaagaatcaagccaaggctattgtgcaagcaatcaatggggctaaacacaccaaatga

SEQ ID NO: 37577 - DNA, 528 bp, Glycine max
  Peptide Sequence Number=SeqID_129262
atgtatgtctgcggcatgacggtgtatgacttttgccatcttggccatgcgcgcgtgatggtggtgtttgatatggttgcgcgctggttccgtgccagtggttacgaggtgacttatgtgcgcaatattaccgacattgacgacaaaatcatcaaacgtgccaacgagaacaatgaaagtatccaaagcctgacgcagcgttttatcacggccatggacgaagattctgccaaactcggtattattcgtcccgacattgagccgcgtgctaccgagcatgtgcaaggtatgctggacatgatcactcagctcatcaacaaaggttttgcttatcaggcagacaacggagacgtgttttacaaggcaaaagcctggatgatttgcgtgccggcgaacgtgtggatgtcgacgggcataagcaggatccgctcgacttcgtgctatggaagtccgccaaacccggtgagccttactgggagtcgccatggggcaatggccgtcctggctggcatattgaatgttcggtga

SEQ ID NO: 37578 - DNA, 394 bp, Glycine max
  Peptide Sequence Number=SeqID_129263
tttctctccgggttccttgttgaccaattatcagacttatcaaggtaatccttgtggcgtctaccctgacttatcttccttcactggaagtggcgtctacccagacttatcttccttcaccggaagtggcgtctacccagacttatcttccttcaccggaagtggcgtctacccagacttatcttccttcactggaagtggcgtctacccagacttatcttccttcaccggaagtggcgtctacccagacttatcttccttcactggaagtggcgtctaccctgacttatcttccttcactggaagtggcgtctaccctgacttatcttccttcaccggaagtggcgtcatccaaacctccgtagcctgtatcaaacgatccactcctactcag

SEQ ID NO: 37579 - DNA, 642 bp, Glycine max
  Peptide Sequence Number=SeqID_129264
atgactaccctgacccaaatatggatgacgttgctgctcagcaacatccagcccagcgatcataattccgacctccccctgccgaagtgtatgccacctaccaggcaccctttagacccagataagtctaacagagcctggggttttccggcattgatcacgggtctctgccagtcgttcggggttcctgtcgtgcccagtaaggtgatccgaccgccgatcacccatgttttcatagagaagtactgcacagctagacaggcacagggtggcgaccctcaggccccagatgcaccgctgccacctcctcaggctgacccgactgggtcatttgacacggagcggtatttacggcatttggttcgccagcaggaggccaaccaccgggtgcacgtgcagacccattactctctatatcagcttagcctcagcctgcagagccagggttttgtttcttttccatgccctactccggatcagttcagggcagaggtcgcatggccaggagattggcctgaggcccaggcaggggaggcacccgcagagacacccgcagaggctctcagcaaggcagataaggcccgcgaggacgaggagatgaccggcttgcttgatttcttgggagggagcggagccacatga

SEQ ID NO: 37580 - DNA, 309 bp, Glycine max
  Peptide Sequence Number=SeqID_129265
atgcaatctcagggacttgcactgcctccggagcctctagttggtccctcaggtcctcgagtaagcacaaaggagagttgtgttgatccctcaggaaacgatcctgagacgggtgactcagagaggtgcggcttgtacatcgaagcaaatcctactcacctggttgccctaggaaaagtttatgagggatccactgttgttcataacactcctttgttgcatgtccaagtaaaggtgggtgtggaggaggttaaagatccaaatgctcccgttcctgtacccactgatgaggtttccttaatggggtag

SEQ ID NO: 37581 - DNA, 1089 bp, Glycine max
  Peptide Sequence Number=SeqID_129266
atggaacaggaaaattacaccaataaatatttacaagttttaggagaaaccattaagactaaggtagttcctaaacaaaaatcggttgaagaagcctctccaagtattcccattgaaaaaccactgttcaaacctttcaaagttagtgaaaaggctaaacgaaaaattagagaacttaggaaaactaaatccttagttgaaggagtaggtgacaatcatagtgaattactaaacaagattggtagtttacttaaggtcattccagatacttcccaaacatcggaaaatacttccaaaatggtaacaagaagtacctccaaattaattaatgttattaatgaagatagtgaccaaaactcagataacataactgagttaggatcagtgtcagaaaagaatataaatccaattaattccaaacattggaaaacaccttccaaattatattatcaacgtccagctgcctttgatcttctattagaagaaagaggagaaaacaattttaagatttttagtgcaaacaacatctatgaatggaacatagatgcacaaatggagtataatatcacgaatacactccaacatatgaccatggtagctatggcttaccaaacctcccacgaatgttcaaaagaaaccattatagatatcttagtggcaggattttctggacaactaaaaggatgcgcagttaagacggatctcaacgaaaaagttattactaatgacgatgataaagagattcctgacgctgtcaataccttaatttttacaatagctcaacattttattggagacccatccttatggaaagataggtctgcagaattattatcaaaccttaagtgtagaaccttagcagattttaggtggtatagagatactttcctaactagggtttacaccagagaagatagtcaacaaccattctggaaagaaaaatttttagctggtcttcccagatcattaggagacaaggttagagataaaattcgtagtcaatctgctaatggagacattccatatgaaaacttaagctatggtcagttgatttcctatgtccaaaaggtagccttaaaaatctgctaa

SEQ ID NO: 37582 - DNA, 615 bp, Glycine max
  Peptide Sequence Number=SeqID_129267
atgtggatggatcggtttgctcttaccttgaacgggagtcaagaacttccccgattgttagccaaggccaaggcaatggcggacacctactccgcccccgaagaaattcatgggcttctcggctattggaaaaacaccataactaaacgcgccacaaggcatccctatcgcaccagatccaaatctagaacgatgggtgatcaagaagagacacaggaacagatgaaagccgacatgtcggctctaaaagaacagatggcttccatgatggaggccatgttaggaatgaggcagctcatggagaaaaacgtggccaccgctgccgctgtcagttcggctaccgaagcagacccaactctcttggctaccgcgcgccatcctccctcaaacatagtaggacggggaaggaacacgctggggcatgatggcaaccctcatctgggatacaaccgagcggcttacccttatggattgctgcccaactactcaccacccgtcctgcaagacgatgcgggccatattgcttctcccgtccttgaaagagagcctcctcaacagcctgacgaggtccatgaagaccctcaagactatgctcgaagggatgtcgagttctaa

SEQ ID NO: 37583 - DNA, 57 bp, Glycine max
  Peptide Sequence Number=SeqID_129268
atgggggtagtggagaggagtgggaagagaattcaagaaaagggtggcatctcataa

SEQ ID NO: 37584 - DNA, 84 bp, Glycine max
  Peptide Sequence Number=SeqID_129269
cgattctgtggaaattcttcgtcgttcttcgtcgttcttcaccgttcttcaaccgttcttcgttcgttcttcgttcttcaacgg

SEQ ID NO: 37585 - DNA, 282 bp, Glycine max
  Peptide Sequence Number=SeqID_129270
atggtggcatctccacattattggggatttggagtagaatcacgaggaacaacctcaaaaattcccgatccttttgctatagaacaaggtaacccaacaaaaattaaaaatggatatgaggagaaatggttgctcaacatcatggtcattgatacacgtggtgcacaagataagaaagcttgcactcaatgtagatgtgaccatatgaatctcccgaaggacttttataatgcagagtataccattccagctggtggtggtggtgaattcatcctcatgtaa

SEQ ID NO: 37586 - DNA, 447 bp, Glycine max
  Peptide Sequence Number=SeqID_129271
atgggagtggagttctttttctttaagcttttccttgatgatgcaatggtgaaccaggacatacctcaaaaccggactaagtactggcctgcccaacatactgtctgcgatgagcatcttccccctagcacaaagacccctttccccgaagattccaatccctggagtcccgaactctcctctccttcttcccgagcttatacagcgggaacctggtttccggaattcggggggcctctaggttccgttcattctccttcttctctctttcttcatgaaaagccatcaaccgggggaatgcacataaggtatgtcgcaggtttttcttgtgaagatgccggaaatggcggacgccaggggtctcaaccccgcgggccggttatccgggggcgttcccgttcgaggggcccgtctggacgggagggactcaaggttgagttcaaataa

SEQ ID NO: 37587 - DNA, 85 bp, Glycine max
  Peptide Sequence Number=SeqID_129272
atgggagaaagtaaaaaggaagaagaagaaggaaagaaagctcctgatcagggatcgaaggaaaacagaagaaatgtgcagaaag

SEQ ID NO: 37588 - DNA, 783 bp, Glycine max
  Peptide Sequence Number=SeqID_129273
atggaagacatttgtaagaggtggactgagtatcttgacagcacacgatcaagggtcaatcacccacaatcgataaattgtgatttttgtggagaagagcatttcaatgacaactgtcatctctactccatgaaaaattcttggtggggacaagagttatacccttacaatcaatatgaagaaagaactcctaatcttgaaagtgtgttcacgaaattcacggcataccatcctagctctactgccaatcaaaactcaatgcaaaatcaggaaattcaggttggaaacagctactccatggaaaattatcaatgggagcaagagttacaaccctacaatcaatatgaagaagaaagaacttctaatctggataatttattgatgcaattcaaggaagtcactgaatatactcaacaagcatttaaaagttttgaaattcaagttggtaagctagcagaagaagtgactaaatttatggccagaagagaagaaaactttataaaggttgaagctcaagaggaaagccctgtacgaaagcatgattcaaaagaaaaagatgaagataaaagtgaggagaaagcacaacaatgggagaagtactcacaagaagaaagacatggagaacatgagaaagccttaagtgctattctttccttgatcactagcacttctcttgcaatgatatggaaggtgcttccagaatacatgactttcatggagtctctagctaggaggcaaaaatacaaggaatatgtgttctttgtgaccttcatgccaccttga

SEQ ID NO: 37589 - DNA, 171 bp, Glycine max
  Peptide Sequence Number=SeqID_129274
atgactaaagcacgtcaaaagggggtacggaaagggaaaaaagggaggtggttgccacccagctcgcccaggcgagctgggttgcttccaccagaaggcaccgccttctgttggaagatcttggaaggcccaagtgggccggattgctatttgtacacccttgtttactaa

SEQ ID NO: 37590 - DNA, 321 bp, Glycine max
  Peptide Sequence Number=SeqID_129275
atggtcctccaggacaccttgtatacatcgtgttccttgcagcttcaattcttcataagcattttatcttgccttgtcacagcacttgaagcagcagctttccctgatgtcgagacaatcgtctgggacatgcccctcaaacaaaatttccaaaccgcaacagcggaagtatctgtatgtggcgacagcaaaattctgcaagttgcaagtcgtttccaggatgtcaagacatctcacgtgacatcagctttctgctccccctgtctccatgctcctactgctgtgaagcagttcactgcggcatctttctatcagctacta

SEQ ID NO: 37591 - DNA, 333 bp, Glycine max
  Peptide Sequence Number=SeqID_129276
atgaaacaccggaaagcgcatcgagttgtcaagtatttaaaattaaaacggagtgatccgagtattgaactgatgcaatcctaccccgcaagggcattggatagaagactccaagttgattgggccaaagatccaagggaaggccctagggttctcatgagccttaggctaagctctagcttctttaggaatcttcttaaggaagcttctcaaggaggtgagcttagttattatagggggtgtgtagctaagctctatcttctcaaggaagttttctcaaagaagcttttcaaggaagttttctcaagaaagcttctcaaggaagctacctag

SEQ ID NO: 37592 - DNA, 594 bp, Glycine max
  Peptide Sequence Number=SeqID_129277
ataatgtcctggggagaaacattttgcgtgagaggaaggtggagctctaccccaccgagttggatgattttaaaattgagttggagaggtgtaatttccataaacgcctcaccaatttggttgatgagagcatagatttggctttcgtgaaggaattctatgcaaacctatacaactctgatggtctttcactaaagcaagctagggtcagaggccacctagtgaaggtgttggcagagggtgagactttacccacatactccagatactgcaagctgcccacagattacagagagattgaggctgtcttatgcataccaagccgagggttcattttgaacgctgagggccatcttgggaggattctcaggaaagatttgactactttagcccaggtgtggagtgttctctcatactccaacctggcccccacatcacatacctctgatctgacaatggatagagctatgctgatctttggcctagtctctcgcatggacatgaacatagaagctcttatttctggtcagatgacttctatagcccagtctagcacttctagagttgggtttcctgctctgatcaccgccctat

SEQ ID NO: 37593 - DNA, 384 bp, Glycine max
  Peptide Sequence Number=SeqID_129278
atgaacgaagatcaatggatgtatgacagtataatgtctgaagaagttgatatgaatgaacaaaataaagaagaagttggtgtgaaatcaaaacatgttgattgttctaatgtgttcaatacttctcaagtgtttgctacccgtgatgatgttttgaattgggctcaagctgttgcttatgaaattggtgttgtgacagtcattatgaggtcaaacacaaacactggtataagaggaaagactttatttgttttaattggttgtgaaagaagtgatcagtataggtccaggaagaaagattttgtaagaagagatactagcagtagcaaatgtgggtgtccctttaagttgtgtggaaaaccagtggttggaggccaagaatga

SEQ ID NO: 37594 - DNA, 795 bp, Glycine max
  Peptide Sequence Number=SeqID_129279
atggaaaagaacgcgccactgctggagtcgtggcagcgtgaagtgctgcgcattgtgcgtaaagtcagccagtatttttacccgcagaaacagacccaggtgatgaatgaaggctgggcgaccttctggcactacaccatcctgaatcacctgtacgatgagggcaaagtgtcggagcgctttatgatggagttcctgcacagccataccaacgtggtgtatcagccgccgtataacagccagtggtataacggtatcaacccgtatgcgctgggctttgccatgtttcaggacatcaagcgcatctgtcagtcgccaaccgaagaagatcgctactggttcccggacatcgccggttccgactggctgaagacgctgcatttcgccatgcgcgaatttaaagacgagagcttcatcagccagttcctgtcgccgaaagtgatgcgggatttccgtctgtttacggtgatggacgacgatcgcaataactatcttgagattgccgccattcatgatgaggcgggatatcgcgcaattcgtcagcagctgtcggcgcagtacaatctgagcaatctggagccgaatattcaggtgtacaacgttgacctgcgcggtgaccgttcgctgacgctacgctatgtgccgcagcagcgcgccccgcttgataagagccgtcgcgatgtgctgaagcatgtgcatcggctgtggggttttgatgtcaatctggaacagcagaacgaagatggcagcgtggagctgctggatcgctgcccggcgcgcggaccggcgctttaa

SEQ ID NO: 37595 - DNA, 483 bp, Glycine max
  Peptide Sequence Number=SeqID_129280
atgtggagtcaacattccaatatcttaaacaacattgactctgtgaagaagagagaatctcctctgtccctgcattacaaactgtttgaggggacacatgtcccagacattgtctcgacatcagggaaagctgctgctacaggtgctgtgtccaaggatgctttgattgctgaactcaaggacacatgcaaggtgctggaagcaaccatcaaagccaccacagagaagaaaatggagctggaacgcctgatcaaaagactctcagacagtggcattaatgatggagaagcagctgaggaagaagaagaagctgaggaagaagaagaagcagctgaggaagaagaagaagcagctgaggaagaagaagtgcagcagaggatacagaatcagatgatgatgattctgatgctaccccatgaccatcagacctttatttttgctgttattcttactagttattggtctgtaatatttgcacattaa

SEQ ID NO: 37596 - DNA, 246 bp, Glycine max
  Peptide Sequence Number=SeqID_129281
atgggtgaaggtgatggtggcaatgttgaattagtgggagatgttggaggaagttcaaatgatccaattgtagaatcttttgatctagataatttaattttggtggaacctaatgatgatgcacaatctgaggaagaccttgatgatgatggagatggtgatgaaagtgacgatattcatggagatgatcctattagaggatggacatggtctttgaagacatttgtgggttttttagttatttaa

SEQ ID NO: 37597 - DNA, 372 bp, Glycine max
  Peptide Sequence Number=SeqID_129282
atgacagtcaccattttaggagcgctgagcaccagcagcgcttcgaggccatcaagggatggtcatttctccgggagcaacgcgtccagctcagggaccgacgagtatactgacttccaggaggagatagtccgccgtcggtgggcatcactggttacccccatggccaagttcgacccagacatagtcctcgagttttatgccaatgcttggcctacagtggagggtgtacgagatatgcgatcctgggtgaggggattttgcccggactactgctgggagacgagtgcggatcatgcgcaccaacatgaccaccctgaccaagatctggatgaccttgctgctcagcaacatccagcccagcgatcataa

SEQ ID NO: 37598 - DNA, 129 bp, Glycine max
  Peptide Sequence Number=SeqID_129283
atgaaggttcgtgatcatcacaggtaccaaccacacagtacaaaaattgcaatggcaattccccttcatagtgatcagcctgagtcaagggagttccaaatcgagtggcatgcccccaagtacaagtag

SEQ ID NO: 37599 - DNA, 378 bp, Glycine max
  Peptide Sequence Number=SeqID_129284
atggcacccacaagacacccagtggacccggagaagtccaacagggccctggggtttccagctctggttacaggcctctgtacggtgcctgttccccccggaaagggatcgcacccacaaaggcacccagtggactcggagaagtccaatagggccctggggtttccagttcttgttacgggcctctgtagtcctacagggtgcccgttccccccggcaaggtcacgtcatcatgacatagggatcgcgcctgcaagacacccagcggacccgaagaagtccaacagggtcttggagttgtcaagctctaattacgagtctctgtcagttctacggagtgcctgtcacctccaacaagggcatcaggccccctactaa

SEQ ID NO: 37600 - DNA, 900 bp, Glycine max
  Peptide Sequence Number=SeqID_129285
atggggacaaagggttgcatcagttacaatcccgttcttgctataaggcaacttggctaccctatgagaggggcaccactagaggaagagctcgcgcctgtcatttcacgaggtttctttaaaaccaacgtggagacacttcagaaagtccacaaggcatgggaggtggtgcaaaagaaggacagagaactctggggcagtaacaatgggcccatcggtggctaccgtaagtggttgagagcccacgtgcaaggtttggattggctcccgagtttgagaattactaaaagggaggaagttgaggcatcggaggaagacgaagaggtgcaggcccttaggacaaaactcaagcaagcccaaacagtcaaagaaaggttcaaatcagaagctcttaaaatccgaaaggagaatgccgaactaagagatataaatatagctaccaccaaggccttggaacaagagaccaagagggctcgtagggaagagcacggccagaacaagtttcgaggggctttgtggggcagtaatagcgagcttaagctctggagagaggaaagggaccaatcacgagtagacagtctgatcttgaaagatgagttgaagacagagaccaacacgttagccatcatcagcaagtaccaagcagaactaaatctagccacggcccacgagcatagagtggcggacgagtatgcccaagtgtacgcagaaaaggaggctagaggaagggtgatcgactctttacatcaagaggcaacaatgtggatggaccgatttgctcttaccttgaacgagagtcaagaacttccccgattgctagccaaggccaaagtgatggcggacaccttactccgcccccgaggagatccacggacttctcggcttattgtcagcatatga

SEQ ID NO: 37601 - DNA, 339 bp, Glycine max
  Peptide Sequence Number=SeqID_129286
atggaaccaaagtcacgaatagataaatataaaatccaacagtcatctcaacctgttgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagatgcgatctacgaactcttaagtgaaaggttcgggagttgtatttacgcgcggggaaggtgttttcctttgctcctacgtattcctcaatttgggatgagaaaatcagacctacgtagttctttcttatcaagtgattctttttactttaagaggtga

SEQ ID NO: 37602 - DNA, 750 bp, Glycine max
  Peptide Sequence Number=SeqID_129287
atggatgggttggtggacctggcagcgatcgacgcttttctcgcctatcataaccacaaggaaagcccggttgtcactatactagccgatctatacgacacctttgaccgaagatgtgaaaaaagcaatacaaggattgtttgctgtactccagctctttatgtatggttagtctcgcacctttttcgccaagaagtgaggcatgcttgcccattagaaagccactgttcatgcacagagaaaggaagggcgaattgggatcaactcttagcaagcaaagaaggagcatctatcaactgtttccctcgatggaaggaaggaagaaccgaagttcttatttcatgcagaggatttccaaatgttcccttgatggggacaaggggttgcatcagctacaatcccgttcttgctataagacaacttggctatcctatgagaggagcaccactagaggaagagatcgtgcctaaggttcacaaggcatgggaggtgttgcaaaagaaagacaaggaactcagaggcagtaacaatgggcccatcggtggctaccgtgagtggttgaaagcccacgtgcaaggttcggattggctcccaagtctgagagccactaaaagggaggaagatgaggcaccggaggaagacgaaggggtgcaggcccttaggacagaactcaagcaagctcaaacagtcaaagaaaggttcaaatctgcagctcttaagatccgaaaggagaatgccgaactgagagat

SEQ ID NO: 37603 - DNA, 798 bp, Glycine max
  Peptide Sequence Number=SeqID_129288
atggcttctaggaaaagaaaggcaccatctacacccacacaagttagattagaaagatcaagatttacttcccaagaggcatgggaaagatatacagacattattgtgcctaggaagtttctgccagagaggaacgtggtggaattatatgccaacccctatgacctcgaggacaaatcacctaagcaggtgagggtgagaggtcacctgattaaatttgatgaggatacgcttaatactttcttgaagacctctgttattgtggaagagggggaatcactctgtgcttactccagatttgcactcctaaggcctgatcctcaggagttggctgctaagctctgtgtcccagggagaggattcgagcttaatgctgatgggaagcccctgaagattttgtggaagaacataaccaccttagctcaaacatggagtgttctttccttctctaacttgattcccacctcccacacttctgatgtcactcttgacaaggccatacccatttatggcattattatgaagatggatatgaatgcggggtacctcatttcccaccaaatctccctcactactcaggatgatacatctagacttgcattcccgaccttgattacaactttatgtaaggctaggagagttcagtctggctctagatccttggagagtctaagtcttactattaatttggcttacattaagaagaactgttggaatcttgatgatccaatagtcacattcagaggacccaagaaggccagagggaagagatatgaggccctttccacagcaccatga

SEQ ID NO: 37604 - DNA, 93 bp, Glycine max
  Peptide Sequence Number=SeqID_129289
atgatgggagatgcagcaaagtttactcatatttctcccaaaaatagtggacatgtgacctatggagacaacaacaaaggcatagtttattaa

SEQ ID NO: 37605 - DNA, 360 bp, Glycine max
  Peptide Sequence Number=SeqID_129290
atttatatgtccggtattttcgggccagatgtcctggacatcgtatccgacatcgtggatgcttccattcttcatttgacttttatcttgccttccagtattttcgggcaggatgtcctggacattgtatccgacatcgtggatcctgcagcttcaatgcttttagcaattccagcactccctagaactatgccacgacgacatgaacttgctggggggaacgggcgccctgtagggccgacagaggcccgtaaccagagatggaaaccccagggccctgttggacttcttcaggtccactgggtgtctttgtggggggagattggcattgcggtcgctgggcagaatgttgctaagtag

SEQ ID NO: 37606 - DNA, 817 bp, Glycine max
  Peptide Sequence Number=SeqID_129291
tagattgggaccaacacttggctgggataggagacagaacaatcaactggtttcctcgatggaaggaaggaaatgagggagttctcttctcatgtggggactacccaaacatcccgttgataggaacgaggggttgcattaactacaatcccgcacttgctataagacagttagggtaccccatgaggggagcaccgatggaagaaagcctctctcctttccttgtgagagatttcggcccgttaaggaaagataaagaacttaggggcatctgtaatggcatcatcggtggttatcatgaatggctgaaagttcatacacgagggttagattggcttttcaagttaaagattatcgacgaagaggacttcgaagctctggaagaggatgaagaagtccaagctctaaaaaccgaactaggaaaagtaaaacttgccaaagaaaaattcaaattggtcgctacaaacgtccggaaagagtgtgccaagttacgagaagaaaatgcagctaccgcaagagcccttgaacaagaaaccaagagggctcgcaaagaagagcatggccgagacaaattccgtggagctttgtggggcagcaacagtgagctcaagcttcaaagggaagagagagaccaatcacgagtacatagcatggtcttgaaagaggagttagctgcttgctcaaggtccaaaagaaacttgtctcagtgtttatgcgagacagagaccaacatgttagccatcttcagcaagtaccaagaagaactaaatctagccacggcccacaagcataaagtggcggacgagtatgcccaaat

SEQ ID NO: 37607 - DNA, 786 bp, Glycine max
  Peptide Sequence Number=SeqID_129292
atgcaagccttccgcaaggcgtacggaaatattttagatttgaccatagcggagatatccacagaagccgttatatcactcacccaatactatgaccagcctttgagatgcttcacgtttggcgacttccaattagtaccgattgtcgaagaatttgaggagattctaggatgtcctcttgggggaaggaaaccgtatcttttctccgggtttcttccctgcttgagcaagattgtagttgtggtcagggattcggcaagagagttggatcgtgtaaagcaaactcgaaacggcatagtgggcctaccacggaagtacttagaaggcaaggcaagggatatggcgaatcaagaggagtgggtcccgtttatggacgtattagcattgctaatctttggggttgtcctctttccaaacatggatggtttggtagacctagccgcgattgatgctttccttgcatatcaccatagcaaagagagcccggtggtagccgtcttggcgaacttatttgatacatttgaccaaaggtgcgagaagagtagcacacgaatcatctgttgcttgcccgctctttgtgtatggttggtttcgcacctattccaacaagacataaggcatccatgtccactccgaagccatcgctcgtgtgtcaaaaagagaagagtagattgggaccaacacttggctgggataggaggcagaacaatcaactggtttcctcgatggaagaaaggaaaggaggagttctcttctcatgtggggactacccaaacatcccgttaa

SEQ ID NO: 37608 - DNA, 336 bp, Glycine max
  Peptide Sequence Number=SeqID_129293
atggggtccaagtggaccctgagaaaatcaaggccatccaagaatggcccaccccaaaaagtgtgggagatattaggagcttccatgggttaccaagcttctatagaaggctcacttgggccttccaagatgttcctccagaaggcggttgcttctggaggaagcaacctggctcgcctgggcgagttgggtggcaagctcctcccctattttcctataaatatggggaggagtgaaggagaaaggggttcagcccttgtggtacttcgtaatcacttaaaattagtgaggaaaactattttcgtgaagaaaatccaagccgaggcgcttccgtaa

SEQ ID NO: 37609 - DNA, 504 bp, Glycine max
  Peptide Sequence Number=SeqID_129294
atgagacaatactacatgtctacagatgtaaccttctttgaagacacacccttcttctcaccttccgtagactattcttcgtctctccaggaagttcttcctattccttctccttgtcctctagatgtctcagaccaaaatgtcggtgttgttccatcttcctcaccaaattcacctgaagttgtatcttcacctttgattacagatcaacccaggacaacgcagattggatttccagtacctgaagcttctcctcgtgattcttgttcttctttaaccagtcctccactcatggatccttccactttttcttctcattctaactcacattggcctattgccatcaggaaagatgggtccacactattaaagttgggcccaatggtaaggttgatcggcttaaggctcgcttggtggctaagggctacacacagccaaactcaccactgttcgtttgtttcttgctatgggtgtcattcgtcactggcccctttatcagcttga

SEQ ID NO: 37610 - DNA, 111 bp, Glycine max
  Peptide Sequence Number=SeqID_129295
atgagtaatattcaaagtaatttgaaaaaaatacagaggggtttgagaattgtcgagcattcaatgcagtatggcaagattggaggtggagagtcatgtgaatcattgtga

SEQ ID NO: 37611 - DNA, 504 bp, Glycine max
  Peptide Sequence Number=SeqID_129296
atggacccgaagaagtccaacagggcattggggtttccagctctggttacgggcctctgtcagtcctacagggtgcccgttcccccagcgaggtcatgccatcgtgacataggaatcgcaaccacaaagacacccagtggacccggagaagtccaacagggccctgggggatcgtgcctgcaagacacccagtggacccgaagaagtccaacagggtcttggagttgtcaagctctaattacgggtctatgtcagttctacggagtacctgtcacctacagcaagggcatcaggccccctactaatcgagctttcatcaagaagtactgcatccccaggcaggcgcagggcgaaacaccacagcagcctggggatggccagcaacgagcaacagacgcaccgccatcacctctagagttcacctcagctcatccaaaaaaggttaaagcgttgcttacgacccatggccgaccaataggcgaccaagtccaaagccaaaagtaa

SEQ ID NO: 37612 - DNA, 306 bp, Glycine max
  Peptide Sequence Number=SeqID_129297
atgactagaggcaatccatctgacttacaaccctttgatcctgagatagataggacatttcatagattagttaggcatcatattgtaccttttgagcatcctgagcattctgttattggtgagtctgagcattttgtggttggtaattttgaacatcctaattttgagcattacagttttgaacattttgattttgaacattctgagaacatggcacaacctccaccctgtgagaggactctaagggaaatggctgcacctgatttcacctacgaaagcttatgcatccaataccatgatgaggat

SEQ ID NO: 37613 - DNA, 726 bp, Glycine max
  Peptide Sequence Number=SeqID_129298
atgggggatcccatcagcagactctccttccctgaaaacatcgagactttttcaagtctcacaagttatccagaactacgtaggtctgaattcctcattggaggatatgtaggagcaagagcctcgcttttgtcgaccataccgccttttgttgccatgactcaagagctggtagcccgcggagacaccttacggttatccgcacctcgtcattcagtcaccccaagtgtgattgacgagcagagaccaatatggtcatctacgccctttccggagatgtcagcattttccgatggagacttttcaagtctcacaaattatctagaactacgtcatgtgacatgcacccttgtgtcatccagaggcggcgggcccgatgatacgcggagataccttacggttatccgcacccttttgtcatccagaggcggcgggcccgatgatacgcagagataccttacggttatccgcacccttttgtcatccagaggcggcgggcccgatgacaagcccgatgatacgcggagataccttacggttatccgcacccttgtgtcatccagaggcggcgggcccgatgatacgcggagataccttacggttatccgcacccttgtgtcatccagaggcggcgggcccgatgatacgcggagataccttacggttatccgcacccttttgtcatctagaggcggcgggcccgatgacaagcagagacaaaatttg

SEQ ID NO: 37614 - DNA, 744 bp, Glycine max
  Peptide Sequence Number=SeqID_129299
atggcgttatcggtggttatcatgggatggctaagaattcacacgcgaagggttagattggctctccaaattgaaaaggaagatgaagcagtccaagctctaaaattagagctagggaaggcgagacttgccaaggagaagttcaaatcagccgctacccacatccggaaagagtgcaccgagttacaagaggaaaacgcggtcactgcaagagcccttgaacaagaaaccaaaagggcccgcaaggaggaacatggcagaaataaattccgaggagcattgtggggtagcaacaatgacctcaaactccgaagagaggaaagagaccggtcacgggtgcatggcatgatcttaaaagaagagttagctgcgtgcgcaaggtccaagaggagtttggctcaacacttggaagccacggagcaaagcatgctagctatcatagggcaatacaaggaagagttgaaccagtctgtgacccatgaacaaaagctagcagaggattttgcacaagtgtacgccgaaaaagaagcaagagggagggtgattgatgcattgcatcaagaagcgactatgtggatggataggttcgccttgaccttgaatggaagtcaagacctcccgcgtctattagccaaagcaaaagccatggccgaagtgtgtacggctcccgaggagattcatgggctaatcaattattgtcaacacatgatagatttgatggcccatataattagaaaccgttag

SEQ ID NO: 37615 - DNA, 276 bp, Glycine max
  Peptide Sequence Number=SeqID_129300
atgcacgtgttgtatgttggtctcgtcttttgtcacgggaagccggaaggtccatatcaccttcttaactgcatacatggggcactgcgcctccaaatgcacaatattggtgatcagaatttcccttccttggattatagggttaaaccaatctcgtgcttttacgaaaaggttcatcaagtcaagttgaagtatggaagtaaccatcttgcaaaaattggtgcaaaagatggatcatgttacattgttgcttcgtctactgtcaaacacatttag

SEQ ID NO: 37616 - DNA, 162 bp, Glycine max
  Peptide Sequence Number=SeqID_129301
atggaaatttatgcgagtgatcgactaggaaaaagtagttgttatcatcaaaaagggggagattgtagaagcaagcttcatgatgaatcaagattgattcaaggagttttgatgataacaaagatgatgacaaaaagctcaaaagtcaagatcacttcatga

SEQ ID NO: 37617 - DNA, 210 bp, Glycine max
  Peptide Sequence Number=SeqID_129302
atggagcaagttagcataggacaccagaactggggtgaattctacaggctttttgttgcaaaattccttccttggttggtgttttggttcgtgctaaaggtggtgtttagcattggttgtgtggaaggaatggcagtcactgcatgggtttctccctcatcctcaccctcttcatttgccccagttttctcattcgtccaagcaggatga

SEQ ID NO: 37618 - DNA, 138 bp, Glycine max
  Peptide Sequence Number=SeqID_129303
atgggtatatcaggcttaaaggagcactcaaaccaggtaactcctaagggctacactccgaagagtccgtcagggcctctccctcctgattcaggtccaacccctaaaatcattttagcacacagacattgctcgtga

SEQ ID NO: 37619 - DNA, 435 bp, Glycine max
  Peptide Sequence Number=SeqID_129304
atgttacggaaacgttacggaagcgcctcggcttggattttcttcacgaaaataattttcctcagcaatttcgagagaatgagaagtgccaagaaggctgaacccttttcttcttcactcctccccctatttatagcaaaaataggggaggagcttgccacccagctcgcccaggcgagcaagggttgcttccctccagaagcaacaaccttctggaggaaggatctggaaggcccaacttttgaaggagttacagaaactcacggattacgcaaaaacatctcttttcgatttccgccacatcacggaatttcacggattgcgctagcctgcttccttttgatttctaacacgtcttgggacttcatttattgtgcaacaaaggacgccaagtatctcaaagcggctaaccgaaggttgcgtgtcaacaagtaa

SEQ ID NO: 37620 - DNA, 356 bp, Glycine max
  Peptide Sequence Number=SeqID_129305
gagctcgcctgctgaggtacgtcacaggttctcactggctgactattcccgggttgggtcgggattggccaagcttggttttgggcaatgtaaatcatgaagattttgatgatatcaagaagaatttgcttgagaaagagggagatgtaaatcatgcaagctttgatggtgtcgagaagaaatcacatgtttgtcatcatcaaaaagcgggagaatgtgaatctttgtttcaagattcactaaagaccaagccttgccttaaaacaaagtgctttcaagacatgcaaggctctggtaatcgattaccaggaagtgtaatcgattacccgaagacaggattgagaaatagctgttga

SEQ ID NO: 37621 - DNA, 995 bp, Glycine max
  Peptide Sequence Number=SeqID_129306
gcgcgcaaggtctcaaggttatacaaagaatccacaaggcgtggaggagtccgttgaggaaagacaaggagcttaggggcatccgaaacggcgtcattggaggttatcatgggtggctaagaattcacacgcggggcttaggttggctctccaaattgaaagttgtcgatgaggagaaattcgaagctccggaggaagatgaagaactagggaaggcgagactcgccaagaagaagttcaaatcagctgctacacacatccggaaggagtgcaccgagtcacaagaggaaaacgcgaccactgcaagagctcttgaacaagaaaccaaaagggcccacaaggaggaacatggccgagaaaaattccgaggagcattgtggggtagcaacaatgagctcaagctccgaagagaggagagagatcggtcacgggtgcatggcatgatcttaaaagaagagttagttgcttgcgcaaggtccaataggagtttggctcaacacttggaagccacggagcaaagcatgctagccatcatagggcaatacaaggaagaattgaaccagtccatggcccataaacaaaagctagtggaggattttgcacaagtgtatgccgaaaaagaagcaagagggagggtgattgatgcgctgcatcaagaagcgactatgtggatggatagattcgccttgaccttgaatggaagtcaagacctcccgcgtctattagccaaagcaaaagccatggccgaagaacagatgaaggccgatctatcggccttaatagatcaaatggcttccatctcggaggtcatgttaaaactccagaaaactatagaggataaagccacggcaaccgcctccagtacagttagggaagcggagccggtgctgcagcccgtcttaaatccgggccgagacagaaacacagcagtgtttggtcgaaggtatagtccgcaagcttacccctatggcttgcctccggacttcactcctcgt

SEQ ID NO: 37622 - DNA, 390 bp, Glycine max
  Peptide Sequence Number=SeqID_129307
atgacttgcggagacaaatttggtcattccgcacccttttgccattcagacacagtcgtgtccgatggcgcgcagagacaaaatttggtcattctgcaccctttgtcatccagaggcggcgagcccgatgacatgcggagacaaaatatggtcattccgcaccttttcgccatccgaagacgatcgtgtccgatggcacacagagacaaattatggtcattctgcgcccttttgtcatctagaggcggtgagcccgatgacatgcggagacaaattatggtcattccgcacaccttttcgccatacggagacaatcgtatccaatgtcacgcagagacaaattatggtcattttgcgccttttgtcatccagagtcggcgagcccgatga

SEQ ID NO: 37623 - DNA, 1014 bp, Glycine max
  Peptide Sequence Number=SeqID_129308
atgaccaagttcgatccagaaatagtcctcgaattttatgccaatgcttggccaacggaggagggcgtgcgtgacatgaggtcctgggtgaggggtcagtggatcccgtttgatgcagatgctatcggccaactcctgggatatccgttagtgctggaagagggccaggagtgcgagtatggccaggggaggaaccggtctgatgggttcgatgaggaggccatcgcccagttgctatgtataccggggcaagattttgcccggactgctgccgggagacgggtgcggatcatgcacaccaacatgaccaccctgactcagatatggatgactttgctgctcagcaacatcctgcccaccgatcataatttcgacctccccctgccgaagtgtcagctggtgtacgctatcctgacgcggatgagcatccatgtggctcagttaatcgctgatgccatctatatttttgcaggtatggcgcctaccaggcaccctttggatccagataagtccaacagggccctgggatttcccgcgctgatcacaggactctgccagtcgtttggagtccccgttgcacctaccaaggtgattcggccgcccatcacccgggcttttattgagaagtactgcacccagagacaggctcagggggatgctccacaggccgcgggcgcgccaccaccacctcatcaggctggcccggctgggtcatttgacatggagcagtatttacggcatttggttcgccaggaggcagccaaccaccgggcacatgtgcagacccatgattgtctgtaccagatgagcctcagcatgcagagccagggcttcgcttctttttcatgctctactccagaccagttcagggcagaggtcgcatggcccggggattggcccgaggcccaagccggagaggcgcccccagaggctcccggcgatggagaggaggcccacgaggacgaggagatggccgatttgcttgacttcttgggagggagtggagctacatga

SEQ ID NO: 37624 - DNA, 453 bp, Glycine max
  Peptide Sequence Number=SeqID_129309
atgggcggccgagggcgtgcaggccgtggacggctccgccctgcccgccatggccgatgccagcgtgatcgcaccggccggcgcgcgtggcccggccttcatggtgggcgccaacttccgcaccatcctgcgctacaacaactccgtgaattacgcattgggcgtgggcctgctgtcgcagcaactggccggcggcccgggcgtgcaggcggcctggccacgcgatctggcaccgctgtcgcgcgagcagttgcgcgccttgcaggccgcgctcaacgaacggggattttcagccggcacggccgatggcgtgatgggcccggccacgcgcgcgggcctgcgccagttccagcaaagccagggcctggtggccgacggctatcccacgctggagctgctgcagaaactgcagccctgaacgctcacccggcggcgctgcccggctccgggtag

SEQ ID NO: 37625 - DNA, 309 bp, Glycine max
  Peptide Sequence Number=SeqID_129310
atgttggagctttggaaggatattccgacagaaaatttagaaattcgctgctttgatagagaaaaagagccagaatggaatgagtttgagtatcgatttattagtaaaaaaccgtctccgacttttgatgcaaacttttttataggaatggaaaaaatagcggaaaaccgaacaattatacaatatttgccttatgtaacacgttgggactatttagctactatgttcacagaagcaataactgtaaatggaccagaacagttgggaaatattcaagtacctaaaaagagccaagttatatccgagtaa

SEQ ID NO: 37626 - DNA, 219 bp, Glycine max
  Peptide Sequence Number=SeqID_129311
atgcctataggttggacctcccagaagagtggagctgatattcaggaggaagaactaacaaatttgaggtcaaatcttcttcaagggggaggggatgatgcaatcctccctaggaagggaccagtcactagagccatgagcaagaggctccaagaggattgggctagagttattaaagaaggccctagggttctcatgaaccttaaggtagatttctaa

SEQ ID NO: 37627 - DNA, 520 bp, Glycine max
  Peptide Sequence Number=SeqID_129312
atgaaaagagaaaaacatgcctcctatagtagtcataactcttgcaagagcctaagtgaagaacttcgtgactattatgaaggaaggcataggtcacatcttagacctcactcccataggagagaaaatgaaagaaaacctcaagaggttaacattaaactcccatacttccatgggaagcacaatgtagaggcttacttagattgggaaataagggtagagcaaaaacttaaaagaaagtctactttaaaatcttatggctatcattcttatccaaagaaagaccaaggtctaggcatcttaggggcagcaccttctaagcccaatgatgataaggggaagacaatagaaaagcaaccccctaaggctagtatgcaagaaaagactagctccataaagtgctttaaatgtcttgaaagaggacacattatttctcaatgctctaccaagaaaacaatgattatgaggagccaagacatttatagtagccaagatgaggctactacttcaccttcctcta

SEQ ID NO: 37628 - DNA, 591 bp, Glycine max
  Peptide Sequence Number=SeqID_129313
atggggacaaatcaaaacggaaaaagattttatcaagtcaaggttaagggtctagatgtcaccagcctcaaggaattgggacgattgatgggacctctccaaaggcaagccttccgcaaagtgtacggaaagattctagatttgaccgcagtggaggtatttacggaagctgtcatatccctcgcccattattatgatcagccgttgaggtgcttcacgtttggggacttccaaatggtaccgactgttgaagagtttgaggagatattaggatgccctcttggggaaagaaaaccgtacctgttctccgggtttcttccctccttgagtaagattgcagctgtggtcggagattcggcaaaagagttggatcgcatgaagcaaactcgaaacgacgtagtaggcctgccacggaagtacttggaaggcaaggcaagggacatggcaagccaagagaagtggggcccgtttgcggatacactagctttgctgatttttggggttgtcctctttccgaacgtggacagtttggtggacttagccgcaattgatgctttccttgcttttcaccatagcaaggaaagtccagtg

SEQ ID NO: 37629 - DNA, 600 bp, Glycine max
  Peptide Sequence Number=SeqID_129314
atggagcggcgtgcatggtctcccgtggtggagacgaaagggatgaatgcttgtttcacctcggggagtcacacgacatggaaacctgtcccgcagtggaaggattgcttcagcggctcatggactgggggcagcttgaagtgtccaaaggagggaaggaagaaccacaaatttgcatgcggtcggaagagaagaagaaaagggaccggctccacacccatatacccccgggcggcgcccaagccaacgccatttgcgtatcaaagtaatagggtcgttccatggaagtatacccctcccgcgtccagcgaaagagttgcaaccgaagttgactccctatcagctaaggtaacaaacatcaccggcctcagtggcataacccgcagtggtcgggtgttcgcttctcctcactcggcagaattgccctccaaagggaaagcgcccatgggccaagagcccacagacatagccaccccctcgaaagaagtagatcctccagtgggaagaggggccgaaaagaaagaaggtcttcaaggaaaaacagtgaccttggaagaggcccaagaattcctccgcctcatccaacaaagcgagtttaag

SEQ ID NO: 37630 - DNA, 441 bp, Glycine max
  Peptide Sequence Number=SeqID_129315
aaacacagtcaatcaaatgtttattcaactttactcgtcgcttatggcacccccaccaaacgtgtagaacatgcaatttctgattgggtggacttggagatcaactcaggagtgcagcataaacctgaaaatcctaatgagtcattagaaacaactaacaacaaccttcaaattgccccaagcatcatgcatagtatttgttgcaacctacccttcaacgggagggcgacacggggctcatgggtgtgtcttccaagaaaggaaaatgcgcaaagttgccaccaacgtttatttaaggaaaacgttggaaaaaccggaaaaagccgtgctctacgaactttaagtgtgaatggttcaggagttgtatttacgcacggggaagggtgtttcccttgctcctacgtattcctcaattgtgataaggaaatcagacctacgtag

SEQ ID NO: 37631 - DNA, 462 bp, Glycine max
  Peptide Sequence Number=SeqID_129316
atggctatttgttttcacaggctttcgcagcaaggtgcaattacaaaatgtataacgactatcgaggaaatggcaggaatggatgtcctctgcagtgacaaaattagaactctcaccttaaacaagctcagtgttgacaaaaacctgattgaggttttttccaagggtgatgaaaaggactatgttatccttcttgctgcaagggcttctaggactgagaatcaggatgttatagatgttgcaattgttggtatgcttgctgatccaaaggaggcacgagctggtattagggaggtccactttcttccattcaatcttgtggacaagaggactcctctaacttacattgattctgatggaaattggcatcgatctagcaaaggtgctcctgagcagatattgaacctctgcaactacaaagaggatgtaaggaaaagggttcatggaatgattaacaactaa

SEQ ID NO: 37632 - DNA, 393 bp, Glycine max
  Peptide Sequence Number=SeqID_129317
atggcaggagctggtgacgatggtggtgactatcatcaactggatagatctcaacgcttattattagacgcgatgactacacaaatgcaatgtttgctgaatcgtaacaatgaagagctttacagacgaatagaaggattaaagcaccaaatgaaatggcagaacataattgagggagtaaaactcaatgtacctcctttcaaaggtaggagtgatctagatgcctaccttgattgggagatgaaaattcaacatgtattctcctgcaatgattatactaaagagcagaagaggtatgttccaactagctacaatagaaccatgcgacaaaaactccagaggctgtcccagggacgtttgactgtggaggagtactacaggagatggagatga

SEQ ID NO: 37633 - DNA, 690 bp, Glycine max
  Peptide Sequence Number=SeqID_129318
atggaaatcaacgaagaaagctcagccttgtataagaatggcaacattgttgtagagctgccggtattcaagctcgttgtcgttatcatctggcacatcgagtccaagagatcatccagtggcacctcatcgtcatccgcaatcaacaagaaaagttcgggagagcatttgtggtcccttgtgaatttcttgtcgcacttgaagcatagtcccttctcacatcgagtggttatcttctccggcaataatcatttaaaaggaattggaggatgtttggtcggggttggaagcagaggtgaggaggggtggattgtggaagttgtgccagagttaatgcttgtattaacgttaatggttgctttggagccaagccagagacgaagtaactcagcaagaaaggtgttgagtgccagtggggtcctcgtaagtcgacaaagtgggcttccaatgcctaaaggtgtagtgatactggaagaactaggttatcttgaagatccgacccataggatccaagccattgaatcgcaaaacctccagcttcatgcgatgttggcaaatcgtcagttttgtggacatggaattctgggttgcagtgagctggatttgggtggaggttacggatctaagttatttgttgatgatggatgtagtgctgcgaagattgcaaatctaaaggggcagtggttctag

SEQ ID NO: 37634 - DNA, 63 bp, Glycine max
  Peptide Sequence Number=SeqID_129319
atggagaagtttggagagggttgcaaaggacatggagtaggaaagggtagggtgcgcttgtga

SEQ ID NO: 37635 - DNA, 621 bp, Glycine max
  Peptide Sequence Number=SeqID_129320
atgggttttaatcagttagcgtcaagttctagtggcaagacacttgaagcaacatattgtcaattgttacgtccatttcaaatgtattcaatgctttcacatgttttcaaaaaaggcaaaatgattacgtcctttgaatttcgaaatgtcattgggaatgccaaaggtcaagtctctccccagtcgttgattcatggctctaggaaaggatctaatggtctaaatagatgcatccctttgaccaccagaagcttccagaatactataaaagtacgctatcatcaactctcctcctttttcatgtcttttctgagggagggttctgcacgctccagtgatggcaagtttttgtcgtcggaagttcgcctaataggggagagttcaaatgatgaccctactcatctccacaacaactttgacactactagtgaccaagtctccagtgttcatgctggtgatgtctcgctagtggtagcgtggctcaccctaacatgggtattgtcactcatgtgggtggtgccgccactgaggaaaggtttcgcctttaccttggcatgcatcttactcttgtggaggatgatatcgaatcccctcagccaaatcctcctcaaaatttcatag

SEQ ID NO: 37636 - DNA, 285 bp, Glycine max
  Peptide Sequence Number=SeqID_129321
atgactccttacaaagctctgcatggtagaaggtgtaggacacccctgtgcttgctagaaaccgaagagaacctcaccttaggacttgaagtggtacaagaaacgactgagaagaaaaatgacgatctcggagagagaaaaaggaatcgcaccaagacagtacaagtggaggcttcaaatcccttctctgtctctctaacttttgggaactctatcggagaagttagaggaaaaaacttgaggaatctcagggaaccgctagagatgctgctatcgctggcttaa

SEQ ID NO: 37637 - DNA, 552 bp, Glycine max
  Peptide Sequence Number=SeqID_129322
atgtcttgcctagtgatcataattccgaccttcctctgccgaagtgttagttggtgtatgccacccaccaggcaccctctagacccagataagtctaatagggccctggggtttccggtattgatcacaggcctttgccagtcatttggggttcccgtcactcctagtaaggtgatccgaccaccgatcacccgggccttcattgagaagtattacatgcctaggcaggcgcagagtgatgcacctcaggccgcaaacgcaccgccaccacctcatcaggctgatcccgttgggtcattaggcatggagcggtatctacagcacttggttcgccagcaggcggccaaccactgggggcagggacaaggtttcgctccttttgcgtgccctactccagatcagtttagggctgaggtcgcatggcccggagattggcccaaggcccaggcaggggaggcgcctgcaggagctcccggcgatccagaggaggcctgtatggatgaggagatgacgaacttgctcaatttcttgggagaaagcggagccacgtga

SEQ ID NO: 37638 - DNA, 285 bp, Glycine max
  Peptide Sequence Number=SeqID_129323
atggcaacacctaatgccccattaggtcagcaatgggatgtacccggagcaatccctgctatgggtgacttattaggtgttgatttgcgtcacgagttttctgcagaggctgaggaacaagggcggagacagcgcgcaagaagaaatccggatcgtcaagcccgaagggttatggggttatgttatgagttagggttagggttatgggttagggttagggttagagtttatgagtttattttaggacgtagggtttatgagttaggtttaggggttatgggttag

SEQ ID NO: 37639 - DNA, 212 bp, Glycine max
  Peptide Sequence Number=SeqID_129324
gtaatggggcacgcaagatgctaagcaaccatgtcagcttcagtgcggctcccttacgtgcattatttgaagggacttcgcctagtaacatgtcgaatgactcatcccaatgtacgaacctaggtcctatcacagcacgaccatcgaccctaatgcctagatgccgtgcaacatcttcgagtgtgatagtgcacttaccccatggtaggtga

SEQ ID NO: 37640 - DNA, 390 bp, Glycine max
  Peptide Sequence Number=SeqID_129325
atgaacatcacatcactaatgaagatcccattatacgatttcactaagaaaacttggatgattttagtgagcatgaggatcaagagttgtttcatcacaaaaatcgccaaagtgatgatgagggtgttgccataccaacatcaccaacctaggtgtccagtggagttgaaccttgaccctattcaaaatgatgctagttttcctctttggttgtataattttggcaataccatagttgaagatcatgcaagtgctttaggaaacacactcaatctgaagacttcaatgtttgagatgggtaatgaaaatccaacaagagtaggaaatgatggtattaattcgtttgggtcaagttctatagggttccatgcaatggagccaaatatttag

SEQ ID NO: 37641 - DNA, 597 bp, Glycine max
  Peptide Sequence Number=SeqID_129326
atggtttcaactgtgtggaggtggattttgcatgagaatcgtcttgatgaagtaactctcgtatctgatatgcctcgtgacattatatttcaagagaggcatttgattcatactttggtgtcagtgtcccctgaaaatcttgtcactgctactgttcattgtcttgatgttgagaaactgaatcaaatgtatgaaggaaggattctgagtacagctatgaaatacttttggattagtgggctacaagtggatgttgagctgaaatctcccttttcatatatggacctttctcctgaaaaagttatcatttttctcttcaagcttttcagacattccttctcgactactatacatatgctgatcgctgatcaaataattggaatacacaacaagtttcaaaagctggaagaggtatgtcctgccatggaaaaacaaattactaagtggacaaaagttcttctaagtagtgaaaggcttctgggttttagttgttctgctttccgaactagcatgttcaatccaggaacaaattccaaatctggtcgttggtatcctgttggactagcacagatggaacaatggattgctttgctttag

SEQ ID NO: 37642 - DNA, 1732 bp, Glycine max
  Peptide Sequence Number=SeqID_129327
gaaaatggggcctgctccggacacaattgatttggaaggttatgatgatgtgagagcgattctgaaaccgaaaggttctaattctaaggattgtagatcaactgtgaagagtcatggaaaagtggcaagtttaacaataaagaagggtcatatgtcagaggatgaagtggatgaagattacaaattctttttgcttacatatgatcctcatattgatgttgtcagtgatagtgatgtggatggttctgatgatgacatcaacattggccacaacaatgaccataatgatcatccttacagggaagaagaaagcttgcataataatcccaagttagacaagggttcaaaacaaagggatgagacaggaaatcaaagaaacaaagggagtgattctgtgggaaaacagacaagtgggtcaatgaaagctaagcagaatttggaggctaaaagagtacttagtaagaaaaggctacatgaagatgtttctggtgtccccaagaacaatgcccagactaataaggagttagatattgtggacgaagattaccagatattcctgaattcttgtagggatgactatatacctagtgaattaatagaaaagcagaatttggaggctaaaagaggacttagtaagaaaaggccacatgaaaatgtttctggtgtccccaacaacaatgcccagactaatatggagttagatattgtggacgaagattaccagattttcctgaattcttgtagggatgactatatacctagtgaattaatagaaaagcagaatttggaggctaaaagaggacttagtaagaaaaggccacatgaaaatgtttctggtgtccccaacaataatgcccagactaatatggagttaattgttgtggatgaggattaccagatattcctgaattcttgtagggatgactatatacctagtgaatcaataggaaagcagaatttggaggctaaaagaggacttagtaagaaaaggccacatgaaaatgtttctggtgtccccaacaacaatgcccagactaatatggagttaattgttgtggatgaggattaccagatattcctgaattcttgtagggatgactatatacctagtgaattaataggaaagcgatcaaatgttatacagaattcccttgtttctgattatgtgctgagtgaggttgatgaagattacttacaatatctgaattctgttttgattgttgatggtgaggtggggtgtaggcctgagaggaatacctcaaagacagacaacgtggatggtgacagtaattcctctgagccagatgttattcttctagaacctgatcaaattcatgaaaacactccatttgtttcttcgaaaacatatgattcatcttggttcgaaactgaaaagaatcccaaagacaactggcaattacctgcttacggtaattctcagtttaggagaagacttatgaatgatcttcaaaggccttatgaccaagaagaatgtgatagacttctgcttgaaggggtacttttgaacgtgaaaaccatgcgtgcaggacccaaaccgccagaaccagtggcgagtttggtgtccttgagcaaatcgtcagcatcaatggcgatacgtgcatgcagagaccaaatcgccagttggaatggcgacatgcacagatgtttgggaaccgccagtcaaactggcgagttccatggactgagggtgcaggctaggtttcaggcatag

SEQ ID NO: 37643 - DNA, 288 bp, Glycine max
  Peptide Sequence Number=SeqID_129328
atggtgtcacgaggaagtgcagaacagagccaaatgaaaattaccaagagaagatgtgttgaaagttggtggattcggagatcctacgcttcaaggccttcgttgccaccacttccccgatgttgccttctactttgtcgacgagcggtcacagtctcttcctcttcattgcagcttttctactcacagtctcttcctctttgctgcgtgcgtgcgcgtaaaggcatggaacaaacgagtgatgttgtccactgggaaaagggtaaaattggaagaaaaagaacctaa

SEQ ID NO: 37644 - DNA, 237 bp, Glycine max
  Peptide Sequence Number=SeqID_129329
atgaccaaagtattgcaacgtgcccttttgcgggcgagcgaggcgaggctcacgggtgcgctttccaaaggaggaaagatgcgcggagtcgccaccaacgtttatttgtggaaaacgtcggaaaaaccgaaggtcgacaaaagcggggcttttgctcctacgtatcctccatcgaagaggaaatcagacctacgtagttcttccttatgcgtgaatcaagtgattctttttacttga

SEQ ID NO: 37645 - DNA, 477 bp, Glycine max
  Peptide Sequence Number=SeqID_129330
atgacaacaggacctagcttcttacattgggatgagtcatgcgacgagttactaggcaaactccctccagataatgcacataagggagctgcactgaagctgacatggttgcttagcatcttgcgtgcaccattacctaatgaaccaacaatacaccaactacaatgtaggtgtagagcttacataatgtacatgattggtggtgctttaatacctgataaatctggaaatagagttcatctaatagaactatgtgagacatcatcggaggttggtagagttatgggtggttgtgccatactattgcggtcatgggcttggtactacatgccttttattgcatcgagaatcttacggcccaaaacaacttattcacttgctaaaagatggagtagtggtagattaaagcatagggacacacctcatggtgacttgatcgggtatggatctcgtatagatcatatggagaatcattag

SEQ ID NO: 37646 - DNA, 363 bp, Glycine max
  Peptide Sequence Number=SeqID_129331
atggatgattttagtgcgcatgaggatcaagagttgtttcatcacaacaatcgccaaagcgatgacgagggtgctgccgcaccaacgtcacctccgttgcaatatcaccaacctaggtgtccagtggagttgaaccttgaccttattaaaaatgatgctagttttcctctttggttgtataattttggcaatacactagttgaagatcatgcaagtgctttaggaaatacactcaatctgaaaacttcagtgtttgagatgggtaatgaaaatccaacaagagcaggaaatgctggtattaattcatttgggtcaagttctatagggttccatgcaatggagccaaatattcagcatttttga

SEQ ID NO: 37647 - DNA, 1122 bp, Glycine max
  Peptide Sequence Number=SeqID_129332
atggagaaagcagcttgctttccttcccttagccttggtgctatgttatcttctcactcatgttgcatgtgtcgtttggtttccccctctcttctagctttattgacttttgggattctcaaattacgaatgtgtgctcagcgagcatgtctcgctgagcgagagttagtgactgagcgcttagcggatgcaaatgtgctaagcgcgagaagcgacaaaggcctcactgggcaggctggctgcatgcttagcgtgctgctctctgaatttacattctctagggttcttctctcgctgggttctaaaacaaccttgtctgatctccacaagttcatgttatttcacttgatggagaaactcccatttgaccttccacatgccacatacattagtatattgaggaacctgaagggcttaggtggtttgaacaacatctactatgcaactcttatcaacaaacttctatgggatcaagaatttagcaagacaaatctgaaagctatgaaggttgatttagagcatagtttgaaagaggctcatttagtggacctagacgctattaataaaaggaaacaaaagagcctagtcaacgccatttttgataaagaccaagggttgaacaactttgggctaagaaagtccaaccagtctcaaaacctcgggcatctgtcatcctttctgttattccaagacgtatcaagacatgactatgagcatactccatctaaggcctttaaggctttatcattagacgtcatctctttcacaatggactcgtccagtgcagcccaactttgtcaagatgtcttcccactggctcgcacttggaactcagcaacgagttctaccatctacggagatcaagccattgcctaccctcctggtctgtacatctcgagggccactgatatcaagatggttgctgataaagtgagtctatgtctaccaatttgggatgttgcaaagaaaaatggatttaagctttactacattgaagatatgcccacaaggaatatgaaggctgaatggaagggatttgattcaaagtctgaatgtgtttggatggagaatgatgatgataacgaaggtgttcaagtgggattaaaggctggtttagaatga

SEQ ID NO: 37648 - DNA, 399 bp, Glycine max
  Peptide Sequence Number=SeqID_129333
atggccattgagggctttacaattgggggtgaaagaaagaatgggggtaataaaaacaagaatatagagagaaaagggagagctcaggcttggaatgataagagaattgctctgaggaaagatcgtgcgcttagcgcgcgctgcaggcttagcatgtgtttctgttggatcacgcgcttagcgtgtggctcgcgcttagcgcgcgtaacagattctgcatcttcgagcttaacgcctcgcttagcgcctatgctgctttactcgcttagcgcgtggcgcgcgcttagtgcgcgtgttgggctgggcctacttcaaacctcttctttttcttcacttcctgttgcctttttgcttaatgtaacttcaattttcgtatctacaaccaaaaattcaatttaa

SEQ ID NO: 37649 - DNA, 342 bp, Glycine max
  Peptide Sequence Number=SeqID_129334
atggggcacaaagattcttgttggatgctctcaatgctcaaatgtgtggaagcaatgccttccaaggctattttgatgatgccaaagaatcaagagtcaagcaaattccaaagattcaagaatgaagttttcaagaatcaaggtacatctacttgggttgttgtaactgagaacaagagatggtacatctcttgtggatcagttcaagtggagggtacatccacttggttgttcaaagagaacaagggagggtacatcccttgtggatctttgcttgtaaaggattttacaaggttgaaaagaaatctcaaggaccgcaggtcgcttgggtactggatgtag

SEQ ID NO: 37650 - DNA, 123 bp, Glycine max
  Peptide Sequence Number=SeqID_129335
atgaatgagaatggctatccagtcctagaaagccaagaagaattggctacgtggacagcagcaaagcaaaaggagtacaagcaaaacaagcaaaatgatgctaaggctctgctattcatttaa

SEQ ID NO: 37651 - DNA, 1022 bp, Glycine max
  Peptide Sequence Number=SeqID_129336
atgcgtgcagctgcggtggcatgggaagcagggaagccactgtcaatagaaaccatagaagtggcaccaccccagaaaggtgaagtgcgtttgaggatcctcttcaactccctttgccgtagtgatgtttattggtgggatgctaagggtgtgacacatctgaaaccaggtgaccatgcactcccaatattcactggggagtgtggtgaatgcacttattgtaagtctgaagagagcaacctgtgtgagctactcaggatcaacactgacaggggtgttatgctgagtgatggaaaaacaaggttctccaaaaatggccaacccatttaccacttcgttggaacctccactttcagtgaatacactgttctccatgaaggatgtgtagccaagattaaccctaatgccccacttgacaaagttgctattgtcagctgtggattctgcacaggttttggggctactgtgaatgttgcaaaaccaaagcctaataatactgttgctgtctttggcttaggagctgttggtcttgctgcctgtgaaggggcaagggtttctggtgcatctagaatcatcggggttgatttacttcccaatcgatttgaacaagccaaaaaatttggggtcactgattttgtaaacccgaaagatcacaacaaaccagtccaagaggtcattgctgaaatgactaatggaggagtagatcgtgctattgaatgcactggaagcatccaagcttcaatctcagcatttgaatgcactcatgatggttggggtactgctgtccttgttggtgtgccaaagaaggatgttgaattcaaaactaatcctatgaagttcatggaagggagaactcttaagggtaccttctatggtcactacagaccccgcactgacattcctggtgttgtggagaagtacctcaacaaggagttggaactagacaaatttatcactcactctgtgccattctcaaagatcaacactgcatttgatcttatgctgaaaggggagggcataag

SEQ ID NO: 37652 - DNA, 105 bp, Glycine max
  Peptide Sequence Number=SeqID_129337
atggctgttgaaagtgatgaagactcagtaaagttagaagaggtggaagccaaaaatttaggaaatatggagatcatggaacaaaccgttaggatcatggattaa

SEQ ID NO: 37653 - DNA, 777 bp, Glycine max
  Peptide Sequence Number=SeqID_129338
atgaccacttttactggtgacacgcaaaccgccagtggaactggcgagtttggtgttttagaaggaactgccaacactattggcgatatcggtatccatgggaaccgccagtcaaactgctttttcagagaaagggaagttgcaactgccattggcgagttaagggcaagttgcaactcccactggcgagttagggcagaaggaatagtcattccagatggcgatttaggacctttatatacgcgaaaattgtttcagtgttattgtgtgttcacaaataaggttgatgttcatgatttgttggtacacgatgaattcggttataacagtgttgtatttcaatggacgggtagtaaaaaagtgattcagattaaacatggaattagtttcaatgctttgaagaaaaaaaattggagacaaggaaaatatattgccttgcaaatttgtgatgacgaagacgttgaaacgatgctggaaagttttaaacaacaacaagaaatgtcagttctagaattgtacatagaaaaggatgtgactggtggttcaatgtttcattatgcaaattcgcttacatcatgtgaaaattatttatctaatgatgagacacaaccgccaacaaatatgagcaatttacatcttgacgaagatgatgatgatgattatcttgtgtctaactcatacgttgaagagtctttagacgaagatgacaatgttgacggtatatctgatacagacaatgaagtcaccgagtttaaatacatacagaaatttaaataa

SEQ ID NO: 37654 - DNA, 243 bp, Glycine max
  Peptide Sequence Number=SeqID_129339
atggctacgactaaaccgctcatcacaattaaagaaaagttccttctctctgcgtacgactatttcttcagggtggaggtgggtgtatcggtggggttggtgaaatattcgattgagggggacaaggccacgatgtattcaggccgttatgtgacatccaatgataccatgcgagcgcagagagacgaaagaagtggggagtgtgtggaagatgagatcagagaatgtgaatggactccataa

SEQ ID NO: 37655 - DNA, 90 bp, Glycine max
  Peptide Sequence Number=SeqID_129340
atggaggagaaggtcactagcacatgggaagcttccttgagaagcaaggaaggtagcttccttgggaagctaggaagaaagcttccttaa

SEQ ID NO: 37656 - DNA, 2538 bp, Glycine max
  Peptide Sequence Number=SeqID_129341
tccaatgatccatcacagttgtcttggatgggtccagttccaggtgatattgctgaagttgaggcattttgtaggatctttaggaattcagaaaggcttcattctgcattaatggatgcattatgtaacccattgactggtgaatgtagtgtctcatatgaggttccatccgatgagaaacctcaactagaagataaaatagtttctgtccttggatgcatgatatcccttgtgaacaaaggcagggaggatattctttctggaagatcctcaattataaattcctttcgtgctgcagaggttagcacaacagacgataagctccccccacttgctctttttaggagtgagatgaaaaggtgttctgagagcttacatgttgctcttgagaactatttaatacctgatgatgatcgaagcttaaacgtgtggagaaaacttcaaagactgaagaatgtctgctatgattctggttttcctcgtggggagggatgtccttgtcacacactatttgcaaattggaatcctgtatatttatctgctgcttctaaagatgactcggaatccaaagacacagagccggccttttggactggaggtcaggtaacagaagaaggcctaaagtggttactggataaaggatataaaaccattatagatctcagagcagagactgtaaaagataacttctgtcaagcggctctgcaagatgctatttcatctggaagaattgaattggtaaaaatcccagttgaagttaggactgcacctacaatggaacaggttgtgcagttcgcatcttttgtttcagattgcagcaaaaggcctatttatcttcacagcaaggaaggagttttgagaacatctgccatggtctcccgatggaggcagtacatggctcgatcttcatcacagattgtttctaatccaccagttacaccctatgacatgttattatgtaatacaaatggttctgcaaaatcttgggactcttcaatgactgcagagagatcctccctggaaaaggatatcaattcattgcaagagagtttgaactcaactcataattctgttggaacatttgacaggagtacctctcaaaagaagtataatggtaaaccacaaggtactacagccatgagtaaagtttctactgataacagggaattatcagaagccactgctgctaaggaagaacgatcttttccacgtaacttcagcaaaattaaccctttaaaagctcaagttcctccttgtgatatcttttccaaaagagagatgtcaaaatttttgggaagccagaagatctcaccaccctcttatgtcaattatcagagtagaaggtcagaatgctctccgcaaccaaggaacatgaatgtcacaagactacagggaggtgtgactgtcagcactagtgataatctcatacctaaaattgtaggttcagaaagttcaaatggatcagcccgtgttgatcatccatctagagagacccagattacagttagcgacaattgggaggtagtgaatgggagtatttctagttctgtttggacaacagtaaatggatttagtgaacaggaaatgcattacatgactaatgccaatgcttccaacattgtgaaggacgattttgataatgtcacaactaactctcaaaggattgaagatcgtatggttaaggataggttagccttaaatgacgacgacatgggatccgttgaaggagatatgtgtgcttcttcaacaggagttgtaagagtgcaatcgagaaagaaagctgagatgttcctagttcgaacagatggattttcttgtaccagagaaaaagtgactgaatcttctttggcattcactcatcctagcacccagcagcagatgcttatgtggaagtctatgccaaagaatgtgttattgctgaaaaagctgggggaagaactaatggaagaagcaaaaatggttgcttcttttctttatcaccaagagaaaatgaatgttcttgtggaacctgatgtgcatgacatatttgctagaattccaggctttggatttgttcagaccttctatagtcaagataccagtgatctacacgagaaagtagattttgtggcctgcttgggtggagatggcgttatactgcatgcatcaaatctattcagaggtgctgttccccctattgtgtcatttaaccttggctcccttggttttctgacttctcatgattttgaagattacaagcaagacttacgacaagtcatccgtggaaataatacacgagatggtgtgtatattactcttagaatgcgtctccgatgtgaaatttttcgtaaaggtaaagcaatgccagggaaagtatttgacatcctcaatgaggtggttgttgatcggggttctaatccatacctttcaaagattgaatgctatgaacatgatcgacttataaccaaagtacaaggtgatggagtcattgtggccacccctacaggaagtactgcctattctacagctgctggaggttccatggtaagcttgtgttag

SEQ ID NO: 37657 - DNA, 228 bp, Glycine max
  Peptide Sequence Number=SeqID_129342
atggatggatgtgagaggattgatgagaggtcacggggtatattttaccacggccccaccatgggagccaaatgttcttaccaaaatttggaactgtggcacgtcagggtggacgtggttgagtggggtcctgaacttcatatgtcggcttggagaggtgccattgacaggaggggggacctacaaaacagaggactccaatgctcaaggattgttgtagccttgtag

SEQ ID NO: 37658 - DNA, 534 bp, Glycine max
  Peptide Sequence Number=SeqID_129343
atggttagaacaagaggtttacctcgtgccttaggtagtggtacaggcagaggcatgggtcaggatgagcatgatgatgatgttcccaggcatcgtaggcctaccgcttctgcccgtaggcaacgggttcaggttgatgtcgctgaggaagttcctcaggtgactaaggatgttcctcctcaggtgactgaggatgttcctgatgtgattgcagatgttcctcatgtggacgaggacattccaactgcagatgtagatgttgcggacgtagttgctgatggtgctgagggatcacctgctgagcatggcaagggattccctggtgggccacatgacacatcattgctgacatcatttgttgaccatgaacgacatgagttgaaggtggtctcccacggtaggaaagtagataaatttgggagttcagcgcctgagattgaaggcctagttgccggcaccagattaagttcattgattgggtgttctatggtcaccggcgatcctgaacttatatatgcatttgtggagaggtga

SEQ ID NO: 37659 - DNA, 882 bp, Glycine max
  Peptide Sequence Number=SeqID_129344
atgggcccgaaatctaccctaaggctcataagaaccctagggccttctcttgcatatctggcccaatctacttggagttttctatccaatgcccttgcggggaatgatgtgattctcaatgattatattaataatggtaatacaactttcaaggttaaggagaaaatgacactgattgcggtgaagaaaccatttgatttagctgttggcaacacttcaaaagatcattcacatgaccattgggggaatgttgtactaaagcatttatatcattcattaggcaatgacaatggtggcatgaagtggtgtataagggaagcactcatgagctgtcctaaaattagttgtgcccctacaatgaaggaaactcttaaaattgtcaaagatggtcaggagtgctctccgcaattagaaagtttgttttatagattacagagtgaagctaatggacatgaaaatgttgtgcacaacggattttctagtgagtcaaatggccgtgatacaactgaggggtgccagcgtgtgttccgcgatatcttagcctctgaaaagttcagttcattatgtaaagtgctacttgaaaatttccaaggaacgaaacctgaaactgtatttgactttagtttgataaactcaaggatgaaggggcaagcttatgaacaatcgcctacacttttcctatctgatgttcaacagggtataagtagtgagcagttcattgataaagaactcgaaatactggttgggtcaatgtttgagtgccaagttccaccatttccatccaacaaggtgcctaaaggcaactctgaagagaggaatgctatacagagaaatggatgcctgatggtggaaatgtacagggatgcgaattgggaagactag

SEQ ID NO: 37660 - DNA, 379 bp, Glycine max
  Peptide Sequence Number=SeqID_129345
tggtaaaggaaaaggtgattaccttaccagcactgctgatcctccttccaagtctaatccaaatccaactaggaactggaaattggttgatcaacatcatgaacttgaaaataggtcaaaactttatgttctattcaactgcaaaggaaatcttgggcagcatcaaggaaacctactcaacctggtgaatacttctgaatttttcaagataaaagcatccttacatcctccagcaagaataaagcagaagagaagtcatgatggaatgggaaatcaaggacctctttctgaaggcgaagattctgctcttcatgtaaaccagaatcagggaaatgatggtagaccatggaaagggagaccatcatgtgaccttttctag

SEQ ID NO: 37661 - DNA, 363 bp, Glycine max
  Peptide Sequence Number=SeqID_129346
atggctagaacacgaagtttaggtcgtgccatagatagacttgtgggcagagatagacatgatgaccatgatgtagctgatgttcccgagaggcataggcctactgcctcagcctgtaggctacgggttcatcagatgactgcggagggacgtgatatggctgaggacgttgctgacatgactgacgatgtccctaagctggctgcggaggcacctgagatgcgtgcggacgtagagggtgctgatggtgctgaggggtcagatgctgatgatgctgctgagggattccctgataggccacgtgacccatcagtgctgacatcatttgtcgagcatgttgcacatgctgtttggagtggacag

SEQ ID NO: 37662 - DNA, 1368 bp, Glycine max
  Peptide Sequence Number=SeqID_129347
atggcaagcaaaggcggctcgtggcggtcaccgatggtgaaggaggagcttggggtgttgggggaaggtatagggttttcaattgctattcattccatgggctcatgggttatgaacccaacattgaaatggggagggaaagaggagaatgtctatcatgacttggatatgggcacatggtcattccttgaagttgttgacctgatacatgatcttgagtattttgttattgatgggcttaaaatgtggtggaaagggtttgatgttaataatgaaaccttaagggatttgtccaatgatcaagactctatggatttggcaaggtatgctttgagtcataagtgtgaaattgatatttatgtggtgtttagggagagtgattatgaagaagttactgaggatgaagttaggggtgaacttactgagggtgaagagttgttcaaagaccaacaaattttagtgtttgaccatggtgtagatgatttgtttgattgggatagtgttatggcatttgatgacaacgatgagccatccaggaagcaaaatgagcttagagtgaaaagcaaagtcagcaacaaaggaaaacaaaaggattctggatatgaagatccttttgttgaaaatcctagtcagtgtgatgaagacccaaattggatggatgacgatagtatgactaacccaccacatgaggaacctaatacaaattttaaagagatgcatgatttggagactggtaatgaaactgaggagttgtatagtgatgttgaatctaaggatgacactacaaagcctggaaaaaggtttccaatgtttagggggaaaaaactgtctaaggctttcaagtggacactaggaatgcaattcacatgtttgcaagattttaaggaaggaatgatggagtattttgtcttgaatggttatcagactgagaacaaagagagttggaaatggttcttaaatgagttgttggctggcattggagattttgaaacgcacaaatgggttttcatttctgacaggaaaaagggacttgtaaaggcattccatgagacggatgatagaattgaacacagattatgtgcatatgaagagaaaatgaatcagatcaaagagatcaacaacaaggtttatgactggttgacagatgaatttcccaaaaatgcatggtgtaagcatgcatttactacttactccaagtgtgatgttgcgcaagttattggatctaaaattccagcaacaggaaatactgttgaagctagtggatttgaggcacaagctgttggatctaaaattccaacagtaggaaacacttttgaagatggtggatttgaggcacaagttactggatctgaaattccaacagcatga

SEQ ID NO: 37663 - DNA, 216 bp, Glycine max
  Peptide Sequence Number=SeqID_129348
atggggggtgcagtgaccttgttggatatccctgttacctatgcacgacagggtgacctcgacacttactgcgtagttttcctaagtgagagtgtcgtgtggatacaattaggctatttccttggggatggtaccacattgcatttgagagttgagaatgatagcagtaaagtacaagaagtgagattcttttatggagccgccgagccaacgtga

SEQ ID NO: 37664 - DNA, 621 bp, Glycine max
  Peptide Sequence Number=SeqID_129349
atgtcgcgggggtcaggagaccttggggacgtcaggtggggtgctattgcccaaaaccaagcttggccaatcccaacccaacctgggcatagtcagccagtgagaacctgtgacgtacctcagcaggcgagcttctggcagtcaaccaataaaggaacaaaagtccacgaagcagggaggcttatcgtgatggcagcgcagttgatccatgatcgcgtcgtgatggtgtgcctagagggtgtttgggagaccctcaaaggcgatgagaggtgccgattccgtggcacagttcgactcactgctacttcgctagtacatccgaagcaacccgcacgcacacttcaacagcttatggagtggatactacctacgcctgtggagtggatactagttgagcctgttcaattgatagaggtgtcatcctctgaagaggatcttgaagaggacccagaggagttatctcctgaacctgctatggatgcccctgacttaccagaggatgatgaggaccagctccctgatgtagattctccagaggatattatgccagcatcagaggcagactctacagaggagagtggccctggagggacagcaaatagtgacgactcttcatcatag

SEQ ID NO: 37665 - DNA, 231 bp, Glycine max
  Peptide Sequence Number=SeqID_129350
atgaaatatcctaagcgtgtccacatgacactctcacttaggaaaacaaggcagcaagtgtcgagctcatcctgtcgtgcacaggcaactcccccccatggtgatcaacctgagtctcaaggaagtttcaaaccgagagacaagtctccaagtacaagtatttttcctcatgaaaaactacgagtacttactgacaaagtttgtactatttctatgcaatatgaagtatga

SEQ ID NO: 37666 - DNA, 273 bp, Glycine max
  Peptide Sequence Number=SeqID_129351
atgtacatcaagtatggcccaaaatacatcgtgaagtatagccaacaaaacatgttatccaatgaaacaaaaccccccacttattcccaaaacaattccaaagctccagaattccttaaggttaaggaagcatcaacaagaatcaagccaaggctattgtgcaagcaatcaatggggcaaaacacaccaaatgattatgatgatggctcaaattctcacaaaggtaaacttatcactttcaaattgagctttcaaaactatcatgacatgtag

SEQ ID NO: 37667 - DNA, 390 bp, Glycine max
  Peptide Sequence Number=SeqID_129352
atggactgccccctgtggatgctctggagcatgaagtgcaacatttgtggagtaaaaataaagtctgctgaacctgtagaaagaggagctggaagtggaatctgtgttgatggaggtactgtagaagaagaaggtgatggtgcctctgatggtgctgaagtggaaggggcctcagatctcttacccctggccttcctaggtcctctgaaagttactgttggatcatcaagattccaacaattcttcttaatatatgccaaattaatggctggactcaggctttccagggacctcgaatctgactacactcccctagccttacataaagttgtgatcaaggcatggaatccaagtctagatgtgtcatgttgtgctatgagggagatctag

SEQ ID NO: 37668 - DNA, 294 bp, Glycine max
  Peptide Sequence Number=SeqID_129353
atgaaggatgatgtcctacttgatgaggaagacattgctgtggaggaggttgttgctgaagggcagcgtgctacggagaaaggcgatgatgcctgttgtcataccctaatttcgtccggggacctttgcttgatggcatgcgacctttgtttggtccttgtaaggcccacttgggccctccagaagattcctccagaaggctgttgcttctggaggaagcaacctggctcgcctgggcgagctgagctcgcctgggcgagctgggcggcaagcatctcccctattttgctataa

SEQ ID NO: 37669 - DNA, 906 bp, Glycine max
  Peptide Sequence Number=SeqID_129354
atgaccctttcatcatggcagaacaagctaaacaggaaaatggttacaccacccaactctcctcctcctcctactggtgcagcatcacagtcacgatctaccttgaagcaaacaagaaaagccatatggctaagatcattggcgactagaccagttggggcagagagaccgctagtccatgtcgatactatgactgggaaagctgacagtccccacagaaagaagttaagaacatatttggggatcatcgctcgtgataaggctgaatttgatatccctgaagcattagatccgaggacaaaaaagaaaatacttcagactatgggggagcggtggagacaatttaagtctgatttgacatcaaaatgggcacttgcagccgacaaggaaagtgtcgaagacactgtatgcgaaaagtacgacattagcaagaagaagtgggccccaattttgtcagacctgcagagaccacccttcgtgggagatgtgcgaaagaagacacatgtcatccagaaacaaaacacagcccctcacgaagctgctcaattcggaagcactgacaccgcgattgatccttcatctctcatcagacgacacatgaagtggaagatggcctgcaccaagaaaactgggcaaatgatgtttgaggtagcaaaggaaattgttgagaagattgcctcacggggttcctttgtcgcccatggacgtcaggatgtactgactgctgccattaggcaaccagaacaccctggtcatgtgcgttctgctagagctagtgtcatgatcaagaaatactttggaccgactccaaggacctcccacacatcttcctccatggctcctgaagacctggagcagctgatgcaaaaaattagggaccagctggaggagtcaatcacagaaaaa

SEQ ID NO: 37670 - DNA, 456 bp, Glycine max
  Peptide Sequence Number=SeqID_129355
atgaagatgaatacaaaggttaaggttaatgcgacagtgattccagctccgaggaaatcggtgaagagaatgatgttggagaccatggtcggttttctcgcacgtttgtgcttcacttccaattccaagtaccagttatatgacgccaatgacagtgacctaaaatcaccttcgaagaaacccaattctgcatccacccccagtcccaccgcgtgcggcgtcaaagaggatttctttgagcttaccaacgacaaagaagaagaagatgtaattgccgagcattggtacgaagacgagcatggtgccagacccgtcttagaatggggactgttctacatcggttgtgtagctataaccgataatgggtgtggtttctacatcggtcttcattcaaccgatgtagaatgggtaggaatgggtgcggtttctacatcggttatcagtcaaccgatgtag

SEQ ID NO: 37671 - DNA, 375 bp, Glycine max
  Peptide Sequence Number=SeqID_129356
atgttcgatgtgagcctcagtgtctcaacatggttgcaggatgtagtgcacgatgaaaagagtttgtatctggcacaattggtttctgagggaagacaaagtgaggctggagaactttattcaaagaagcttgccaagtttgttggaaagtgtctcaaatcagaacgggttacttctatatggactagtacactggaacgaacaattctgactgccactccaattattggatttcccaagatacaatggcgtgcacttgatgagataaacacaggggtgtgtgatgctatggcatatgcagaaatcaagaaaaacatgccagaggagtatgagtatgtttgcagacttgtaatttctctcttatttgcaagttga

SEQ ID NO: 37672 - DNA, 496 bp, Glycine max
  Peptide Sequence Number=SeqID_129357
atgaagggttttagaattagggctttttcaatttttcctcttctgaatccaccgccactgcaacgtggacagaattggagtgcagccatagcagcagcaatagaagtcctggggataggggtttattttattgctgctggttggaacatgattggtggactttctaagggtccaggcaccattgttgatgactggaagtttgactattctagtcatgatgctcgccgtatggtatgtaatgaccaagctgatatgaccgtctctaaggaggacttgattttgatgtgggctttccttaccggtcgtcagaacgactgggctcactttcttaggtatcgaatgaataaggcattaggggccaatgcacctcttccgtatcctcaattggtcaccctttttctcagtcattttcaaattcctcttgatgatgaaccttttgttcaagtcaagcgatcttttgccattggtgctggtgcagtaacttcatttggttacc

SEQ ID NO: 37673 - DNA, 237 bp, Glycine max
  Peptide Sequence Number=SeqID_129358
atgccactagcacaaagcgagggcaagagctatgggatcgaagatccaaccgtgcttgtcctttgtgaccttggaagcatcaaacctgacaaggttggccctgatgtctgtgtgggaggagtgagggggcacgtaggagtaggaccgcgctggaggccgagtgagatccacgcgaggaagaggaagaaggcggggacgaagggtatggagtggctaccgcttcgtcgtggactttag

SEQ ID NO: 37674 - DNA, 780 bp, Glycine max
  Peptide Sequence Number=SeqID_129359
gatctcctgactgctgccattgggcaaccaaaacaccctggtcgtgtgcctgcagctggagccaatgtcaccatcaagcaatacttcggattagctccacgaaactcccacagttcctccttcatgcctcccgaagaacttgagcagctgactcaacaaatcagggaccagctagaggagttgatcacagaaaaaggatttgcaatgcctccggagcctgaggttggtccctcagctacccatgttagcacaaaggggagttgtgttgatccctcaccaactgatccagagatgggtgactcagtcaaatacgggttgtacatcgaagacaatccttccctcctggttaaagatgcagaggctcccgttcctgtacccactgacgaggttatttttgtggggcaagcacttaacaccttccatgcttggccgacacatctcgtgaagcgtccatcagaacaagcagctgtgtctcagcaaaacctccagatatgtgggatactaccgtgttcggggccagacaactatcttaaaggaataattaacagtgttttgaaaggacttgatgatactccacaacctaaatccaaggatggtgctaggtggattattgttaagtgttatagacaaaaaggaaccactgagtgcggctattacatcatgcactggatgtccacgataatcttaggaactttcaagaataattgggaaacgaccattggaagcagagagattgaaggtgcttcgcatccaacgggcatagtattatctcaaagttag

SEQ ID NO: 37675 - DNA, 420 bp, Glycine max
  Peptide Sequence Number=SeqID_129360
atggagcctaagtttgctaagcaagccttcactaacccttcacctccttgttcattacccttcatttggcagttgttgttccaagagcagagatgttacaccatcaaaaggatacccaatattggaaggcatagtgcagtgagtgatttagaatatctgacaagcagctgcatacctcaaaataaaacaatggcactcagcaaacaagaaaatggtgcacctaacaatcattgtaggcttgcagcaacagtgcaaacaaacaccatcaaaccaacagggataaatgttaaagcaacatcaaggtttgcccacgtacctaaatcgcgccagtcaggaatgggaacttatggagcctgtgcgaacccgaacacgaacctcaatggcagcttgagtgaggaagacacagtatctgagggatga

SEQ ID NO: 37676 - DNA, 330 bp, Glycine max
  Peptide Sequence Number=SeqID_129361
atgaggtcctttaatggtgattttccaccatggatacgcagtggaagacaaaggagaagaggtgagaagaggcgccatccactagggaataagccatggaagaaagagcttcaccaccaagaatgtgccttggataagaagcttgaagtggatgctttaatggaggaaaagaaagacagaaggggggagcatgaaattgaaggaataaaagagggagagaagttgaaatttgagttgtgtctcacaagactctcattcatcaaatttataataagtgttacacatgcttctatttatagactaggtagcttccttgagaagctttcttga

SEQ ID NO: 37677 - DNA, 951 bp, Glycine max
  Peptide Sequence Number=SeqID_129362
atggcagaatcgtcaaagaaacgaaagggttcttccgcctccgcttcggcttcaagtgctcatcgttccggagccactagcgcatccacagcaccaattccatcctcattgtcctcttccccattgttttcttccgacgaacagcagaaacggtactccaatcttttctcatctcgttccattatcgaccctaagtttattgatatggaattcttttctgatgaaacctttgattgcattcaagcctttcagaacttaggtacactgaattacgattggaaatttgatttctcttcacatgatgcccgccagttggtttgcaccaacaatgcggatatgaccggacgccttcttgccgggtcattggcttttgaaagccgcatccttcactatttaattgtgcgtattctgcttccacggtcttccaaccttgcccaggtttctgaggaagatctaattatcatgtgggcctttcatacagggcgtcaacttgactgggcacacttagtcagatatcgtatgcataaggcattgcgattaaatgctccactaccatatccacagcttgttactctctttcttcgtcattttggaatacctcttgattctgaatcttatattccaatcaagagatcttttttaattggtgctgctgtgattgcttcttttggttaccgcaaagagcatgatggctcttgggtcaaaaagggcgctcaacccgctgatgacgaaggcagcctaccagttgaagataatttcactcttcttcgaaggcttatggacaagtttgatggacttcagacttttgttggtgacaagtttgatgccatggaattgcaagtcgacatgcggttcgatgccatggaatcaaggatcaccaaagttgaagaagatgtctccttcatccgtacttgctttgatccacgaccaccgcctccatcatcgtcttag

SEQ ID NO: 37678 - DNA, 285 bp, Glycine max
  Peptide Sequence Number=SeqID_129363
atggcattaggaaaagtgtatgacagtttgtccaccatacacaatgtcccttatgcagaagatgtggttagggtgagtgttgtgaaagtttaccacagtgacgctcaacttccttttctgacatcagagattcagtttgtgaggcaagtcgttggcacattcgttgggtggtcgacacatcttatgaaacctgtatctaatgaggattcacaaaaacgtctgccaaaacgggttacatctgctgaaatggacaatgcaatggctgtagttgatccattaaaataa

SEQ ID NO: 37679 - DNA, 58 bp, Glycine max
  Peptide Sequence Number=SeqID_129364
atgtcaacatcttccggtagagactattttagtctcacatcgctaaagaactacatag

SEQ ID NO: 37680 - DNA, 166 bp, Glycine max
  Peptide Sequence Number=SeqID_129365
atggagcttgcatcagtacatctacttgggttgttaactgagaataagagagggtacatctcttgtggatcagttctagtggagggtacatccactaggttgttcaaagagaacaagggagggtacatcccttgtggatctttgcttgtaaaaggatttttacaag

SEQ ID NO: 37681 - DNA, 231 bp, Glycine max
  Peptide Sequence Number=SeqID_129366
atggcaagaggtcttcgtacatcatcgggatcggggcgaattcatgagttggccttgggggaaagttccttgccgcgtttggaaccgatgccaaggtgggcattgccggccaggcgagtcgaggttggagctggagcttggggggcctccctctggacgagcacgggcgcccttggttgtacgggcgctaagttggaggagtcctcggtgcgagctaagaagctcgagtga

SEQ ID NO: 37682 - DNA, 480 bp, Glycine max
  Peptide Sequence Number=SeqID_129367
atggcgccgaccaggcaccctttggacccagataagtccaacaaggccctgggatttcccgcactgatcacaggactctgccagtcgttcggagtccccgttgcacctaccaaggtgattcggctgcccatcacccggacttttattgagaagtactgcccccagagacaggctcagggtgatgctccacaggccgcaggcgcgccaccaccacctcatcaggctggcccggctgggtcgtttgacatggagcagtatttacggcatttgctgagcctcagcatgcagagccagggcttcgcttcttttttatgccctactccagaccagttcagggcagaggtcgcatggcccgaggattggcccgaggcccaagcaggagaggcacccccagaggctcccgacgatggagaggaggcccacgaggacgaggagatggccgatttgcttgacttcttgggagggagtggagctacatga

SEQ ID NO: 37683 - DNA, 207 bp, Glycine max
  Peptide Sequence Number=SeqID_129368
tggtacctggagatatgtcgcgggggtcaggagaccttggggacgtcaggctggccaactgtgaattttgtgtgatatatgggttgtggcctttggtaatcgattaccaagggctggaaaacgaggttgtagaggcctctggtaatcgattaccagtctgtgtaatcgattacacagaggaatgggtcactggtaatcgattaccag

SEQ ID NO: 37684 - DNA, 354 bp, Glycine max
  Peptide Sequence Number=SeqID_129369
gttctggctgaaccgggtattggcgtgcagcgggtagtcgtaagggcgcatcagcaccagaatgccgacgccgtggcggcgctgcagccagccgcgttctaccagttgatccaccgcgcggcgcagcgtgtggcgattgacctggtaacgttcggccagctgctgttccgaaggcaggtagtcgccgcagcggtactgcgtgcgcagctcctgttccagctgcgcggcgatctgctgatagcgggtgggatgacaatcgcgttacgccgcggtggcgaacagatgaactatttaggacagcccgggcgtgcacgggcggcggcggcacgctatgctggcgcgattgttgactga

SEQ ID NO: 37685 - DNA, 180 bp, Glycine max
  Peptide Sequence Number=SeqID_129370
atgaagactttaaagactaccgtggatggtaaagctgatcaagctgcacctcaatggattgaagcaaagagccatgttcaaaatggaggctatgagtgtggctattatgtcatgcattggatgtggaacatagtaagcgggggtttgaagaatgattgggccatggcatatttactttga

SEQ ID NO: 37686 - DNA, 246 bp, Glycine max
  Peptide Sequence Number=SeqID_129371
atgccgtcaatctatctcttcctgaaaatctgcgtattcatcgtccctgagctggacgcgtcgctctcggtggaacgaccatcctttgatggcctccaaacgttgttggtgctcaactctcctgaaacgatggatgcaagacggaggagcggcgctggttcctttggccgcgaggtccctcctatatcttgttgcggagagcttcctcgatggaatttcctgccaggacaacatttggaaagttag

SEQ ID NO: 37687 - DNA, 523 bp, Glycine max
  Peptide Sequence Number=SeqID_129372
tgatggctttccagaggagattgctttcaagaccagaggggcagatgatagtttcaaggacatggggagaggatcccgattcaaaaaaaagaacctgacggaggcacccgccgccgcctatgacaatcttcgatttcctctccctacgggagagtacaaaacaaagaggaaagcgggtcagttgattggcaagccgattgacagggccccgaagcaaggtatgatgggtgcgagctactttcacttgttaggagtaggggctgaaaagagctcttcgtataggtccttattcgaaccgcagagagataggcaatgggatggcactactggttttttggacagtgaagttgctggttttcttaagggggcgcggccttcggtgcgcccccgcggcgatcctacaagcctcgaacccggtgccggcgatgcggcttggctcgtagaagcgtgcgatgcgaagaaaacgggactagaatgccgactacaatacaagaccagctctgctgttctctttcgcctggcg

SEQ ID NO: 37688 - DNA, 909 bp, Glycine max
  Peptide Sequence Number=SeqID_129373
atgattaactgcatgaaataccacgatctccgcgacttcctgacgctgctggaaaagcagggtgaactcaaacgcattacacttcctgttgatccgtatctggagatgacagaaattgctgaccgcaccctgcgtgccggtggccctgcattactgtttgaaaatccgaagggttactcaatgccggtgctgtgcaacctgtttggtacgccacgtcgtgtcgcactggggatggggcaggaggacgtcacggcactgcgtgaagtgggtaagctgctggcgtttctgaaagagccggagccaccaaaaggtttccgcgacctgttcgacaaactgccgcagtttaagcaggtgctgaacatgcccaccaaacgccttcgcggcgcgccatgccagcagaaagtgctggaaggtgatgcagttgatttgaccaaaatcccgatcatgcagtgctggcctgaagatgctgcgcctctcatcacctgggggctgaccgtcacgcgtgggccgcataaagagcggcaaaatctgggtatttaccgccagcagttgattggcaagaataagctcatcatgcgctggctgtcacatcgcggcggcgcgctggatttccaggagtggtgtgctgcgcatccgggtgaacgtttcccggtgtctgttgcgctcggcgctgacccggccaccattctgggcgcggtaacgccggtgccggatacgctgtcagaatatgccttcgcaggcctgctgcgcgggaccaaaaccgaagtcgtgaagtgtatttctaacgatcttgaagtcccggccagtgcggaaattgtgctggaaggttacattgagcagggtgaactggcaccggaaggtccttacggcgaccacactggctattacaacgaagtggataatttcccg

SEQ ID NO: 37689 - DNA, 537 bp, Glycine max
  Peptide Sequence Number=SeqID_129374
atggaagccaatgcggttacagtttccgctaccagagttgttgctaaggtgaacccgatgcccccatctggcctcaaccaaatgaatcatccaacctcagatatggtaggcaaagatttgggaagtacagacggcccctattatgtgcaaattcaaaacaagaacgccttcccgccatatggcttgcctcccaactatacaccacccaatgtggcgtacactcccagtgagaatgccaataactccactcccatactcattgagagccgacaaccccaaactgatcatgcacatgtctctcaaaccatgggggagacacatgaaattccccaccacaatctagccgactttgagccttgcctcagatatgccactgaagagcaagcggttggtggtatacccttgcaaaacactttggagggccatcagtatcacccacaaccacaccccttgcattccacagtgggtaaaaaccctcatgctatggcaaaaaatgggaaagttggatcatctagaggaaaggctcagagccattga

SEQ ID NO: 37690 - DNA, 690 bp, Glycine max
  Peptide Sequence Number=SeqID_129375
atggccccaaggaagcttgcctcaaagagatccaggaaagacaaggcggttgaaggaaccagttccgctcccgaatatgacagccatcgttttaggagcgctgagcaccaacagcgcttcgaggccatcaaaggatggtcattccttcgggaaagacgtgtccagctcagggacgacgagtatattgacttccaggaagagatagttcgccggcggtgggcatcgctggttacccccatggccaagttcgacccaaacgtagtcctcgagttttatgccaatgcttggcctacagaggagggtgtgcgagatatgcgatcttgggtgaggggtcagtggatccctttcgatgcggatgccctcagccagttcttgggataccctttagtgttggaggagggccaggagtgcgagtatggccagaggaggaaccaggccgatgggtttgatgaggaggccatcgcccagttactgtgtataccggggcaggattttgcccggactgctgctgggagacgggtgcggttcatgcgcaccaacatgaccaccctgacccagatctggatgaccttgctgctcagcaacatccagcccagcgatcataattccgacctccctctgccgaagtgtcagctggtgtacgccatcctgacatggataagcattcacgtggctcaagttgatcgctga

SEQ ID NO: 37691 - DNA, 228 bp, Glycine max
  Peptide Sequence Number=SeqID_129376
atgaagattttgacgatgtcaagaagaattaagaatttgcttgagaagggggagaatgtaaatcatgcaagctttgatggtgttgagaagaaatcacatgtttgtcatcatcaaaaagggggagaatgtgaatccttgattcaagatttcttcaagatcaagccttgcctcacaatgaaaggtttgaagtcattcaaggcacatgtaatcgattaccaatacatgtaa

SEQ ID NO: 37692 - DNA, 237 bp, Glycine max
  Peptide Sequence Number=SeqID_129377
atgtaccgtgatgcaatccttcctaggaagggaccagtcaccagagccatgaacaagagtctccaagaggattggactagagttgctaaagaaggtcctagggttctcatgaacctcaggcatgggggtgagcttagctattggaggggtgtgagtagcccccctctagcttctcaaggaagctttcttccttgcttcccaaggaagctaccttccttcattgtatttttggcatag

SEQ ID NO: 37693 - DNA, 234 bp, Glycine max
  Peptide Sequence Number=SeqID_129378
atgtcaggtagtggtgaacatcaattggatagggtacaaagattcttgttggatgctctcaatgctcaaatgcaaaaactattgagggagaacaacgaggagttgtatgaaagaattgagagattagagaatcgtgaacgtcatgaggaagaaaggagaggagaaaatggtggtggtccaaggccaaaccgaattgaaggagttaagttcaacattcctccctttaaggcaaaa

SEQ ID NO: 37694 - DNA, 153 bp, Glycine max
  Peptide Sequence Number=SeqID_129379
atgaccatgattacgccaagctcgaaattaaccctcactaaagggaacaaaagctgggctttttccggaggagccctggtgcttaccaacatggatggcgaagagctaccttcacccgtgaactctgatgtcgtcaaacaatattatgcttag

SEQ ID NO: 37695 - DNA, 300 bp, Glycine max
  Peptide Sequence Number=SeqID_129380
atggatcggtacttcaacaatgcatcattcacatacatccatgcttttcattggttgcattgtccattgcattctttccttgaaaaccaaactgtaatcattgtaatcaaaccgaaagaatgcactttacgatgcccttaccaaatgcgtgctagagctagagtaatgggtgaagtagaggaggtacaagaacatatcaaggctgacatggaggccatgcaagaacagatggccacaatgatggaggccatgatgagcatgaagaagataatggaggtcaatgcggctgcagttgccact

SEQ ID NO: 37696 - DNA, 1134 bp, Glycine max
  Peptide Sequence Number=SeqID_129381
atggcatccagctttattgtgatgcgcgatccggtgctgtaccgcattaaatttgccgaacaccaccagactggcaacaagtggtgcatctatccgatgtacgactttacccattgcatctctgatgcgctggaaggcatcacccattccctgtgtacgctggagttccaggacaaccgtcgtctctacgactgggtgctggataacatcactattccggtgcatccgcgtcagtacgagttttcgcgcctgaatctggaatatgcggtgatgtcgaagcgtaagctgacgcagctggtgagcgagaagattgttgaaggctgggacgatccgcgcatgctgaccgtatccggtctgcgccgtcgtggctatagcgcggcgtcaatccgcgaattctgccgccgtatcggtgtgaccaagcaggacaacattgttgagatggcgtcgctggagtcgtgcattcgtgacgacctcaacgagaacgcgccgcgcgccatggcggtgctggatccgctgaaagtggtgatggagaacctgccggccgggcatgaagaaatcatcagcatgccgaaccatccgaacaagccggagatgggcacgcgtgaggtgccgttcagccgtgaggtgtggatcgatcgtgccgacttccgtgaagaggccaacaagcagtacaagcgtctggtgctgggtaaagaagttcgtctgcgtaacgcttacgtcattcgtgccgagcgcgtggcgaaagatgaagccggcaacatcacctgcatctacgctacctgcgatgtcgacaccctgagcaaagatccggccgatggccgcaaggtgaaaggcgttattcattgggtgtcggcgattcacgcgctgcctgccgaattccgcctgtacgatcgtctgttcagcgtgccaaacccgggcgcggccgaggatttcctcaccaccattaacccgaactcgctggagatcaaacagggcttcgttgagccgggtctgcgtgccgccagcgcgctggcgccgtatcagtttgagcgcgaaggttacttctgcgctgacagcgtgtactcgcagccgtcgaaactggtgttcaaccgcactgtgggtctgcgtgatacctgggcaaaaatcggcgaataa

SEQ ID NO: 37697 - DNA, 1026 bp, Glycine max
  Peptide Sequence Number=SeqID_129382
atgggaacaaatcaaaccggcaagaggttctaccaagtcaaggtcaaaagcccagataccaccagcatcaaggaattagggcggttgatggaacccctccaaatgcaagccttccgcaagacttacggaaagatcttagagttgactatagcagaagtgtccatagaagccattgcatcactcacccaatactacgaccagcctttgagatgcttcacattcggagacttccaattagtaccaaccattgaagaatttgaggaaattctaggatgtcctcctcgggggaagaaaaccatatctttcatccgggtgtctcccctctttgagcagaattgcaactgtggtcaaggattcagcaagaggtacctagaagacaaggcgaggggtatggccaatcaaggagattgggtcccgtttatggatgtgttagctttgctaatttttggggtcgtcctctttccaaacgtggatggtttggtggacctagcagcaatcgacgctttccttgcctaccaccatagcaaggaaagtccggtggtagctgtcttggcagatctatttgacacatttgaccgaagaatagattgggaccagctcttggctgggataggaggtagaacaatcagttggttcccccgatggaaggaaggaaaggagggagtccttttctcatgtggagggtacccaagcattccgctgataggaacgaggggttgtattaactacaatcccgcgctcgctataagacaactagggtaccccatgaggggagcaccgatggaagaaagcatgtctcatttccttgtgagggatttcggcgcgcaaaatttcaaggctatacaaagaatccataaggcatgggaaaccccgttaaggaaagatcaagaacttaggggcattcgtaatggcatcattggtggttaccatgaatggctgaaagttcatatacgaggtttagattggctcgccaagttaaaagtcgtcagcgaagagagttttgaagcaccggaagaggacgaagag

SEQ ID NO: 37698 - DNA, 486 bp, Glycine max
  Peptide Sequence Number=SeqID_129383
gccatggctactccacctgcctcgcctcctccttctcttcctcctcctcctgcagacacatcagcatctccatctacattgaagcggacacgcaaggcgacacggctacgatcattggccactagaccacctggggcaaaaagacctgtggtcaacgtcgatcctgctaccggcaaggccgacggtccccacaagaagaaattaagaacatatttggggattgtcgctcatgataaggcggaatttgaaatccctgaagcttctgacagtaggacaaagaagaaaattcttcagattgtcggtgagcgctggaggcagtttaaatctgacttgactaggaaatgggcacttgcagccgacaaggacgatgtggacgacattgtctgtgaaaaatatggcattagcaaggagaaatgggcccaattttgtcagacccgcagagacccctcatgggaggatgtgcggaaaaaggcacaggcctcctag

SEQ ID NO: 37699 - DNA, 636 bp, Glycine max
  Peptide Sequence Number=SeqID_129384
atggtgattaaggcacagagccctgcaggattcgctgaagagtacataattgaaagcatctggaacagccgttttccgccgggatcgattcttcctgctgaacgtgagctttctgaactgatcggcgtgacccgcaccactctgcgtgaagtgctgcagcggctggctcgtgatggctggctgaccattcagcatggtaaacccacccgcgttaatgatttctgggaaacgtctggtcttaatatcctcgaaacgctcgcccgtcttgaccacgacagtgtgccgcagttaattgataacctgcttgcgctgagcgaggaagatcaggctgaagcctataccgagctggattaccgcgtatttcgcggcctggcctttgcttccggcaacccgatttacggcctgattctcaacggtctgaaagggctgtacacccgcgttggccgccattacttctcaaatccggaagcgcgtgaactggcgcgtaacttttatcgtcagctggcggatctgtgtggcaaacagccgacgcaggatcagatcgtcgacagcgtgcgtaactacggccgccgcagcggtgaaatctggcacagtatgcagaaaagcatgccggatgatttgagcagtaagcgctaa

SEQ ID NO: 37700 - DNA, 333 bp, Glycine max
  Peptide Sequence Number=SeqID_129385
atgtatgtgacagtgtcattgggatgctccttaacattcaaggcaagacggaaagatggtcttgtaaatcatgaagattttgatgatgtcaagaagaattttcttgacaaaggggcagaatgtggatcatccattgttttgatgatgtcaaaaagaaatcacttgattgccatcatcaaaaaggaggagaatgtgaagcaacagaactctggaaattcaaaattcaaaagtcatgacccttcaaattataactgtgcaatcgattacacaaacattgtaatcggttaccagcggagagttttcaaaaaatctgccaacagtcacatcgtttga

SEQ ID NO: 37701 - DNA, 357 bp, Glycine max
  Peptide Sequence Number=SeqID_129386
atggcgacgcagctaatccatgatcgagtagagatggagtgcctagagggagcctgggagaccctcgaaaggcaacacgagcgcactgtggagtggatactacccacgcctacaccataccgtctagtggagccagtccaagtgatcgaggtgacgtcatccgaggaagacccagaggaggatctcgaggagctacctcccgagcctgctgtggatgctcttgactttctagagggtgatgaggacccacttcatgaggtggattctcccgaggacgtcatgtcggcatccgaggcagactctacggaggatagtggcccgagagagatggcggccagtggaggctcttcatcatag

SEQ ID NO: 37702 - DNA, 457 bp, Glycine max
  Peptide Sequence Number=SeqID_129387
atgggatcaagtcaaatgccttcacttaaaaggaggttctctcaagtcaaggtcaagagcctagggaccacaagtctaaaggagttagggcagttaatgtgtcagctccagcggcaagcttttcgcaaagcttacggtaaaatctgggacttagccatggtagaagtctccatagaggccattgcctcccttgcccagtattatgatcggccgttgaggtgcttcacctttggggacttccaactatcacctatggtagaagaatttgaagagatcctaggatgccctctagggggaaggaaaccctacctcttcttagggttctatccctcattagctagaatttccaagatagtccaaatctcggcacaggaattagaccacaggaagcaagtcgaaaatggggtggttggaataccgagaaaatatttggaggcaaaagcaagaatcttggcag

SEQ ID NO: 37703 - DNA, 636 bp, Glycine max
  Peptide Sequence Number=SeqID_129388
ggtgcacctttaaggggcaccattgttgatgacatgaagtttgattactccagtcatgatgcctgccgcatggtctgcattaaccaagcggatatgaccgacagactgcttgttgggtcagtgacatttgattgttgcatcatgcactatatcattgttagaattttgatgcctcgttcttctaacctagctcaagcctctgaggaggacttgattctgacgtgggctttcttgaccggtcgtccaatcaactgggctcatttgattcgttactgcatgcataaggcattgcggtctattaaacgttcctttgctattggtgccggtgcggtaacctccttcggctaccgtaaggacatggatgggcaatggttgaagaaggatgcgcaacctccacaagacgaacgtactccctctcctccgcctcaacgagatgactcctcagccctcatgcatgaagttttttcggagttacgaggcctccacacctattttgttgaatgctttgattccttggatgatcgtatcgatgccattgatgctcgctttgaaggaatggatacccgcatcactcagcttgaggaggatgtgagttatcttcgtcggtgcttcgaccttccaccaccaccttcatag

SEQ ID NO: 37704 - DNA, 405 bp, Glycine max
  Peptide Sequence Number=SeqID_129389
atgccgaaaggcactgcactggcattgccgcgaagggtcagtccttggctgctagaagacgagcggcagcagccctgcctgaacttctcgacgagccatattgggcgaatccgcgtcgggagccggaggcagtattgcgcgggttcacgtaggtctgcttgccttccgcttccactcttggcgcttgagcgccagaaagtcgcgttttggccatatagacctcgccgcgcacttccaccacatcgggcgcatcggcgacagctccgttcgaatttccttgatggtccttatattgggagtgacattttcgccggtcgtgccgtcaccgcgcgtcgccgctgtcttcagcctgcgttttcagcggaatggacatggaaagcccgtcgatcttcggttccgcagtga

SEQ ID NO: 37705 - DNA, 318 bp, Glycine max
  Peptide Sequence Number=SeqID_129390
atggacccttgggtactagttaccctcaccgttgagaggactacacgtcctcgccttgagaggactacacgtcctcaccatcagagggttgcacgtcctcgccttgagaggactacacttcctcaccatcagaggttaccctcgccgttgaaaggactacacgtcctcgccttgagaggagtacacgtcctcgccttgagaggactacacgtcctcaccatcagagggttgcacgccctcacctctagaggactacatgtcctcgccttgaaagggctacacgccctcaccttgggtactagttaccctcaccgttga

SEQ ID NO: 37706 - DNA, 120 bp, Glycine max
  Peptide Sequence Number=SeqID_129391
atgactaagaacttgccacaacggtgtagggctttgctcgtctgcaatgagattatggtactcgaccaagaacctatcgaaggggacacaataggcaatggtgtcagaaaatcatggtaa

SEQ ID NO: 37707 - DNA, 435 bp, Glycine max
  Peptide Sequence Number=SeqID_129392
atgaaacttcaacgtctcaaccaaaatgaagagaccgacaaaaggaaaagaagcatagcactcaaagcctcctcctcaatgcaagaagaagaagaatatgatgatgaagaggacttttcactctttgtgaagaagtttcataaattaatcaaaaatagaagaatggagagaagccataacttcaacaatgggaagagatatcaagaagtttctccaacgcttaaatgctataagtgtaatcaactcggtcacataaaggcaaactgcccctcaaatgagtcatggcccgagaagaatgagaagaaaagctataaagaaagaagatccaagaaggcgtatattgcttgggatgacaatgactcatccgatggtttggagaaggagatcatccttctatccaaggactatgaaagtgatgagaacatctctcaagaa

SEQ ID NO: 37708 - DNA, 528 bp, Glycine max
  Peptide Sequence Number=SeqID_129393
accaaggtctaggcatcttagggggtgcaccttctaagcccgaagatgataaggggaagacaatagaaaagcaaccccttaaggctaacatttatagtagccaagatgaggctactacttcaccttcctgtagtgaacgtgaagaatcaaaaggggaagaatctagtgaagaaatctatccccaagaagaaggacaaccattaatggttaaggaggagtgtaaggaggtaattgtctcctccaagaggttagctaagaaggaaagtcattttacaataaagacaaacattaaagaaacttcccctcttagacaacctccacattttctcctttgtaaaaagacacatgttagcattgccacacctcttgggcttgagtttattcctcaagaaaaggagttgttggatgagggggttcccatgaaccctaagagaataaagatcattcctgagtggctcactccaccaacaccactcattgagttggtgagaaaccatgttccttcatgggaagatgcccaggaaatgg

SEQ ID NO: 37709 - DNA, 1044 bp, Glycine max
  Peptide Sequence Number=SeqID_129394
attcagccgtaccacgagtttgcccgcaatctgccggtgccgaccaaccttaacctggtacacctgaacccgctgcgcggcacggcgctgttcgtcttcgcgccgagcctggtatttatcgccgtcgataacctgttcggcggcgacgggcgtttcccgaccaaggtcgaaggccgcgaattcacgcccaccgaacagcgggtcatcaaacgcatgctgcgcctggcgctggacgcctacggtgacgcatggagcgcaatctataagattgacgtcgaatatgtgcgtgcggaaatgcaggtcaaattcaccaacatcaccacctcgccgaacgatatcgtggtgaccacgccgttccaggtggagattggcgcgctaagcggtgaattcaatatctgtattcctttcgccatgattgagccgctgcgtgaactgctgaccaatccgccgctggagaattcccgccaggaagatagccagtggcgcgaaacgttggtcaagcaggtgcagcactctgagctggagctgattgccaacttcgtcgatatcccgatgcgcttatcgaaaatacttaagctgcagccaggcgacgttttacctatagataaaccggatcgcattatcgcccatgtcgacggcgtgccggtgctgaccagccaatatggcaccttaaacgggcacccaatgagtgatcctaagcaaccgtctggcgcaggaaaggaatccgtagacgatctgtgggctgatgcgcttaatgaacagcagtcgtctgagaaatccagcgccaccaccgatggggtgttcaaatcgctggaggcccaggatgcgctcggcagcctgcaggatatcgatctgatccttgatattccggtgaagctgaccgttgaactggggcgcaccaaaatgacgattaaagagctgctgcgcctgtcgcagggatcggttgtcgcgctggatggcctggcgggcgaaccgctggatatcctgatcaacggctatctgatagcccagggcgaagtggtggtggtggccgataaattcggt

SEQ ID NO: 37710 - DNA, 384 bp, Glycine max
  Peptide Sequence Number=SeqID_129395
gtatggcgctacaggcaccctctggacccggataagtccaacagggccctgggatttcccgccttgatcacaggactctgccagtcgttcggagtccccgtcgcacctagcaaggcggccaaccaccgggctcatgttcagacccatgattgtctttaccagatgagcctcagcctgcagagccagggttttacttcttttctgtgccctactccggaccagttcagggcagaggtcgcatggcctggagattggtctgaggcccgggcaggagaggcacccgcagaggcaccagcagaggctcccgacgaggcagatgaggcccgcgaggacgaggagatggctgatttacttgatttcttaggagggagcggagccacatga

SEQ ID NO: 37711 - DNA, 312 bp, Glycine max
  Peptide Sequence Number=SeqID_129396
atgacaaacaccaattgtacagataatcgcttgggtatctccgtacgtcacctgacttcatgggtcaggatgacagaaggcgcggaagacgaagtaagtctccgcgtgtcaatggaaatcgtttgtgcggataatcacttgggtatctccgcacgtcacctgaattcacgggtcaagatgacagaaaccatttgtacggataaccgcttgggtatctccgcatgtcacctgacttcacgggtcaggatgacagaaatcgcggaagacgacgaaagtctccacgtgtcaacgggttcgttggcccccgattga

SEQ ID NO: 37712 - DNA, 354 bp, Glycine max
  Peptide Sequence Number=SeqID_129397
atgtaccctctcttgttctcagtcacaacaacccatgtagatgtaccctctacttgtaccacaaaggatgtaccctccaatgtgttaagacaaagttctcaggcgggagaagggaaacacaaaagaattcaggcggttagtccttcgggaattcttttggaaaagggagaaaagaatgaaaagatgaatagcacaagttttcaaggtttggaaaaccagaaaacttcagaaagcttttggtacaaagaagaagaagaagttcaaagagattcaaggcttgtaaaggattgtaatgaaatgattggaaaagtattcaagattgttgaaatgcaaaacaaagccttgcttttatag

SEQ ID NO: 37713 - DNA, 96 bp, Glycine max
  Peptide Sequence Number=SeqID_129398
atgggagaatccctcttccatatcaagaacataaaaatcaacagggaaaataagttcaccaaccctcaccaatacctcttctatgaaacctgcagg

SEQ ID NO: 37714 - DNA, 393 bp, Glycine max
  Peptide Sequence Number=SeqID_129399
atgggtgaccaagaggagacacaggaacagatgaaagccgacatgtcggctttgaaagagaaaatagattccatgatggaggccatgttagggatgagacaactcatggagaataacatggccaccgctgctgctgttagttcggctgctgaagcagacccaactctcccagctaccgcacaccatcctcccccaaacgcgataggacgagaaaagagcacactggggtacatcagcaacccccatttgggatacaactgggtggcttacccttatggattaccacctaattacacgccaccagtcgtgcgtgatgacgcgggtcatgtcacttcccccatccttgaaggggagcctcctcgacagcccgatgaggttcacgaggatcattaa

SEQ ID NO: 37715 - DNA, 288 bp, Glycine max
  Peptide Sequence Number=SeqID_129400
tgggctaagcgcgcatccaccgctaagcgcagcttcaacatgcttagcgcgacagaaaaatctggcagggcatcaatatcaaggccgcgcaccaagcatgagcgcacgactcgcgctaagctcaaatccacttactctcgctaagcgagagggtggtgctaagcgaaacgtcatgaattcagagattattcaaagcctggcacagaattccatagcacaccacattgcctatttcgggaaaagagctctgaaggcagcaagaggagcaacttttgcagagatacctag

SEQ ID NO: 37716 - DNA, 282 bp, Glycine max
  Peptide Sequence Number=SeqID_129401
atgcaaccatatattgcagcactgaaattttgtcacttgactgggaatcttcttataggtacatccgatgggtgcattaaggcatggaatgtggatgcaaagagagttgtctgtgacctcaacacaaccgaagcatttccaagtgtattggacataaagtgcagtcctgtggaacctatttttgtgtctgcagcagcatctggaggggctggttctaactatattgacaacctgggttttgcttcacttactgtgtggaacatgaagacatggaaagccatg

SEQ ID NO: 37717 - DNA, 117 bp, Glycine max
  Peptide Sequence Number=SeqID_129402
atggaggccatgaaagatcaaatggccgcaatgatggaggccatgatgagcgtgaagaagataatggaagccaatgcggttgcaattgcaattgccgctaccagcgttgttgctaag

SEQ ID NO: 37718 - DNA, 144 bp, Glycine max
  Peptide Sequence Number=SeqID_129403
atgactgaagcacgtcaaaagggggggaggagcttgccacccagctcgcccaggcgagctcagctcgcccaggcgagcatcgttgcttcctccagaagcaacagccttctggaggaagaatctggaaggcccaagtgggcctga

SEQ ID NO: 37719 - DNA, 231 bp, Glycine max
  Peptide Sequence Number=SeqID_129404
atgaaggagaatgtcttctccagcccctcagcccttcttctctctatttttcacttggtatatggtttcctagactatggttgtggtggtgacccctggttttctgccaatcttagtgttttaaaggctcttggacttctcagcacacgaaggctcgctcagcgagcatgtctcactgagcgagaggtttcccatccgctaagcgagctggctatctcgctaagcggatga

SEQ ID NO: 37720 - DNA, 429 bp, Glycine max
  Peptide Sequence Number=SeqID_129405
atggtcattctgcgtcttttgtcatccagaggtggcgggcctgatgaaatacgggaaccatttggtcccgcactttttcaccttttgtcatccagaggcggcgggcccgatgacatgcggagacaaattatggtcatccgcacgcttttgttatctagacatattatggtcattctgcgccctttgtcattcagggacagtgagtcgagaggtgggcggagacaaattatggtcattccccacaccttttcgccatccagaggcgatcgtgtctggtggcacgcagagacaaattatggtcattttgtgccttgccacccaggctcgatcgtggccgagggcacaaagagacaaattatggtcattctgcgccttgtgtcgaccgagaggaacgaattcgacagtatcaggatgatgtgtcggtactga

SEQ ID NO: 37721 - DNA, 117 bp, Glycine max
  Peptide Sequence Number=SeqID_129406
atggcgcgcccagcgcgcgatctgaacgcgctaagcgcgaggtgtggcgctgagcgcaactacgaaggccccctagcctttctttcatccccagttgtaagccctcaatggccatga

SEQ ID NO: 37722 - DNA, 313 bp, Glycine max
  Peptide Sequence Number=SeqID_129407
atgacggaagggtgtggtgaagggttttgccttgcaaaccttcccgtttttccatgtgcccgggggtcgggttttggcccgtggctaggtcttggcaagccgttggttgaaaattttgccccccggtcaacttcgtggtttttgcccgttgttggcttggctagggtcggcggtgctgggttatggccccgtgctaagtttcggattgggtttgttggtgatttggaggggagggacgaatcaaagcgacaagggctgaatctcagtggatcgtggcagcaaggccactttgccacttacaataccccgtcgc

SEQ ID NO: 37723 - DNA, 519 bp, Glycine max
  Peptide Sequence Number=SeqID_129408
atggaggccatgaaggaccaaatggccaccatgatggaggccatgttgagtatgaagaaaataatggaaagcaatgcggttgcagttgccactaccaacgccgcagctgaggtggatccgacccatccatctggtgtaaatcaaatgagtcgttcagtcccagacgcggtaggtcagggaggagaagcattgggaagtacaagcgatccccatgttgtgcaaagcaagaattctttcccaccatatgacttgcctcccaactacatgccacccaatgttgtacatatgcctgacgagaacgccgaccactccgctcctgttccccttgaaagccagcaaccccatgcacatttttctcaacccacattgggggcacgcgaagaaccccaggaccatgctctggctgacttcgagccttaccccggatatgccactgaggggctagcatttggtggcatgccccagtctaacacctcaaggggccctcagcatcgcccgctgcaacccttacatttctcg

SEQ ID NO: 37724 - DNA, 165 bp, Glycine max
  Peptide Sequence Number=SeqID_129409
atgcgtcaggtggcaggtggatatacccaagtgattattcgtacaaagacaacatctgttgatcctgacccatgcgtcaggtggcaggcggatatacccaaatactttttgtcatccagggatgatcaagtggatgatgcacaaagaacccattctactgtctag

SEQ ID NO: 37725 - DNA, 261 bp, Glycine max
  Peptide Sequence Number=SeqID_129410
atgacatgcggggaaccatttggtcccacactttttttacctttgtcatccagaggcggcgggcctgatgacatgcgggggaaccttatggactcgacgcctgatagcacacagagactaacatcgtcttctgtgccttttgtcatccagggacagcgagtcaggtggtgggtggagataccttatggtcatccgcgcctttcgtcaatcgaggggaacgaattcgacggtatcgggatgatattggttgttcggtgctaa

SEQ ID NO: 37726 - DNA, 483 bp, Glycine max
  Peptide Sequence Number=SeqID_129411
catctgagcccggtcattaacttggcctacttcaggaagaactgttggaatcctgatgatctgacagttgttatccgaggggctaggagggcgagaccaaggccagttgatcttccttccacatctgcagtggtggcgcctccaggatccattccttccattgagcaatttctggagagggtagcctggcctggggcccaaccttctcttcatagggaagatgaaggtcccacaacccaggaagttgctgctacttctgagaggtcacgagaggtcacatcagatccacccataccagtggtggacctatcctcacctcagcatgcaatagatccctccactcctatacttgagataccagaagacctgaccacaccagtcctgactctgaacacttctcctccagctactccagtacttcatctgacagatgaggaggatgttcagacacaggatactcaggaccagtcacaggaattctaa

SEQ ID NO: 37727 - DNA, 350 bp, Glycine max
  Peptide Sequence Number=SeqID_129412
gtattattaggcaccaagtccctaaaataggtggtatgatgaatgttttgagtggtgcaacactcttttgtaaaatcactcatgcacccaacatcttcgtgatttgtgtacatagggacccattaggcagtgatcaaagggttcccatgaaccctaagagaataaaggtcattcctgagtggcccactccaccaagtataagaaaaatttggggcttccatgacttaacaaacttttacaaaaggtgtcgagggaaggagccagagtatgaagaacctcgggatttgaggtcaaatcctttccaaggtggagggaatgatgcaattctatcccgcaagggtattgggtag

SEQ ID NO: 37728 - DNA, 398 bp, Glycine max
  Peptide Sequence Number=SeqID_129413
gtagttgtgtctccggtaaaaccacctccaaagcccgatccggaggttgatgatccactttatctaatgacattgaccatcccagagcttttcttgaggccttatcaggttatatgggatgccaccgtgttcaaggtctttaatccaaatttccccctctacataaagcacgaagacctctccgaaatcgcacacggtggtcaatgtcttagcatatcagtgttacagttaaatctcactgaaacatgtatgcgagtggggaattctgatatctatggattcctcgagccacagtccattcagaggtatgggcaatcgcagtttgagtctgaaagttacataaagacttggatgcagagttcaaaatgcaatgtctatcttggagcctacctaaatgg

SEQ ID NO: 37729 - DNA, 252 bp, Glycine max
  Peptide Sequence Number=SeqID_129414
atggaagacgcacccgtaagccctcgcgtcgccctcccgcaaaagggtaggttgcgacaatctcctccacctctaggacctcacaatcacttacaaactcatctcaagctctcaggacggcttcctcttccagctctggtctctgtagatcttcacacaacaaattctctcaaactctctgattcttcctcgcgcttagccgaggaatgttgcgctcagcagatggctcgctatgccaacaaattggcttag

SEQ ID NO: 37730 - DNA, 381 bp, Glycine max
  Peptide Sequence Number=SeqID_129415
atgtattctcttgatttcaggattgtcatcataaaaaagggggagattgtggaagcaattccttccaagattattttgatgatgccaaagaatcaagagtcaagcaagttccaaagaatcaagagtcaaggtggtttcaagattcaatatcaagattcaagattcaagaataatcaagatcaagattcaagattcaagaataatcaggatcaagattcaagaatcaagattcaagattcaagtaaagaatcaagacttaagattcaagaatcaagagaagactcaatcaagataagtattaaaagagtttttcaaaaactattgaatagcacaattttgttcaaaagaaaatttttaccaaagagttttactctctggtga

SEQ ID NO: 37731 - DNA, 390 bp, Glycine max
  Peptide Sequence Number=SeqID_129416
atgacattgctacttagcaacattgctggcccagcgaccgcaacgccaatctccccctgcaaaagtatcagttggtctgtgtcgtcccgacatggggatcgcacccacaagacacccagtggacccggaaaagtccaacagggccctggggtttccagctctggttacgggcctctatcagtcctacagggtgcccgtacccccccggcaagggatcgcacctgcaagacacccagtggacccgaagaagtccaacaggagtacctgcaacctccagcaagggcatcaggccccctactgatcgagctttcatcaagaagtactgcgtccctaggcaggcgcagggcgaaacaccacagcagcattgggatggacggtagcgggcaatag

SEQ ID NO: 37732 - DNA, 639 bp, Glycine max
  Peptide Sequence Number=SeqID_129417
atggagagaagtacgatagatgctgccagtggtggagcccttggagacatgactcctgctgaagccagaaatttaattgagaagatggcttccaactcccaacagtttagcgccagaaatgatgctatagtcattagaggagtgcatgaggtagctacaaactcagctacatcatctgaaactaagaagcttgaaggcaaactggatgcattggttaacttggtaacccagctggccttgaaccagaaatctgtacctgttgcaaggacctttgcccttccatgcaacaacttggagcaattgagcagcccgaagcttatgctgctaatatttacaatagacctcctcaacctcagcagcaaaatcaaccacagcagaaaaattatgacctctccagcaacagatacaaccctggatggaggaatcaccctaatctcaggatggtcaagccctcagcaacaacaacagcagcctgctccttcattccaaaatgctgctggcccaagcagaccatacattcctccaccaatccaacaacagcaacagccccagaaacaaccaacagttgaggctcctccacaaccttccctcgaaaaacttgtgaggcaaatgactatgcagaacatgcagtttcaataa

SEQ ID NO: 37733 - DNA, 463 bp, Glycine max
  Peptide Sequence Number=SeqID_129418
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtttccccctggcggctccctcgtgcgctctctgtcctgcctttcggtttaccggtgtcattccgctgtatggcgcgtttgtctcattccacgccttgacactcagttccgg

SEQ ID NO: 37734 - DNA, 267 bp, Glycine max
  Peptide Sequence Number=SeqID_129419
aaaattgggggagaagcttgccacccaactcacccaggcgagctctgctcgcccagacgagcaaggtggcttcctctagaagcaaccgccttctggaggaatcttctggagagcccaagtgggcctggttgctatttgcaccccctgatgcaatcctaccccgcaagggcattggatagaaaactccaagtagattgggccagagatgcaagagaaggccctagggttcttatgagccttagggtagatttcgggcccatgggctaa

SEQ ID NO: 37735 - DNA, 279 bp, Glycine max
  Peptide Sequence Number=SeqID_129420
atgtggttcaatttcgagcgtctcgatattttatgctccctaatcgagcatccaagtgaaaagttaagaccattggaatttcttgatggggacatgaccaagagcaagggcaaggatccacttgaaggacttggaggacctatgacaagggctagagcaaggaaagccaaggaagctcttcaacaagtgctgtccatactatttgaatacaagcccacgtttcaaggagaaaagtccaaggttgtgagttgtatcatggcccaaatggaggaggactaa

SEQ ID NO: 37736 - DNA, 204 bp, Glycine max
  Peptide Sequence Number=SeqID_129421
atgggtttgggccagaacaacgatggcatggagagcttggtagagttcacggagaaccgcagaaggttcggactagggtataagcctacgcgtgctgacgtgagatccgacaatgattcctatgaaggtaatgataccgaggacctagacgtcaattttgagcaaccggtaaaccaagctgaggatgaagaagatgaggattga

SEQ ID NO: 37737 - DNA, 585 bp, Glycine max
  Peptide Sequence Number=SeqID_129422
atgatagatcaaggccgactagtagtcggcgatgaggggaaggaagagcagcatatatgtatgcagtccgcagatgagagaagttttggaaggcctaaacctttggtgatatatttcaccatggacgcagcttcacaaaagccccgatacccctcggtagctaagcctggtcctttcccataccaaaacagccacgcagtcctgtggaggtatgcacctccgaatgaaaggaaagaagaggccactgacatcggcttgttgtcagccaaggtgaccaatatcacagggctgagcggtgtgacccacagcggtcgcgtgtttgcaccccccgacctggcgactcaacccgcgaacgttaaggggaaggcaaagatggtggaagaacagaatgacaaaacgaccctcaccttagacgaggatattccgacaaaaggtcttccgaataaaagggatggttgtggcaagaaggaagtgtcgctagaggaagcaaacgagtttctccgctttattcagcagagcgagttcaaagtcattgagcagctcaacaaaccccggccaaagtctctcttttggaattactcatga

SEQ ID NO: 37738 - DNA, 187 bp, Glycine max
  Peptide Sequence Number=SeqID_129423
atggcgccttacgaggcattgtatggtaggagatctaggacacctctatgttgggtagatgttaatcggaggcttcctggttatggaaagttaaaatcctctgttggatcttcccttggaaattggtctgattctgatgaccttgataggacagggctaagttgtcgtactatcacgaggaatcagg

SEQ ID NO: 37739 - DNA, 615 bp, Glycine max
  Peptide Sequence Number=SeqID_129424
atgaccggaaggcttcttgccggttcattggcttttgagagtcgcatccttcattatctcattgtgcgtatcttgcttccaagatcttcaaaccttgcacatgtttctgaagaagatcttattgttatgtgggcttttcataaaggccgacaaattgattgggcacacttagtccgatatcgcatgcataaggcattgcaattaaatgctccatttccatatccacacctagtcactctcttccttcaacacttcaacattcctcttgattctgaaccttatgttctaatcaagagatcctttctaataggcgctgttgtgattgcatcctttggttatcataaagagcatgatagctcttgggtgaaaaagggtgctcaacccattgatgaagaaggacatttacatgatggagaagatgtctctcttcttcaaaagattttggacaggttcgatggtcttcaaacctttgttggtaaaaggtttgatactttggagttacaagtggacatgcgattcaatgagatggagtcaaggatcatcaaggtcgaagaagatgtttcttacattcgaacaagctttgatctaccaccaccaccgccaccaacatcttag

SEQ ID NO: 37740 - DNA, 420 bp, Glycine max
  Peptide Sequence Number=SeqID_129425
atgttggctactggtaatcgattactaccttctggtaatcgattaccagagagtaaaaactctttgggagggtacatccacttggttgttcaaagagaacaagggagggcacatcccttgtggatctttgcttgtaaaggattttacaaggttattggaaatctcaagaaccggtggttgcttagggattggatatgcaatccctgcaaaccacatccaattgagtcagatgtagctccttctaatgcccgtgtgagcacaaaggaaagttgtgttgatcccttcggacaagaccctgacattgatacatcagataggtgtgggttgtatgttaatgacaatcatcctcgcctggttgcccttgagagagtttatgaagggtcatcaatcgtacatcacgtgccattggccaatgatatg

SEQ ID NO: 37741 - DNA, 462 bp, Glycine max
  Peptide Sequence Number=SeqID_129426
atgttggtgcgcatgatccgcactcgtctctttgcagcggcatgggtgaaatcttgccccggtatgcatagtagctgtgtgatagcctccctttctggttgtgcttgcacagttggccctcctccaatattagggggtggcccaggaaccgtgcggatgtggagcacactgaaaatgaggacacgtagccctctaaaggtgagggcgtgcaaccctctcaaggcgaggatgtatagtcctctggaggtgagggtgtgtagtcctctcaaggtgagggcgtgcagccctctgttggcgaggacgtgtagtcctctaaaggtgaaggcgtgcagccctctgttggcgaggacgtgtagtcctctaaaggtgagggcgtgtagccctacgaaggtgaggacatgcagtcctctgatggcgagggcgtgtaaccctctgaaggtgaggacacgcagtgtcctctga

SEQ ID NO: 37742 - DNA, 906 bp, Glycine max
  Peptide Sequence Number=SeqID_129427
atgccattcgcctttacagggctacacgtcctcaccttcagaggacaacaccttctcgccttcagaggactacatgccctcaccttgagagggctgcattcccttgccttcataggaatacacgtccttgccttcagaggactacacatcctcgcctgtagaaggctgcatgccctcgccttcagaagactacacgccctcgccttcagaagattgcacgtcctcaccatcagaggattacacgctacacgccctcgccatgagaggactacactgtcctcacttaaaggactacacctcctcactttagagggctgcacgcccttcgcctttaggctacacgccctcacctttagaggactacatgtcctcggattcaccccttttgagggctgcacgccattcgccttcagagggctacgccctcactttgaggactacacgactacacgtcctcaccttcagaggactacacgtcctcaccttcagaggactacatgtcctctccttgagaggcctgcatgccctcgccttcagaggactacacgtcctcacgtcctcgcctttagagagctgcacatcctcactttaagagggctacacgccctcgccttcagaggactacacatcctcgccttcagaggattacacatccttaccttcagaggactacaggtcctcgccttccgaggactacacgtcctcacctatagaggactaaacgtcctcgcctttagggggctacacgtcctcaccttcagaggactacacgtcctcgcctttagagggatgcacgccctagcctttacagggctacacgtcctcaccttgagaggactacaccttctcgccttcagaggactacacgtcctcaccttcataggactacacctcctcgccttttga

SEQ ID NO: 37743 - DNA, 721 bp, Glycine max
  Peptide Sequence Number=SeqID_129428
agacggcaagtccgatgacatgcggagataccttatggttatctgcatcttttgtcagctagaggcaagcgagctcgttgacacacagagactaacatcgtcatctgcacctttgtcatccagagacggtgagtccgatgacatgcggagataccttatggtaatcagcacattttgtcagctagaggcaagcgagcccgccaacacacagagactaacatcatcatctgcaccattgtcatccagagacggtgagttcgatgacatgcagagataccttatggttatccacaccatttgtcagcaagaggcaagcgatcccattgacacagatggcaagtctgatgacaagcggagatacatctttggtcagctagaggcaagcgagcccgttgacacgcaatggctaacatcgtcatctgcacctttgtcatccagaaacggcaagttcgatgacatgtggagataccttatgtccgatgacatgcggagataccttatggttatccgttccttttgtcagctagaggcaagcgagcccgttgacacagacggcaagtctaatgacatgcgaagataccttatggttatccattcctttattcagctagaggcaagcgagcccgttgacacagacggcaagtccgatgacatgcggagataccttgtggttatctgcaccttttgtcagctagaggcaagcgagccctttgagacatag

SEQ ID NO: 37744 - DNA, 303 bp, Glycine max
  Peptide Sequence Number=SeqID_129429
atgagtgtagagcagttcattaggaaggtggcctggcctggagcccgaccttcttttgtgggggataatgaaaagacgagatccaatgaggctgctcatcctggaccagtgctagtaccagctgatgtaccatttccagggatggatccatcttcacctcagcatgcaatagactcttccactcctatcttagagatacttgagggacataccacaccagtcctggctctggacacttctcctccagctacttcagtattgcatctgacagataaggaggatgtacaggcacaggaattttga

SEQ ID NO: 37745 - DNA, 321 bp, Glycine max
  Peptide Sequence Number=SeqID_129430
atggttacgagcccggaaatgggtttaggcaaggacaacggcggcataaccagcctgataagcgctaaaggaaaccgtgggaagtttgggttaggctataaatccacacaagcggacataaagaaaggcattataggaaggaagagcagaggtcaaggctcgcgattgggacaagaagtcaagagaggcccgccctgccacatcagtaggagctttataagtgcaggtctaggacacgaaggccaagtcgttgcgatatgtgaagatgatttgccaagtgggtcggcagggtacgaccatgccctcctagtttttgactag

SEQ ID NO: 37746 - DNA, 249 bp, Glycine max
  Peptide Sequence Number=SeqID_129431
atgacacgggtcacgttcctcccctcaccctcgaaggggagcctcctcgacatcctgatgaggtccacgaggatcatcgagaacatgctcagggagacatcgactcctactccccatttcccgctgaggggctggcacccaacgcactacctcaacccaacatcgcgggagaacctcgaaaccacccaacgcagccaatggtttggtgattatccgttcgtagacatgaccggcctatgcctggtgtag

SEQ ID NO: 37747 - DNA, 242 bp, Glycine max
  Peptide Sequence Number=SeqID_129432
atgaacgaaaacgcaattcatggggctccgaaaaaggggttgagaatggagaattgcactaagcaatcactacgcatggctccaaactcgaagaatggagaattgcactatgcaatcactacgcattgctccaaactcgaaggtggaagacgcatgaacgaaaacacaattcatggctccgaaaaagggttgagaatggagaattgcactaagcaatcactacgcatggctccaaactcgag

SEQ ID NO: 37748 - DNA, 102 bp, Glycine max
  Peptide Sequence Number=SeqID_129433
atggataaccactcgggtatctccgcatgtcagggtcagtatgacagaaattgtggggcggccgacaaaagcgaggctcttgctcctacgtatgctcaatga

SEQ ID NO: 37749 - DNA, 237 bp, Glycine max
  Peptide Sequence Number=SeqID_129434
atgatggaatctttgtcaaccaagcaaagtattgcaaggaactcatcaagaaatttggacactcttggaaaactcaaaacacttggggctactcctatgagcaccagttattaccttgacaaagatgaatccggtcaacctgttgatgcaaagcaatacagagggtctgctcttgtttctatgaacgcaagaagcaaggataacattatccgagacagaaaacctttctgcacgtag

SEQ ID NO: 37750 - DNA, 426 bp, Glycine max
  Peptide Sequence Number=SeqID_129435
atgaggctacaacagcaccttcctctagtaaaagtgaagaagcaaagggggaagaatcaaccccaacagatctacccccaagaagaaggacaacctttaatggttaaggaggagggggaggaggtattattaggcaccaaatccctaaaaataggtggtatgatgaatgctttgagtggtgcaacactcttttgtaaaatcactcatgcacccaacatcttcatgatttgtgtacatagggacccattaggtagtgatcaaggggttcccatgaaccctaagagaataaaggtcattcctgagtggcccactccaccaagtgttgagggaaggagcccagagtatgaagaacctcgggatttgaggtcaaatcctttccaaggtggagggaatgatgcaatcctatcccgcatgggcattgggtag

SEQ ID NO: 37751 - DNA, 168 bp, Glycine max
  Peptide Sequence Number=SeqID_129436
atggataagagcttgaaggtaagagaagatgagtggagggagagggagagaaagggcacaaaatttatgcctcaaatgagatgtctattttatccaattaaaatttcagctcaaaatgcaaagtattcaagccatggaggaattaagaacacagtgtgccaaaactga

SEQ ID NO: 37752 - DNA, 636 bp, Glycine max
  Peptide Sequence Number=SeqID_129437
atggctcggaggaagctttcctcaaagatatctaggaaggacgctgcggtcgcagggactagtgccgctcccgagttcgatagtcatcgtttcaggagcgctgagcaccagcagcgtttcgaagccatcaagggatggtccttccaccgagagagacgcgtccagctcagggacgacgagtacacagatttccaagaggagatagctcgccggcacgccgtcagtcagttcctgggatacccactggtattgaaggagggccaggagtgcgaatacggtcagaggaggaaccgggccgatggatttgacgaggaggccattgctcagctactatgcataccaggtatgtcgcctaccaggcaccctctagacccagataagtctaacagggccttgggttttccagcattgatcatgggtctctgccagttgttcggggttcctgtcacacctaagaagtattgcacgcctagacaggcgcaaggtggcgacccgcaggccccagacgcaccgccgccacctcatcaggctgatccagctgggtcatttgacacagagcggtatttacggcatttggttcgccagcaggcggccaaccacagggcgcacgttcagacccatgactgtctctactag

SEQ ID NO: 37753 - DNA, 396 bp, Glycine max
  Peptide Sequence Number=SeqID_129438
atggcaagaagcggaaaggatgatcttggagaccttcaggaaagtagaggtgaacgaatcctaatgccatcaagcagattccaagataataaagtgagggaaattgatgccttggtcaaaggaactcaagctgcaatgaatcagaaatttgcacctgttgcaagagtctgtggtctatgttcttctgcagatcaccatatagatctttgtccttctttgcagcaatctggagtcaatgagcaacctgaagcttatactgcaaacatttataatagaccccctcagcagcaaaaccaacaacagcagaataattatgatctttcaagcaacagatacaatccaggttggagaaatcatccaaatctgagatgggcaagtcctccacaacaacaatag

SEQ ID NO: 37754 - DNA, 940 bp, Glycine max
  Peptide Sequence Number=SeqID_129439
aggactgcacaccctcgccttcataggactacatgcccctactttcaaaggactacacgtcctcaccttcagaggactacacgtcctcaccttgagagggctacatgccatcaccttcagaggactacacatcctaaccttcagagggctacacatcctcaccttcaaaggactgcacgtcctccacttcagaaaactgcacgtgctccccttcagagggctacacgtcctcaccttcagagcgctacacgtcctcacctttagagggctacatgtcctcaccttcagaggacagcatgccctcgccttcagaggactgcacgtcctcgtcttcagagggctgcttgccctcgcctttagagggctaatcgcccttgccttcagagggctgcacgtcctcccctttagagggctacatgtcctcaccttcagaggactacacgtccttacctttagagggctacacgccctcacctttagagggctacacgccctcaccttcagaggactacacgtcttcacctttagagggctacatgccctaaccttcagaggactacacgtcctccccttcagagggctacatgtcctggacttcagaggactacacgtcttcaccttcagaggactacatgtcctcaacttaagagggctacacgccctcaccttcggtggactacacgtcctcaccttcagagggatacatgccctcaccttcaaaggactacatgtccttgcctttagatggctacactccctcgccttcagaggactacacgcccttaccttcagaggactacacgtactccccgtcaaagggctacatgtcctcaccttcacagggctacacgccctcatcttcagggggctacatgtcctcccttttagaggactacacgtcctcgccatcagagggctacatgtcctcgcctttagaggg

SEQ ID NO: 37755 - DNA, 456 bp, Glycine max
  Peptide Sequence Number=SeqID_129440
atggtgggacaaggaggagaggtgttgggcaacatcggtggaccacacatggggcataataggaatgcttacccctatgtcttaccccccaattatatgccgcccaccatgcacatgcccaacgagaacgctaatcatgtcgttcccgttacatttgagggtcagcaaccttgggagcatgctcaatgtgactttgacccatatcccacattcaccgccgagggattggcatttaatgctatgcctcaacccaataccacggaagctcctcaaccccaccctctgcaacaactgtgtttcttagtaggtgggccgcctccggcagtggaagggatagagaaacttgatctcatcgaggagagattaagggctgtcgaagggtttggtgattaccttttcgctaacatggcagaattgtgtttggtacctgatgttgtcatccccccaaagttcaag

SEQ ID NO: 37756 - DNA, 582 bp, Glycine max
  Peptide Sequence Number=SeqID_129441
atgtcggctttgaaagagcaaatgacttccatgatggatgccatgctaggaatgagacaacttatggagaataacgtggccaccactgccgctattaaaagaagcacactggggcacatcagcaacccccatctgggatacaaccgagtgacttacccttatggattaccacctaattacatgccaccagtcatgcgtgatgacgtgggacatgtcccttcccccatccttgaaggggagcctcctcgacagtcggacgaggttcacgaggatcatagagagtatgcccaaggagacatcgatttctaccccccggtccccgtcgaggagccggcacccaacacactacctcagcccaacctcacgggagaacctcgaaacctcccagcacagccaatattcttgtccgcagaaggaccacccccggcagcggaagaaaaaaggaaactcgatctcatcaaagagagattgagagctattgaaggctttggcgactatccattcacggacatggcagatctttgcttagtactggacgtcgtcatccccccaaaattcaaggtacctgataacgataggtag

SEQ ID NO: 37757 - DNA, 486 bp, Glycine max
  Peptide Sequence Number=SeqID_129442
atggctctgctaccatcatgcacagaaacaaggaacaagaaacatgagactgttaaggtcttttgcaagccttgtaaacctggtcaaggacacgagtatgcacaagaacttgccagattgagtggtggtattccacttcaaataattggagatgacactataatatttgattgcggaaagaactatgaacagcctgaggttatgtcaccaattgataccctgtccaagaataaggtgtatttgtgcttcatgaaaaaagaaaagaaaagatctgaaatgcacgattgctatagtttttgttcatcgtttaaaagcattggaaatgcaaattgtttcgatgttttacctgcattgtcagttgcagaaaagcatagttgttttgcacctactagcctcagtggcaatccacaaactgattctgatttctaccgaaaaatctgcccaaacccagagaaagaaggagagttgagagaagttgacctttga

SEQ ID NO: 37758 - DNA, 447 bp, Glycine max
  Peptide Sequence Number=SeqID_129443
atgggtcaacttcaacagcaagcctttcacaaagcctatggtaagatttgggacctagctagggtagaagtctccatggaaccgattgcatccctttcccagtattatgaccagcccctaaggtgcttcacattcgaggacttccagctagtgccgactgtgaaagagtttgaagagatcctgggatgcccactgggaggaaggaagccatatcttttctctggttctatccctccacgacaagagttgccaaggatgtccaaatgttcccttgatggaacaaggggttgtattaattataatcccgtcctcgccataagacagcttggctaccccatgagaggagtgccatcagacgaaagcatcacgcctttcatcgcatggggtttcagtgaccacaacgcaagggtactccaaggagttcgcaaggcatgggatgcggcgtga

SEQ ID NO: 37759 - DNA, 363 bp, Glycine max
  Peptide Sequence Number=SeqID_129444
ggagccagtagtttccttttatcagttcttgggccaccccctgatattggaggagggccaactgtgcgagcacaatcagagagggaggctatcacgcagctactatgcataccggggcatgatttcacccgtgtcgctgcaaagagacaagtgtggatcatgcgcaccaacatgaccactcttacacagatatggatgatgttgctacttagcaacgttttgcccagtgaccgcaatgccgatctcccctacagatgtatcagttggtctctgtcgtcccgacatagggatcgtgcccgcaagacacccagtggactcgaagaagtccaacagggtcttcaacggatttctaaaaaagcctaa

SEQ ID NO: 37760 - DNA, 378 bp, Glycine max
  Peptide Sequence Number=SeqID_129445
atgggtgaagcaaaaaaggtgcaagagaagatgaaggccgacatggaggccatgaaagagcaaatggccacaataatggaggccatgatgagcatgaagaagataatggaagccaatgtggttatagttgccgctactagcgctgtcgctaaggtgaacccgatgctcccatctggcctcaagcaaatgaatcatccaacctcaaatatggtaggcaaagatttgggaaaagagttgttcctagtacccaatatcatcacccctcccaagttcaaggtgctggactttgacaagtacaaggggactacttgccccaagaaccatccaaagatgtattgtcggaagataagggcatacgcaaagatgaggaactgctaa

SEQ ID NO: 37761 - DNA, 534 bp, Glycine max
  Peptide Sequence Number=SeqID_129446
atgtcttccaaggttattttgatgatgccaaagaatcaagagttaagcaaattccaaagattcaagaatgaagtttcaagaatcaagattcaagattcaagaatcaagtttcaagaatcaagattcaagaataatcaagatcaagattcaagacttaagattcaagaatcaagagaagactcaatcaagataaattcaaaggaccaaccgcctgagaattctttgtcccaacacattggagggtacatcctttgtggtacaagtagagggtacatctacttgggaactgttctactgagaacaagaaatggtacatctcttgtggatcagttcaagtggagggtacatccacttggttattcaaagagaacaagggagggtacatcccttgtggatctttggcttgtaaaggattttacaaggttgaaagaaatctcaagaattgcaggttgcatggggactggatgtaggcacggtttgtggccgaaacagtataaatcttgtgttagtcttcttctttcctatactctttaa

SEQ ID NO: 37762 - DNA, 373 bp, Glycine max
  Peptide Sequence Number=SeqID_129447
tggttcacaacatcctttgttgcatggccaagtgaaggttggtgataaggaggttaaagatgcagaggctcccgtttctgtacccactgacgaggttattttagtggggcaggcacataacaccttccttgcttggctgacacatctcgtgaagcgtttatcacaacaagcagctgtgtctccagcaaaacctccatataggctggatcatgaggttgatgatcccctttatttgatgacattgacaatcccacagctttttttaaagcgtcttctggttatgtgggatgctactgtgttcggggtgtttaatgaacacttcccgttgtacataaagcacgaagatctctctgaaattgcacacggtggttaa

SEQ ID NO: 37763 - DNA, 387 bp, Glycine max
  Peptide Sequence Number=SeqID_129448
atggttgcacctcgtgggagagggagaggtcgtaacagcagaagaggtcgtagtggaagaggtggacgtcctcaatgcacatattgcaagaggatgggccacactcaagagaattgctactccttgcatggcttcccagacaaagtagctcaggtagctcagacagaaaaatcagagtctaagttctctgaaaaagagtatcaagagtatttgaagctgaaatttgagaaatccagcagtcaggcttcatcttcctctgtaccatgttattcgacagcatgtatttctcaatctattgacggtcccagtccttggatacttgattcaggtgtctctgatcatatttctggaacatggcccgggtcaactgattggagaaggacgtga

SEQ ID NO: 37764 - DNA, 324 bp, Glycine max
  Peptide Sequence Number=SeqID_129449
gtttcagccattactccaaataaagtgactgaagctgttcaaccgatgaatgatgttgttgtagatgaccccttgcgtgagttgataaagagcctggttgacatttatgagaagcctgttcagttgttgtgggatgttagtaaatttggaattccagatgtagatgcatccttgcatacaatgtttgaacatagctatactacagttgtggaccatccaatactcaatgcaaaggatagacgtggccaatgtcaagattacatcgagaaatggcttaaggaatcgcatcgagaggtgtatctaggagcttatttgaatcagtaa

SEQ ID NO: 37765 - DNA, 423 bp, Glycine max
  Peptide Sequence Number=SeqID_129450
atgacgggagcgtccattagttggttctcatggtggaaagaaggaggggcaggagtgttatgctcgtgtgagggattcccaaatgtccccttgatggggacgagaggttgtattaattataatcccatgctggccataagacagttaggctaccctatgagaggtgcaccgtcggaggaaatcatcacgtctttcatcgcgcgaggtcttaatgaagctaatgcgaagatacttcagaaaatccgtaaagcatggaatagagtgggaagaaaagataaggagcttaggggaagtagcaatggcgtcatcgatggctatcacaagtggttgaagtctagaacgcaagggataacttggctcccaaatctgaaaagtctaagtgagaaagaggttgaaattcctgaggaaagtgaaaaagtgtaa

SEQ ID NO: 37766 - DNA, 597 bp, Glycine max
  Peptide Sequence Number=SeqID_129451
atgaccccggatcaagcctgcgcccacccgaactggtcgatggggcgcaagatctcggtggattccgccaccatgatgaacaaaggtctggaatacattgaggcccgctggctgtttaacgcctcggccgagcaaatggaagtgatcctgcatccgcagtcggtgattcactcgatggtgcgctatgccgacggcagcgtgctggcgcagctgggtacgccggatatgcgcacgccgatcgcccacgcgatggcgtatccgcagcgcgtgaactccggcgtggaggcgctggacttctgtcgcatcggttcgttgaccttcgccgaaccggagcgcgagcgttatccttgcctgtatttggcgattgaagcgttcgatgccggccaggcggcgaccactgcgctgaacgcggccaacgaaattgccgtggcggcatttttgcagcagcagattcgcttcaccgacattgcggcggtcaaccgccaggtggtggagcgcctcgcgttgcaggaaccgaccagcatcgaagcggtcttagacattgaccgccaggcgcgcgccgccgccgaggagcgcgttcgcgcgttgcgcggttga

SEQ ID NO: 37767 - DNA, 195 bp, Glycine max
  Peptide Sequence Number=SeqID_129452
atggcttccaacgcccaacaatttagtgccagaagtgatgctattgtcattagaggagtgcatgaagtagccacaaattcatcttcatcaggcgagactaagaagcttgaagactctgtccacacagacctttgcccttttgtgcaacaatctgaagcaattgaacagcctaaagcttatgctgcaaatatctaa

SEQ ID NO: 37768 - DNA, 813 bp, Glycine max
  Peptide Sequence Number=SeqID_129453
atggggctgacctttccgaacgcgctgggtctggctgcggggctggataagaacgcggagtgcattgatgcctttggcgccatgggctttggctttgtcgaggtgggcacggtgacgccacgcgcacagccgggcaatgacaaaccccgtatgttccggctggtggcggcggaaggtatcatcaaccgcatggggtttaataatctcggcgtcgatcacctggtaaaaataaagactacgccggtggagcagggcaaagacgattatctcacctgcatggaaaaggtgtatgcgcacgccggttatattgccatcaatatttcctcaccgaatacccccggattacgttcgctgcaatatggcgaagcgctggacgatctgctgtcggcgattaaattaaaacagcgggcgctgcaggaaagccatctgaaatatgtgccggtggcggtgaagatcgcgccggatctttctgaagaagaattgatccaggttgccgacagtttagtgcgccacgaaatagacggcgtgatcgccaccaataccacgctcgatcgttcgctggtgagcgggctgaaatatgccgacgaagcggggggattaagtggccgtccggttcagtcgcgcagcaccgaggtgattcgccgtctggcgcaggagctgcagggacgtctgcctattattggcgtcggcggcattgattcgctggtcgcggcacgggaaaaaatggcggctggcgcaacgctggtgcagatatactctggctttatttataaaggtccgggtttaattaaagatatcgtgacccatctctaa

SEQ ID NO: 37769 - DNA, 207 bp, Glycine max
  Peptide Sequence Number=SeqID_129454
atggaacaacggaagcagtcgagaaattcgaatggtcataacatttcactcggctatccgattcggggacataatatatcggagacgctcgaaaatgaacagcggaagctctcgagaaattcgaatggtcataacttttcacacagatgtccgattcggggacataatatatccagacgctcgaaattgaactacggaagcggttga

SEQ ID NO: 37770 - DNA, 291 bp, Glycine max
  Peptide Sequence Number=SeqID_129455
atgcagagttcaaaacacgatgtctaccttggagcctacctgaatggcgaacactggcagatggtggtcatcgcgcccaaggaacacctagttgtctggttttgttcattgcataataggccagacaactaccttaaggggataattaacagtgcattaaaaggtcttgatgatgctccacaacctaaatcaaaggctcctactaggtggattgtcatcaagtattttaacgatcctagaccattggagtcagagagattaaaggcgcttcggatccagtggacactgtaa

SEQ ID NO: 37771 - DNA, 654 bp, Glycine max
  Peptide Sequence Number=SeqID_129456
atgactgccccccacgtactgtctcgtgggggttatgatttgcttgaaaaaaagctattagacgagaaaaggaagaaaagacaagaagatgcaatgctgacagagaatacaccattgattgaggaccctccatctcctattgaaagacatgtcaagtggaagatggcccgcacaaagcgatgtgggcagatgacatctcaagcagcacaagaaatatctgagaattgtgagttcgaatcgttacaagaacagatgacacagggtagttttgttccccatggttgtgacaatatactcaatactgccattgggcgaccggagcatccatgtcgtgtttgtgtagtgggccttaaggaagagtggaggaatgagattatcagaaaccttaaggaagaagtcaagaatgagattgaagaagaaaataagagcaatgctggaactattgtcaacccatcaagggaagaacatgatggtcatgtgataccgactatggggttcattcacaatgtggcttatgcagatgatgtggtaatgattagtgttgaaaaagtttttgatgatgatcccttgcgtcacttgattaagagcatgtatgatatttacgagaagcccgttgagtttatgtgggatgggactaaatttgggattccaaat

SEQ ID NO: 37772 - DNA, 252 bp, Glycine max
  Peptide Sequence Number=SeqID_129457
atgtcgtcttctgcacctttgtcatccagagacggcgagtccgatgtcatgcgaagatacccaagtggttatccgtacaaaggatttctgttaatcctgacccatgaagtcaggcggagatacccaagtggttatccgtacaaacgtttttctgttaatcttgacccgagaagtcaggtggcaggcggagataccaaagtggttatccgtataaacactcattcgttatccgtaagactcaaagcacgatag

SEQ ID NO: 37773 - DNA, 306 bp, Glycine max
  Peptide Sequence Number=SeqID_129458
atgggggagacaaatgaaattccccaccacaatctagccgacttcgagccttgcctcggatatgccactgaagggcaagcagttggtgaaatgggaaagttggatcatatagaggaaaggctaaatgtcgttgaaggaagtggaggttatgcctttgctaacctagaaaagttgttcccggtacccaatgtcgtcacccctcccaagttcaaggtgtcggactttgacaagtacaaggagactacttgccccaagaaccatctaaaagatgtattgtcggaagatgggggcatacacaaaagatga

SEQ ID NO: 37774 - DNA, 306 bp, Glycine max
  Peptide Sequence Number=SeqID_129459
atgaagcatggctccaaactctttggtggaggatgcatgaacgagaacgcaattcatggggctccgaaaaagggtagagaatggagaattgcactaagaaatcactacgcatggctccaaactcgtgggtggaggatgcatgaacgaaaaagcaattcatggggctccgaaaaaggggtaagagaatggagaattgcactaagcaatcactacgcgtggctccaaactcgtgggtggaggatgcatgaacgaaaacgcaattcaggggctgtgggctctagagtcgaggatggaggattgcactag

SEQ ID NO: 37775 - DNA, 120 bp, Glycine max
  Peptide Sequence Number=SeqID_129460
atggccctcagcgttcgcttactcaaacccactcaagtggcgttttccgcttgtcccgagctgggaagggatgacgatttgtcggtcatgaccctagcctctatttgcgtccgttcctaa

SEQ ID NO: 37776 - DNA, 161 bp, Glycine max
  Peptide Sequence Number=SeqID_129461
aggcggcgagcccgatgacaagcagagaccaagtttggtcatttctgcacccttgtatcatccagaggcggcgggcccgatgacaagcagagaccaagtttggtcattctgcacccttgtatcatccagaggcggcgggcccgatgacaagcagagaccaa

SEQ ID NO: 37777 - DNA, 318 bp, Glycine max
  Peptide Sequence Number=SeqID_129462
atggggcgcccgttccccccagcaagttcatgtcgtcgtggcatagttctagggagtgtctgtcgcccccagcaaggtcatcaggtcccccctaccaatcgagctttcatcaagaagttctgcgtctccaggcaggcacagggcgaaacaccacagcagcctggcgatggctggcagcgggcaacagacgcaccgccatcacctctagagttcacctctgctcatccacaaaaaggtttgagtattgcctacaccacatggccgaccaataggcgaccaagtccaaagccaaaggtaagcaaagtactaggtcagtga

SEQ ID NO: 37778 - DNA, 254 bp, Glycine max
  Peptide Sequence Number=SeqID_129463
tgttagagttgtctacaacaacttcatcccttggttcagagtcagctgcttcagattcccacatcttgaatatagcttcagaagcggtgcgtccgaaggatgatggatccactcggttgacattcttgccatctcagaattctattccggtgaacgactctaatgtgttggagataagaaagaccaagggggtgaagattttgaggcgtaattctgctctaggagctgcgagtagtggtggctctgtggcataa

SEQ ID NO: 37779 - DNA, 292 bp, Glycine max
  Peptide Sequence Number=SeqID_129464
atggggccctatatgtactgggaggtcgatctctccccttacctctcagcggctgccatcgaaggcatgaaccaccatggaactcggcctcaggtgggaggcattaaatggcaacttctccaatgtgctcttcggcatcacgtaattgttggctgtgatgttattgacgatcccctcaaagccttctatggagatgtcttgggctacgtgagcttcattcaagacttttaccaacaaagctcagtgaggctccgagctcgtgagcagctccagaagggagactctagacgag

SEQ ID NO: 37780 - DNA, 468 bp, Glycine max
  Peptide Sequence Number=SeqID_129465
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatgtggggaatcatcaatgattgttgactatgtaaaccaaacattgatgatacagtcctaccccgcaagggcattggatagaagactccaagaagatgggccagagatgtag

SEQ ID NO: 37781 - DNA, 115 bp, Glycine max
  Peptide Sequence Number=SeqID_129466
atgacctcattgaagctcaaagatccagcctccatagaagctccacaagcaagcttccatcagtttctctttgctcctacgtattcctcaattgcgatgaggaaatcagacctac

SEQ ID NO: 37782 - DNA, 639 bp, Glycine max
  Peptide Sequence Number=SeqID_129467
atgtccaaaaggagcttgtctcagcgtttatgcgagacggagaccaacatgctagctatcatcgctaagtaccaagaagagttaggtctagccacggctcacgagcataggatcgcggacgagtatgcccaagtatacgcggaaaaagaggctagaggaagggtgatcgactctttacaccaagaggcaaccatgtggatggatcggtttgctcttaccttgaacgggagtcaagaacttccccgcttgttagccaaggccaaggcgatggcggacacctactctgcccccgaagagattcatgggcttctcggctattggaaaaacaccataactaaacgcgccacaaggcatccttatcgcaccagatccaaatctagaacgatgggtgatcaagaggagacacaggaacagatgaaagccgacatgtcggctttgaaagaactgatggcctccatgatggaggccatgttaggcatgaggcagctcatggagaaaaacgcgaccaccgctgccgctgtcagttcggctgccgaagcagacccaactctcttggcaactacgcatcatcctccctcaggcattgtaggacggggaagggacacactagggcacgatggcaaccctcacctgggatag

SEQ ID NO: 37783 - DNA, 1083 bp, Glycine max
  Peptide Sequence Number=SeqID_129468
atggcgtgcgctgacgctgcaggaaaaaacggccggcattcaggacgttacttatcagcgcagaaacagtcgatctaccgcgagctggatcagaccactcagcgttttaacgtcggtctggtggctatcaccgatgtgcagaacgcccgtgcacaatacgacagcgtgctggccaacgaagtgaccgcgcgtaacgacctggataacgcggtggaatcgctgcgtcagatcaccggcatggattatctgtcgctggcgtcactgaatatcgatcgtttcaaaacggcgcgtccggaagcggtatccaatttgctgaaacaggctgagagccgtaacctcaacctgctgtctgctcgtctgagccaggatctggcgcgtgagcagattcgctccgccgagtccggccacatgccgacgctggatctgaccgcctctaccggtctgtcgaacagcaaatacggcggcagccgcgctaatcagagcgccggtaccaccgactcgatcaccggctccaaccaggttggcctgagcttctcactgcctctgtacagcggcggttcagtgacctcgcaggtgaaacaggcgcagtataactttgtcgccgccagcgagcagctggaaggcgcgcaccgtagcgcgatccagaccgtccgttcttcgttcaataacgtgaacgcttcgatcagcagcatcgacgcttacaaacagtcggtaatctcggcgcagagctcattagatgcctcagaagccggttatcaggtgggtacgcgtaccatcgttgacgtgttagacgcgacaactacgctgtttaacgctaaacagcagctgtcgaatgcgcgttacagctacctgatcaaccagctgaacatcaaatatgcgctgggcacgctgaacgagcaggatctgcagcagctgaacagcacgctgggcaaagaagtgacgacctcaccagaagtggtcgcgccggaaaacagccagcaggccgcgcgcgtggataacggcccgaaagcgacctccgcttccgccgccgctcaggcccgtccggccgcggcacgtaacagtgccaatcctttcgctaattaa

SEQ ID NO: 37784 - DNA, 291 bp, Glycine max
  Peptide Sequence Number=SeqID_129469
atgcctcagccaagtccacaacaagaaagctgctttgccaatcaatttgttgctatcaaatgtttcattggagaatactatcttattccgttgctgccaaatggtgcagatttgttcacccaggataatgattcccaccaaatagggatgattctattgcagtggaaaaataaatgtcctgcttcctgtagatgcaaatgcctttggtgttttgatgatgatcatgatgaagaaaagcaaatgatgcaaatgattcaagaatacaagccacaacatcaagatgatcactag

SEQ ID NO: 37785 - DNA, 159 bp, Glycine max
  Peptide Sequence Number=SeqID_129470
atggaaacaagatttgacagtgactggaaaaaggttgaagcatttgttgtatcaaagacagtcatccagggcatccttatagtttttgaaggtgtgtttgattatgttacattaagtaattttggccctttccaaataaagaattggttattggcatga

SEQ ID NO: 37786 - DNA, 656 bp, Glycine max
  Peptide Sequence Number=SeqID_129471
gtaccgttcccgaaggtcaagcgcaccgacttcccggatggccgcggcatcttcgtacaagcagggcgccaggtcacggtacagctgccactcatcgaaggagacacatggacgcccgtccgctgagcgcgagcgcgcacccgcatcgacgtcaggggaagggtgtgcgatgacggtcaccttcgatgacaccgcactgcgtgcacacgtcgaccccgcgctcgcccgcacggagagtcgtgagcgtgtggccagggagggccgccaggtcggcgtggtcctcggttccggtcggccgtcctggtggccggcgccggagtgctcgatcggccctcgccgtcgtcgccgtgcagttcatgttcggcggggcgacggccgacctgcgacggtcgtgcatggcggtgctgatggtgctgccgctcgccgtggccaacgcactgacctatcgcaccggcgagctcgaccccgagcgtccggccgcgctgttccggctcggcacatcacgggtcgcgagcgacatcgtcgcggggacgtcaccgcggcccttcgaggcggcgaactactccttcgacgtatgggtggcgcgggcgcgcatgccccgggtggcgaactacgtcgagttcgcgttgcgcaatccgctccccgcgctgaccgtg

SEQ ID NO: 37787 - DNA, 417 bp, Glycine max
  Peptide Sequence Number=SeqID_129472
atggcctcagcaaattccttatttccagaagggaattctatcaatagacctccaatctttaatggagagggttaccactactggaaaacccgaatgcaaatttttattgaggcaatagatctaaatatctgggaagccatagaaatagggccttatatacccaccacagtagaaagagttacaatagatggtagttcatcaagtgaaagcataactatagaaaaacctagagatagaatggaacacgagatggaactattgagattacaccaacatgaagaaaatgacaagaaaaagaaaggaattgctcttaaagcatcatcctcaattcaagaagaaagtgatcaggataatgatccagatgatgatgatgatgatctaagtctttttgtaagaagattcaacaagtttcttaaa

SEQ ID NO: 37788 - DNA, 141 bp, Glycine max
  Peptide Sequence Number=SeqID_129473
atgactaaacctttgatccctcgtcaggctgaatatccaagcttcgtccgcaaatccctcatttcaagtgaagggtacatccacttggttgttcaaagagaacaagggagggtacatcccttgtggatctttggcttgtaa

SEQ ID NO: 37789 - DNA, 141 bp, Glycine max
  Peptide Sequence Number=SeqID_129474
atggaaatttatgagagtgatcgactaggaaaaaaagttgtcatcatcaaaaagagggagattgtagaagcaaagcttcatgatgaatcaagagtgattcaaagatgttttgatgataacaaagatgataacaaaagatga

SEQ ID NO: 37790 - DNA, 330 bp, Glycine max
  Peptide Sequence Number=SeqID_129475
caatctggtaatcgattactagactgtatcattttgaattctttgacaagggagaagggagacacaaaagaattcaggcagttagtccttcgttcttttggaaaagggagaagagagacacaaaaagaattcaggcggttagcccttggtgaattctttttggcaaagggagaagggaatgaaaagatgaatagcacaagttttcaaggcttagaaaaccagaaaactttagaaagcttttggtacaaagaagaagaagaagttcaaagagattcaaggcttgtaaaggattgtaagagattgattggaaaagtattcaagattgattga

SEQ ID NO: 37791 - DNA, 339 bp, Glycine max
  Peptide Sequence Number=SeqID_129476
atggcaaatggcaccgaagacgatgtcagtctcttcgtgtcaacgggctcgtttgccccctggttgatgaaaggcatgggtaaccataagcaaaaggatgtttatacggataaccacttgggtacttctgcctgccccctaactttacggcaaaaggatgtttatacggataaccacttgggtatttccgcctgccccctaactttacaggttaggatgaagagattgatggtgccagtagacgaccaaaatgatgtttatacggataaccacttgggtatttccgcctgccccctaactttacgggttaggatgacagagattgatggtgcgcggtag

SEQ ID NO: 37792 - DNA, 129 bp, Glycine max
  Peptide Sequence Number=SeqID_129477
aggaaaatgcaaggatcatgcatgagcaaacgtgaaaacaaaagggactaccagcaacaacatgctatcaaagagaaaaactctagatcagggttcactgttatcaagcaagtcggagacccagcatga

SEQ ID NO: 37793 - DNA, 135 bp, Glycine max
  Peptide Sequence Number=SeqID_129478
atggaggagatacatggagaagaagatgaagaacaaggaattaaaataaatggcagtggaatgggtatggaagaaagattattggagatgccacttcaaggagaagatgagtcaagaagaagctcaccaccatag

SEQ ID NO: 37794 - DNA, 186 bp, Glycine max
  Peptide Sequence Number=SeqID_129479
atgaccctcaagcgtaaggtgcaaggtctaattgatgcgggctggctgaaatttgaggagaatcgcgtgattttcaagtgcgagccattggtttgtttgctcaagcaacctgcgctcctgagtgttgacttccaagacagttcaatcagagattactcatcttgcacattggtgggggtgtcgtaa

SEQ ID NO: 37795 - DNA, 456 bp, Glycine max
  Peptide Sequence Number=SeqID_129480
atgtggtggcgtgaaccggagacacggatatttccaacgctcgaagagctgggtatcggtttcgtaccttactgcccgaccgcccgcagcttccttgccggagcagtcaatccaagccagcggttcgacagcaccgatcggcggcataacctgccacgcttccagcccgatgcactggccaaaaacatggtactgcttgaattcgcgcaatcgtgggcccgccgcaaaaacaccactccggttcagttcgcactgacctgggtgatggcacagcggccatggatagtccccataccgggtacgacgcaatatccgcacctaatagaaaacagtggtgcaccgcaagtccggttgacggacagcgagctacgcgaaatcgatgcagcgcttgccaggatcccattgcagggcggtcgcgcagatccgtttaccgaaagtcagtttgataaaagttaa

SEQ ID NO: 37796 - DNA, 240 bp, Glycine max
  Peptide Sequence Number=SeqID_129481
atgaaatcttgccccggtatgcatagtagctgtgtaatagcctccctctctggttgtgctcgcacagttggccctcctccaatatcagggggtggcccaggaaccgtgtggatatggagcccaccgaaagtgaggacgcgtagccctctaaaggcgagggcgtgtagccttctgaaggcgaggacgtgcagtcctctgaaggtgaggacgtgcccctctttgaaaatggggaacatgtag

SEQ ID NO: 37797 - DNA, 675 bp, Glycine max
  Peptide Sequence Number=SeqID_129482
atgaagattattatctcaatcccattaatgaactgtgatttagccagaggagagcagcacaaagacagttgttatttttattctataaataactttgaccggagacaggaatcggtcatgtatgaataccttgaagaggaaagagcccttgatcttaaaagctatcaatgggagtcattctggcaaccaaattattacgataaagcagaaggagttcttaatctggatgatgctaacactgcggccagacaagaggaagagcgtgcagagattgacacgcatcccgaaagcatttttaaagttacctcaatccatcatcagatgaccactgaagagaaaatgtctgaagtctccagtactccagaatattcctgcccagccactgctggctatgttggaggaacaaagaaaggtagattggaactcagtgtggaggatcaaaaagtctctttagacctctttgaggttatgaaacactcaaatatgggtgatgcttgttctgaggaggaagaggtggaacaggaaatatttcctttggaaaaagaattgggtgatgagatagacagcttagtcaataatgaagagtgtgatgatccgaaagacaattgcgtcgattatgtgggttttgaagaattggagaaaatgagaccatcaaaaagcccaaagcagaattaa

SEQ ID NO: 37798 - DNA, 65 bp, Glycine max
  Peptide Sequence Number=SeqID_129483
atggataacaagggagaaatggataatgtaccactacctataactggggaagaagcaccattagc

SEQ ID NO: 37799 - DNA, 249 bp, Glycine max
  Peptide Sequence Number=SeqID_129484
atggcaatgtttaaaagggcacgcagcgtgtttgctctgtgcccctattttagggacctacacgggaggaaactaaaagggcttttagtgataattcccaaggtggtcatatctctcttgatggtctcaagaggtatcatccccttcgaagaacatattgcagcagtagggactactagcaacaatgtgttatcaaagagaaaaactctagatgagggttcactgttatcaagcaagtcggagacctag

SEQ ID NO: 37800 - DNA, 153 bp, Glycine max
  Peptide Sequence Number=SeqID_129485
atgaaggaaaagaatgagaggaggggtgatgtaatcctccctaggaagggaccagtcactagagccatgagcaagaggctccaagaggattgggctagagttgcagaagaaggccctagggatctcatgaacctcaggggctccataatgtag

SEQ ID NO: 37801 - DNA, 195 bp, Glycine max
  Peptide Sequence Number=SeqID_129486
atggcggcagcgggcaacagacgcaccgccatcacctctagagttcacctcagctcatccacaaaaaggacacacctatttgctcatgatcctaggaatttaaataaaacaagcacaagctcggaaggtagtcatacctcacaaaaagaaatatgtatatatgtagcaagataccttggatatgcatgtatatag

SEQ ID NO: 37802 - DNA, 441 bp, Glycine max
  Peptide Sequence Number=SeqID_129487
atggaagccaatgtggttgcaggcgccgttaccagcacagttgctaagacacatgaaattccccactacaatctagccaacttcgagccttgccttggatatgccactgaagggcaagcagttggtggtatacccctacaaaaccctttggagggccctcagtatcacccccagctacacctcttgcattccacaacaagtaaaaaccctcatgctatggcagaaatgggaaaattggatcatctagaggaaaggctcaggtccattgcaagaggtgaagattatgcctttgctaacctagaagagttgttcctagtacccaatatcatcaccccctcccaagttcaaggtgctggacttgacaagtacaaggggactacttgccccaagaacccatctaaagatgtattatcggaagatgggggcatacgcaaaagatga

SEQ ID NO: 37803 - DNA, 231 bp, Glycine max
  Peptide Sequence Number=SeqID_129488
atgaaaggaaaccaacaaaggtccccagtggagtcgccaactgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgtgatctacgaacttttaagtgaaaggttcgggagttgtatttacgcacgggggaggtattag

SEQ ID NO: 37804 - DNA, 557 bp, Glycine max
  Peptide Sequence Number=SeqID_129489
atgggtgccaagcacctcacaaggaccaaacaaaagttgcatgtcatcaagcaaaggcataatctccataaacgcctcaccaatttggttgatgggagcatagatgtggctttggtgaaagagttctatgaaaacctatacagctctgagggtccttcaccaaagcaacctagggtcagaggccatctagtgaagatcgacgctgacagcttcaacacattcctagagacacctgtggtgttggcagagggtgagactttgcccacatactccagatactgcaggctgccttcagatcctagggagattgaggctgccctatgcataccaggccgagggttcatcttgaacactgagggccatcctgggaggatcctgaggaagaacttgatgactttagcccaggtgtggagttttctctcatactccaacctggcccccgcatcgcacacctctgacctgacagtggatagagctaggctgatctttggcctagtctctcgcatggacatgaatgtaggagctctcatttctggccaaatgacttctatagccca

SEQ ID NO: 37805 - DNA, 273 bp, Glycine max
  Peptide Sequence Number=SeqID_129490
atggccggtctctttttggaacatccgttgcagttgatgacattgctcgcacatggccgcgccatcgctggtcagctttaccagtacgccgcgtttgtcattcgggttagggcttcgttctacccatcctttgcagacgagacgatcgagcatgcgggtgagcgcacccagatcgacagagagcacctttttcagctcaaccggtgtgatacacacttcgcagcgaatggaacacagcactttgaactgtgtcgcggtgatatccagcggtga

SEQ ID NO: 37806 - DNA, 432 bp, Glycine max
  Peptide Sequence Number=SeqID_129491
atgtcgggtctgctagctgttaaatatagtaagctcccaatcatgcttctgtacaactttgatcaacactgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 37807 - DNA, 216 bp, Glycine max
  Peptide Sequence Number=SeqID_129492
atggcaagaatagcaaaagtggtcgagatctcggaacaagagctagaccgagtgaagcaaaataggaatggagcggcaggggtaccaaggaagcacttggaggagaaggcggaagctctaaccagccaaggagaatgggcaacattcatcgatgtattagctctgatagtgtttgggacagtactgttcccgaatgtagacggttggtggatctag

SEQ ID NO: 37808 - DNA, 183 bp, Glycine max
  Peptide Sequence Number=SeqID_129493
atggaggagaagcacctcggcttcgtttcctttcctttcttcttcctctcactgatttctctcaatttccatcactcctcaatgctagaaccccatcctcagctccctttcacacctatttatagaaaaaagggcacttgggaccatggcagctcgcccaggcgagctgagacttactcctga

SEQ ID NO: 37809 - DNA, 237 bp, Glycine max
  Peptide Sequence Number=SeqID_129494
atgggtatttggtgctttccatcttcttggacgagggctgagcttatggcctcctcagctattgaaagtatcggtagggctgtgcatttccaggaattttccatcgccaaccccaatagtgtgcattattcaggattgaggcacttatcgtacttacgaatctctccgaacacttcctccaaatttgctacattttgggccatgttgagcaactacttttttcaaaagttttcttaa

SEQ ID NO: 37810 - DNA, 641 bp, Glycine max
  Peptide Sequence Number=SeqID_129495
atgggatcaagtcaaatgccttcgcttaaaaagaggttctatcaagtcaaggtcaagagcctagggaccaccagtctaaaggagttagggcagttaatgggtcagctccagtggcaagcttttcgcaaagcttacggtaaaatcttggacttagccatggtagaagtctccacagaggccattgcctccctcacccagtattatgatcagccgatgaggtgcttcacctttggggacttccagctatcacctatggtagaagaatttgaagagatcctaggatgccctctaggaggaaggaaaccctacctcttctcagggttctatccctcattagctagaatttccaagatagtccaaatctcggcgcaggaattagaccacaggaagcaagtcgaaaatggggtggttggaataccaagaaaatatttggaggcaaaagcaagaatcttggcaggtaaaggcgagtgggccccgttcatagatattctcgcactgtccatctttggaggagtcctctttccgaatgtggatgggttggtggacctagcagtgatcgacgcttttcttgcctatcataaccacaaggaaagcccggttgtcgctatgctagccgacctatatgacaccttcgaccgaag

SEQ ID NO: 37811 - DNA, 853 bp, Glycine max
  Peptide Sequence Number=SeqID_129496
atgactattaagacagcggtagcctttctatttgcgctctctgggctatctacagcactagcggcaacgcctgcttattatatcgcagagtttcaggcgaccgaccgtgaagcgataaaaccttacagcgctcaggttgagtcaactttcaggccctttggtggacgcttcatcgtcagaggaggtgaacccgatgttaaagaagggttcggagcacaaggccgactggttgttataaagtttgagagtcttaaaaatgcccaggactggtataactcggcagcgtaccagaagatcattcctatccgacaccgtgccggcaattcgcgaacctatatcgtagaaggattgccagaactggctcctcgcagagcagcagcattgtttttgtttgcatttatcttcctcatgcccgtcaggcatgcacatagtcgtgaaaagaccgacattaaaacgctcgttatcgtctctcacccttatccggaacgctcagttctgacaaaagggttgcaggaagccgctgagagtctggaaggcgttacggttcgcaaccttgagactttgtatggttatgacacacgtcagattaatggcgacgcggagcgaaaaatgatgcgtgaacacagtcgtgtcgtttttatcttcccgacacactggttcaatattacgccgatgatgaaggcctggttgaatgaaacctgggggagtgtcggacccggtttgtggcagggaaaggagatgcttgtagtcagtacggctgcggggggacgctctacttacgggccggacggcaggatcggggtatcgctcgcggatgtgtttttaccgatgaaggcaagcgccctgcacgcag

SEQ ID NO: 37812 - DNA, 201 bp, Glycine max
  Peptide Sequence Number=SeqID_129497
atggaggttaaacttgggaggattgatggggacccggtgttgagagaaacgaggatatgggctacgtgggagtacgtgagctcagttggaggtgggcaacaggggatggtgggtttatgcgcgcattgtggatgtggaaaaacttgttgtgcaccatcgcccgaccgccacctagtaccacatgtgatgggtcccccctaa

SEQ ID NO: 37813 - DNA, 370 bp, Glycine max
  Peptide Sequence Number=SeqID_129498
gcacttcacaccttcctaccttggccgacacatctgctcaagtctttatcacagcagctgtgtctccggcaaaaccacctccgaagcccgatccagaggtcgatgatccgctttatctgatgacattgaccatcccagagcttttattgaggccttatcagttcattcagaggtctgggcaatcgcagtttgagtttgaaagttacataaagagttggatgcatagttcacaacgtgatgtctatcttggagccaacctaaatggtggacactggcagatggtggtcatcctgcccaaggaacacctagttgtctggttttgttcattggataacaagccagacaactaccttaaggggattattaatag

SEQ ID NO: 37814 - DNA, 384 bp, Glycine max
  Peptide Sequence Number=SeqID_129499
atgctcaatggaatgccccggggctcatccatgataagcacacgttgcgttggagtcgtatcctcagaaaaatggaggtcaggaaccttggttggggttcctctaccaagaggtatacacgccctagccatccgaggattgcgtgtcctcaccttcagaggggtacaccccctcgccatcagaggactgcatgtcctcaccttcagagggttacacgccctcgccatcagaggactgcatgtcctcaccttcgtagggctacacgtcctcacctttagaggactacacgtcctcgccaacagagggctgcacgccctcaccttgagaggactacacgtcctcgccaacgtagggctacacgccctcacctttagaggactacac

SEQ ID NO: 37815 - DNA, 242 bp, Glycine max
  Peptide Sequence Number=SeqID_129500
gaggaaaatgcgcggaatcgcccccaacgtttatttgtggaaaacgtcggaaaaaccgaaggaaatcggtcataaagaatattccaagttcgggagttgtatttacgtttgaggaaggtattagcacctctcacgtcgacaaaagcggggctcttgctcctacgtaccctccatcgaagaggaaatcagacctacgtagttcttttttaagggtgcatcaagcgattctttttacttggaag

SEQ ID NO: 37816 - DNA, 87 bp, Glycine max
  Peptide Sequence Number=SeqID_129501
atgactgcggagggacgtgatatggctgaggacgttgctgacatgactgacgatgtccctgagctggctgcagaggcacttgaatgc

SEQ ID NO: 37817 - DNA, 429 bp, Glycine max
  Peptide Sequence Number=SeqID_129502
atggttagaacacgaggtttaggtcatgctttagctagggttataggcagaggtagacatgatgagcatgatgcagtcaatgttccccagaggcataggcctactgcatcagcccgtaggcaacgagtacatattacggttgatgagggtgttcctcaggtgactgaggatgttcctcatatggcggaggatgttcctcaggtgactgaggatgtccctcatatggttgacgatgttgctcagaggagtgaagatgtgcctcagatgaccgcgaacgtatattcgactgttgcagaggacttaggacgtgatggtgctgaggggtcacatgctgatgagggattacctggtgggccctgtgacccttcagttttgacttcatttgcgaagcatgtcgcacatgccatttggactggacatgtattataa

SEQ ID NO: 37818 - DNA, 483 bp, Glycine max
  Peptide Sequence Number=SeqID_129503
atgactggtagattgttggccggatcattaacctttgattgtcgcatcatgcactatattatcgttagaattttgcttccctgttcttctaatctggctcaagcctctgaggaggacttgattttgatatgggctttcctttctggtcatcaaatcaactgggctcacttggttagatcttttgctataggtgctggtgcagtaacttcatttggttactgtaaggatcgtgatggacaatggttgaagaaggacgagctacctccacaagacaagcgtactccctctcctcctcctcagcgggatgattcctcagcccttatgaatgaagttatttcggaattaaggggcctccgcacctatgttggcgaacgctttgattccttggatggtcactttgaaggcatggatacccgcatcacccagcttgaagaggatgtgacttatcttcggcgatgcttcgaccttccaccaccgtcttag

SEQ ID NO: 37819 - DNA, 413 bp, Glycine max
  Peptide Sequence Number=SeqID_129504
accatgtatgggggctgacgcctgcccagtgccggaaggtcaaggaagttggtgacctgatgacaggggagccgacgaccgaagccccggtgaacggcggccgtaactataacggtcctaagggcaaagaaggcctccttctgggggggccagagccatcagtgagataccactctggaagagctagaattctaaccttgtgccaggacctacgggccgagggacagtctcaggcagaagggagcttgactgcaagacccacccgtcgagcagggacgaaagtcggccttagtgatccgacggtgccgagtggaagggccgtcgctcaacggataaaaggttgggctgttcgcccattaaagcggtacgtgagctgggttcagaacgtcgtgagacagttcggtccgtatccg

SEQ ID NO: 37820 - DNA, 336 bp, Glycine max
  Peptide Sequence Number=SeqID_129505
gtacacgatgaattcggttataaccgtgttgtatttcaatggaaggaaaaggatgtggctggtggttcaatgtttcattctgcaaattctcttacatcatgtggaaattatgtatctaatgatgacacacaaccgccaacaaatatgagcaatttaaatcttgacgaagatgatgatcatgatgatgatgattatcttgtgtctaactcatacgttgaagattcgttagacgaagatgacagtgttgacggtatatcagatacagacaatgaagtccccgagatgattccaccagtaagaattgttcacccagcagaaggtatgattttgtcttaa

SEQ ID NO: 37821 - DNA, 270 bp, Glycine max
  Peptide Sequence Number=SeqID_129506
atgggtgatttcgcgaagattttcaaccgttcttcgtcgttcgtcgttcgttcttcggtcttcaaccgattcgacgacgagttccgcaaaggtactaataccggggacccagccgtcgatttcgagcaagaagcaagtcggacagagaatgaagaggatgaggatgtagggcttcccccagagttggagaggataatcgctcaggaggaccaagagatgaggccgcatcacagaagagatagaactcgtagacttaggaaccggcaatga

SEQ ID NO: 37822 - DNA, 363 bp, Glycine max
  Peptide Sequence Number=SeqID_129507
atgtctcctccacctctaggaccttacaatcactcacaaactcatctcaagctctcaggacggcttcctcttccagctttggtctctgcggatcttcacacaacaaaatctctcaaactctctggaacctggacctttctctctctagaactctctacacatgtagaagcttcaagaaaaggccaaactctcctcagaaatctgatttcaggcttaaataggtggctttgttcgtgctcctcatcctccttccagattcttcctcgcgctcaatcgagaagtgttgcgctcagcggatggctcactaagccagaagattggcttagcgagagggagaaaatgagcacttcaaaacttgcctaa

SEQ ID NO: 37823 - DNA, 102 bp, Glycine max
  Peptide Sequence Number=SeqID_129508
aaggctattgcttctggaggaagcaaccttgctcgcctgggcgagctgacgtcgcctgggcgagctgggtggcaagctcctcccctattttgctataaatag

SEQ ID NO: 37824 - DNA, 150 bp, Glycine max
  Peptide Sequence Number=SeqID_129509
atggctttaggggacatggcagctcgcccacgcgagttgttgctacaacctaaaggaagtaaagataaggacactaatttcgttcaagcgatcttactattcgaccgggcaactggcaaaaaccaaggaagtgaaaccgagaaaacatga

SEQ ID NO: 37825 - DNA, 192 bp, Glycine max
  Peptide Sequence Number=SeqID_129510
gaacaacaagcagagtgggaacaacaagctgagtgggtaaacgcgcagagacagattctgcgccctttatcattcgggagcagcgacgtgggtgataaacgcgcaaagacagattctgcgccctttgtcattctgatttcgcgagatggggaggttcactggctgaagggtgtttcgctcgaacgaaattag

SEQ ID NO: 37826 - DNA, 291 bp, Glycine max
  Peptide Sequence Number=SeqID_129511
atgatgtgtctatcggggaaggagagtatgctgagtgagcatttcgtttctaaacgaccatatagaggaaacactggatccaacaaagataggagaaaatcactcaaagtgcatcaatctcacacaggacaaggattgacattatcaccctgggtcaaggtttatgataagttgggattttggctcaaggcttgtagaatggttggtcatgatatatgtcagggtttggccagcggttcggggataaaggggatgtcctacattatttccatgatacacatgcaacaatga

SEQ ID NO: 37827 - DNA, 336 bp, Glycine max
  Peptide Sequence Number=SeqID_129512
atgaagaacgtcgaagaacgacttacaaccttcgcgatattcctgtacggaaacgtttcgggaagcgcctcggctaaggattttcttcacggaaacaatttttccaagcaaattcgaaagagagagaaggagatgcttgccgcccagctcgcccaggcgaatcaaggttgctttttacttgaaagcaacagccttctggaggatcttctaaggcccaagtgggtggttgctatttacaccccccttaaaaatgatccccccttttctattttttacttggtaagaaacagaaatgataaactttcaaaatcctattttgtggacgagcttgactag

SEQ ID NO: 37828 - DNA, 237 bp, Glycine max
  Peptide Sequence Number=SeqID_129513
atggtcgtcattttgcctaaggaaaatcttgttgtctggttctgttccttgcataacaggccagacaactaccttaaaggaataattaacagacaaaaaggaagcactgagtgtggctattacatgatgcactggatgtccactataatcttaggaagtttcaggaataattggaaaacgtattttaatgatgttagaccattggaagtagagagattgaaggcgcttcgcatctag

SEQ ID NO: 37829 - DNA, 315 bp, Glycine max
  Peptide Sequence Number=SeqID_129514
atgtcaggatttacacgcaattctcctcaaatttcagccagcccgtatcaattagacttcacactttatgcttcggggtcatacaatgctcaatggaatgccgtagggctcctccacgataagcacacgttgcgttcgagtcgtatcctcagaaaagtggaggttgatgaaccttggctagggttatggctaccattgaattatcaagtggtgttcgtcattggaagtgcggtagacagactttgtggtagatttagggatggcctttgtggatcacctgggtggtgggtaaggagaaggtttgttattggctga

SEQ ID NO: 37830 - DNA, 579 bp, Glycine max
  Peptide Sequence Number=SeqID_129515
atggcgaggatgtgtagtcctctgaaggtgaggacctgtagccctttgttggtgaggacgtgtagtcctctaatggcaaggacgtgcagtcctctgaaggcatggacgtgtagtcctctgaaggtgacggcgtgttgccctctaaaggtgatggcatgtagccctatgaaggtgaggacgtgtatccctctgaaggctaaggcatgcagccctcagatggcgaggacgtatagtcctctaaaagcgatggcgtgtagccttctaaaggtgaggacgtatagtcctctaatgaccaaggcgtgtagccctctgaaggtgagggcgcgtagccctcagaaggtgaggacctatagccctcggttggcgaggacgtgtagtcctctgatggcaagtacgtgttgtcctctgacagcgaggatgtgtagccctctaaaggtgagggcgcatggccctcagaaggtgaggacatgtagccctctattggtgagaacgtgtagtcctctgatggcgaggacgtgtagtcctcagacggtgtgggtgtgtagccctctgaaggtgaggacgtgtagtcctttgaag

SEQ ID NO: 37831 - DNA, 369 bp, Glycine max
  Peptide Sequence Number=SeqID_129516
atgaagaattttcccagaatcgcttacagaaacgtctcggaagcgttacggaagcacttcgactcgatttttcttcacgaaaatgtggaaaatgagaggtgcttgccgcctagaggcttcttgaggaagatttctaagcgcaccccaattactaagttcacccccttttcgtactttacggaaaagttacgaaagtgtttcggatttgattttcatctttttttctcttccctttcaccaatgttaagtgaaatatgcttacccaaagttttcggaaattttacggaagcattacggaagacacggaagccccagaaaccatttttcaacaacgtgaaggagcttgccgcccagttgcttcctccttaa

SEQ ID NO: 37832 - DNA, 114 bp, Glycine max
  Peptide Sequence Number=SeqID_129517
atgaaaaccgaggatggttcagagaataatgtcaagaacaaagatgttgaagatagtgtgtgtgatgtagatttcacctcaataaacaaagctgatgcttcgcgtggatattga

SEQ ID NO: 37833 - DNA, 336 bp, Glycine max
  Peptide Sequence Number=SeqID_129518
ccatttgttcaagtcaagcattcctttgcaattggtgctggtgttgtgacttcctttggttaccataaggatcggaatggtcaatggctgaagaaagacgcactccctcctcaagatgagcgtactccttcgcctcctcctcagcgtgaagattcagcactcctgaatgaagtccttaccgaattacgaggtcttcgttcttatattggtgaacgttttgactcattggatacacgctttgccggcatggatattcgcctcacacaagttgaagaagatggctctttcatccgtacttgctttgatccaccaccaccacctccatcatcctcttag

SEQ ID NO: 37834 - DNA, 212 bp, Glycine max
  Peptide Sequence Number=SeqID_129519
aggaagcactgggcccaacaaagataggagaaaatcactcaaagtgtatcaatctcacacagtgcgtggcaagaaagtcgctagcgcacaggattttggttggcaatcaaagggagagggccactttagggcaaggatttatgataagttgggattttggctcaaggcttgtagaacggctggtcatgatatatgtcagggtttggccagtg

SEQ ID NO: 37835 - DNA, 486 bp, Glycine max
  Peptide Sequence Number=SeqID_129520
atgatagtagctcgttgttttataggcttcatcatattcagtcggaagagtttaggtaagactttcaaagtgactctcgacgggagaatccaggctattcaggaagaatcgcagcaattccccaatcctaacgaagtagttcctccggaatctaatgaacaacaacgattacttaggatcagtttgcgaatttgtggcaccgtagtagaatcattaccaatggcacgctgtgcgcctaagtgcgaaaagacagtgcaagctttgttatgccgaaacctaaatgttaagtcagcaacacttccaaatgccacttcttcccgtcgcatccgtcttcaggacgatctaggcacaaagtttcacttattagttaggaggagattttgcccccagtgtatctcgaaaagcagaaaaaatagaactcattcgagagagcttggtggtcttaagaatggttcggggtggggggttctcttaagaataaaataa

SEQ ID NO: 37836 - DNA, 183 bp, Glycine max
  Peptide Sequence Number=SeqID_129521
atgaccaaacttggtctctgcgtgccaacggacacgactgtgtctgaatggcaaaggggtacggataaccgtaaggtatctccgcgtatcataatgaccaaacttggtctctgcttgtcatcgggcccgccgcctctggatgacaaaaggggtgtgcgtcacatgacctcagggtcagtatga

SEQ ID NO: 37837 - DNA, 657 bp, Glycine max
  Peptide Sequence Number=SeqID_129522
atggcacagaagaagagcactccaatcactcctaccacatccagatggagcaaagttgcaatcccttccaagaagaggaaagaaatttcctcatctgactctgatgatgatgtcgaactagatgttcccgacatcaagagggccaagaaatcagggaaaaaggtgcctggaaatgtccctgatgcaccattggacaacatttcattccactccattggcaatgttgaaagagaactgggaagagatgcctgggattgcaaggagatcatggacctcatcaaggctgctggactgctgaaaactgtcaccaagttgggagattgctatgaaagtctagtcagggaattcattgtcaacattccctctgacataacaaacagaaagagtgatgagtatcagaaagtgtttgtcagaggaaaatgtgttagattctcccctgctgtaatcaacaaatacctgggcagaccaactgaaggagtggtggatattgctgtttctgagcatcaaattgccaaggaaatcactgccaaacaagtccagcattggccaaagaaagggaagctttctgcagggaagctaagtgtgaagtatgcaatcttgcataggattggcactgcaaactgggtaccctcaatcatacttccactgttgccacag

SEQ ID NO: 37838 - DNA, 1953 bp, Glycine max
  Peptide Sequence Number=SeqID_129523
atgcaaggtagctttgttccccatggtcgtgacgacatattaaatactgctattgggcgaccaaagcatccaggtcgtgttcatgcagtagggactggtgtcacaatcagtcaatattttggacaagtgtcacgtgggtccaacacttcctctgcatcaatcagccaacaaaaattggttgacataatcggaaagctgaaggaagagttgaggagagaagttgaaaaggaaaacaaaaatctgaaggaagagtggaggagacaagtgccagatattcaactattagctgcacgtgtcagcaccaaggggagttgttttgaagacgttgccaatccatcaggggaaaatgcaggtttaattatgccacctactatggggttgtatgttgaaggtgatcattttacacactttgttgccttaggaaaagtatatgacagggcgtccaccatatgcaacgtgccttatgcaaatgatgtggtgaagtctgtggttagatctgggtctggtgctgctaagacggagtctggaaagatggaacttgatattgaaggttccaaattttatctctgtgaaactgatgctttgaaagatgagattgttgatacaaacgaggaggtctctagtgcttctactggtgattttttaacaagcactaagccaactcttttggatcagccacctgtttctgctacttccatggataggtccaacttccatggattcattagttctagagttgatgcagtaggtcctgggtctttgccagtgaaaagctctgcaaagaatagagctcctaggcttcatttcactaattctgatgcaagtgctgtggataacccatctacattgatacataatatgcctaaagtggaatatgtcggaacaacaatctcgaggaaacaaaaggctgctgaagaaccttctttggatgtttctgtatcacaaagacaaaaaagttcattggaaaatactgagcataatatgaatgaagtaagaactggaagtggtggttggttggaagagaatactgggcctggagctcagtttacagagaggaatcatttaatggacaaatttggacccgaacccaaaaagactttgaatacagtcagtagttcctgtactagttctgataatttaaatgcaacaagcattagaaatgagcaagcaccaattacaagtggtaatgtgctagcttccttacctgctctattgaatggtgcagttgtaaatccaatcatgttggttaacttacttagaatagcagaagcccagcagaaatctactgattctacttcaaatatgatgctgcatccaacaagctcaaattcggctatgggaacagactcaactgcgagtattggttcatcaatggccactggtcttcttcaaagttttgttggaatggttccagtttcatcacaatcaacttccacgctatggaatcagccctttagaagtagtttgactatggccgaagccatattcacaagcttctgcacaatgtcatttctgtcccctaagggtgcttgtgtcgcaccagagaatttcttcttgtgggagaatgtacttgacaattgggatataagactcagcacaaaaagccaaggattgctacaactcatggtctggggcctgcttgatcaacccctcaatgtatctcagtgtgtcagttgcatttgcaagaatgttgttcaccaccaacaaagccacccctttgagataaatacgaaaaatgaggtaacattaagcaaaaagggcaacagaaatgaagagaaagaaagagttctaaagcaggcccagcccaacactcgcgctaagcgcgcgtcagacgctaagcgagcaaagaagccaggcgctaagcgaggcgttaagctcgaagaagcagaaaccgttatgcgcgctaagcccagctacgcgctaagcgcgcgatccaacagaagcacaggctaa

SEQ ID NO: 37839 - DNA, 912 bp, Glycine max
  Peptide Sequence Number=SeqID_129524
atggcgtggaacgtgttcaagttctgcactgctctgcgtggattgggctcgatcatgatcctgttggttcttggcgttgttggtgccacttactatgctgttgttttgaccaattatggccctgctttgtatgctggaggacttgattctcttgttgccttggcagtgttgatcttgtttcatagcttgttggttatgctgttgtggagttacttttctgttgtttttaccgatccggggagtgtccctccaaactggaagcctacaattgatgaggaaaggggagaggctgatccgttggttgggacagagtttagtaatctgccgtctgatcccaatccacgggttcggtactgtcggaagtgcaatcagctcaagccgcctcgatgccatcattgttcagtttgtgggcgctgtgttttgaagatggaccaccattgtgtgtgggtagtcaactgtgtcggggctctaaattacaaatatttccttcttttcttgttctacacttttcttgagacgactctagtgactgcatccttgctgcctcatttcatagcattctttagtgatggagaaattcctggaacacctggctctcttgctacaacttttcttgctttcggtagggtctcagaacatgttttaaacctggcctttgcactgagcgtcttaggatttctcatcatgcacatatctttggtggctgctaatacgaccactattgaggcatatgagaagaaaactactccaaaatggcgttatgaccttggtcgtcgaaaaaattttgagcaggtttttgggatggacaagaagtactggttcatccctgcttattcagacgaagatatacgaaagatgccagctctacaaggtcttgactatccttcaaaacctgacttcgattcccaatag

SEQ ID NO: 37840 - DNA, 513 bp, Glycine max
  Peptide Sequence Number=SeqID_129525
atgccacaaccacactccaccacatcatcaacgagtaccacatcgatggaatcgatgggtctcataaagggcctaagggaagctctatgcaccactgggtttgtggcttccttagctccagatgctgccaccaatgagactttctacttgcccttgtaccgatctattgataattcttggattggaactgttgtgtttcagtgcttcgttgatttcgaacctctagatcctaacagaccagttgaaagcttggtgcgccaggttgagaagatagtgggagagtatgattattatgactctaagatcttgcttggctacagcgccattaaggaggattggaataaagtttcaccacccctcttctttcttgctctcaatcgcctagtgcattcttggcctagggttaagggtgcatctgtcaaggttattagtgacacctatgccttcattcccccaacgtggatccctaaactcctgtctttggccgtctccgatgctggaaaatatccttaa

SEQ ID NO: 37841 - DNA, 1023 bp, Glycine max
  Peptide Sequence Number=SeqID_129526
atgattacattcaaggtgttggccattgccaaccattacgcgaagtgggcttgtctgttgacatggaaggcccagatgcgtgaccagctattcctgaatgaaattatgggtgcttcccccatcaatgaggatgatcacccggtggagggtcatcgccttccacaagtagaaggaagacccgagaggcacacttgtgccctcgatggtacttctcttcacatggagggtgggaacgtgggtggtgtgacggttgagggtgagggtaggcacaagggtgtaggtgggagagtaatgggggtggacgagttcgaggaggaggatgatggtctagcaatttttcctcctgcagacgagcaaggcccgcggcctgcggcctgcgccatggtcaaaggttacagtgcctgcacctcgcggtgtatgtcaggggaaaggccagagacgaagcagctgaggagaaaggcagaggacagtccgatgacacggttggcgagggcttcaaattcagacagaggctatggtcaaacgctcatgagcgggagtgccatggtactcgaaaaattggttgatcttaaagatccaaccagaggggtgaaagtgatggctgaggaaggacaggggttggtgacgtattgggtgaagaaagagggggtagacgatgaagaagttcatcgattttgctggtcaagcaccagaaatgttaggtgcaagctgaattacgaacttcgagggtcagctcctccagaaattcaagggggaaaggaagaattaacaagctcaaacataatcttcaagatgatagatggaggtgttgacgccaaaagggtgctggcagaagaggaggtggagacggcggaagggtttgaactttggatattgcttacacagagagaaggagtggtgcggcagatcaagaatcaggaatatgcatccttcttcaaaaaactgaaagtgaagacaattaaacgcagagtgaaagaacctttaacaccatcaagctcgtttggtctccagaatcagtcttga

SEQ ID NO: 37842 - DNA, 966 bp, Glycine max
  Peptide Sequence Number=SeqID_129527
atggattcttcaaaaaatttaacgcagcaaaaattgaaggttcaggggaaaggctataaagataaatgctatgagcaaataaggaagactgtagaaggacggtttaacaagcttctaaatgagcttgtgtttgaggacctgaaagcaactttagaggaagcacgagcaattggggaagagcttggagatgtctatgactatgtagctccctgctttcctccaagatacgagatattccagctactggtaaatctgtacactgagaggtttattcagatgctaagattgcttagcgacagggcgaatgaattaacaaacgttgagatattaaaggttactggatgggtggttgaataccaagataatctgattgggcttggagtcgatgagtctctagcccaagtgtgttctgagagtggtgcaatggatcctcttatgaattcttatgttgagagcatgcaagctacgactaggaaatggtacttgaatattttggaggctgatagaacacagccccctaagaaaactgaagatgggaagctatataccccagctgctgttgatctcttcaggatacttggtgagcaagtacaaattgttcgggataatagcactgatctcatgttatacagaattgccttggcaatcattcagatgatagatggaggtgttgacgccaaaagggtggtggcagcagaggaggtggagacagaggtgtcgcggcttcattactatggtttaatcaatgttctgagagaaggagtggtgcggcagatcaagaatcagggagaagagcctgttgatttgaggagatcacttaaacttttctcagattttacacaaaagattcttaccaagtatccgatggatacgaaggatatggatgtctccattgaatttgtatatgaattattcactagggttatgagggagcgtggtgctacatctgagaagctatttggatag

SEQ ID NO: 37843 - DNA, 345 bp, Glycine max
  Peptide Sequence Number=SeqID_129528
atgacgatggtggagattttgggtcgagagtcattcgattacttggtggtgaatttggttttgaacaagaatctatcaatggtgtttgggagtggcgagaacctgcagaacaagctgttggatctcacggagcacccaaactcaaagtatggggattgggttttggaatgggggcatgggtgttgtagggagccaagagagggagaaaagtttggagaagtgagaattgttgctgatggaaaggtgtggaggaagaggaagagggtgtcgcagaagctacacatgacttttggaagaaagggaagagggtggaagagagaagggcaaaaaagaaggatggaatag

SEQ ID NO: 37844 - DNA, 537 bp, Glycine max
  Peptide Sequence Number=SeqID_129529
cctgaagttgttgagaaacttgttggtctacgagaaggcattcctcggaaggatgccaaggaggtcattcaagagtgcaaagagatatatgagaattcacttgttgatggaagacctccaaaggcaggctccacattctaccttgaactttgcttctctgccatagcctatgagcccaacatcactcacaaagtcaccaaccattgcgacgtcatccaactctccctaagcgttaccttccgcgcggtgaagcacaactacttcatcatgaagaaactcctaaccaaacaggacctaatgaaacatgtccatgattgtctcgaaatcatagacgaaaccttcaacaagctaagagaaacacataatgaccttgaactttaccctaacatgaaaactctataccagcatgccaatgatcttaaaatcctcattagcgttgccataacaaaccaggtcatgtgcctcgatggtttctctcacgatgacacagacaaacacatgagagagacaaacctcaaagagaaagcgaggttgtga

SEQ ID NO: 37845 - DNA, 246 bp, Glycine max
  Peptide Sequence Number=SeqID_129530
atgactcaatttgttaagctcttactcaagagtcaagttctgatgggtagtgaagctaggaatgaagcggggagttcacaagaaaatgtgattcaagggagagaaaggaggcagccggcttggatgggagaatttgtgaatggtgaggggttgagtgaagaagaagcagaggcctacatggtgcaagatgttgtaggtgacgatccaactcagtttgaggaagctatgaagcatgagaaatggtga

SEQ ID NO: 37846 - DNA, 369 bp, Glycine max
  Peptide Sequence Number=SeqID_129531
atggcttccactgcaccaccgcaaccagcttctttggctgggcaaccacctctgatacacattccaccacttaacacttaccctcctcccaccacaagtccgtcatctccaatcgcacctgtaacttactctcatacaatcactgagaaactctacaacaataacgttcttcttcggcgcaagcaaatcaagcctatcatcaagactcagccttcaccattttctctattggttgacaattcaccccattttctcaccacagaagattgtgatcttggtagaatcaatgagtcctacgcagcatgggaacagcaagatcagttgctgttatcttggcttcaagcctctctccgattcaatcctatctag

SEQ ID NO: 37847 - DNA, 709 bp, Glycine max
  Peptide Sequence Number=SeqID_129532
cgtgattgtctttggtaaaaagatcgtccctttccgtagaaaaacgttgtctgcactctccagtgcttcatcttctctgacaatggtactttctctctctacattagggttttcttcagcactttcgcgcctaaacttcttcccaaagccaccaccttctcttttctccgcactcaccactttccgcagaaaccaacttccactcaaatcgtcgctcgccgcatcgaaacgtgacggcgatgttgtcgttttgggcatcgaaaccagctgcgacgataccgccgctgctgtcgtgagaagtgacggtgaaattctcagccaagtagtgtcttctcaggcagacctgcttgcgaaatatggaggtgttgctccaaaaatggcagaagaagctcactcaaaagttatagaccaggttgtgcaagaagcccttgataaagcttatctgaccgagaaggatcttactgctgttgctgttactattggtcctggtttgagtctctgccttcgtgggggacacaatttactcgttcttgctcgtgatcttgggcagtacatacaacttggaactacgatagatgatgctatcggtgaggcatatgacaagacagcaaaatggctcggactggatttgaggagaagtggtggtcctgctattgagaagcttgctatggagggtaatgctgaatcagtcaagttttctgtaagttag

SEQ ID NO: 37848 - DNA, 333 bp, Glycine max
  Peptide Sequence Number=SeqID_129533
atgccctcgatgatttatcatttgtgttgttttgctctaaccgaaggaaccagattgctgcaagtggaggtccttctccgaacccccctctcaactaaacattggggccacaagatgcactggttgatgtggtgcctccttcagaaaaagatcctaagggaaaatagaagaacaagaagcggagtcattgcgagcatcgaagtggttcggggtaaccttctgggaatccggagggtgatgatgccaccaattgggctaagttttgggcctttcttttcaaggcctcaaccgtggctcaacatctcttggggtccacgaatgttgatgctttga

SEQ ID NO: 37849 - DNA, 87 bp, Glycine max
  Peptide Sequence Number=SeqID_129534
atgaagcacttcactgacaccctcatcagtgcacatagaaacagctatgaccatgattacgccaagctcgaaattaaccctcactaa

SEQ ID NO: 37850 - DNA, 375 bp, Glycine max
  Peptide Sequence Number=SeqID_129535
atgaaggtgcaagggtggttttgcgacaggcacaagactggagtcgggagtgacgttgggattgttgagttcaactttggttgggatggggcatgcacggtggttttggtatttgtgagtggtagtggtagaggggatgggttgggtgggggagaaaagaaggtgaatgtgaagagaaatgctactatcaagccaactcaagtgaaagatcggataaactacaacacaatcatggaatgcaagtttatttgcgagaatagaggaacatcaattgttccattcccaatggtgggtgcacaactttcatcaaaggtgtcatcttcgttgttggcccactcaatcgttgttgatgtttttgtcaccgattttcactaa

SEQ ID NO: 37851 - DNA, 558 bp, Glycine max
  Peptide Sequence Number=SeqID_129536
atgaaggcatcgtcgaagatcaccgtagtgcttggggattgcaaggagcagtacaacaacgccttggagaacctccacagggccatgaaggtcattccgccacacgatctcagcaccattatcgttatgcttagtgttgttatggtgggtgtttctgtgtgcgataatgggtttgaggagcataagaaccctaaggactatgccaatcgctctaccattcagtggcatcgtgtctcagtttatcctcagaaattaagagaccttgtcaccgaacatgttgttcccaccctaaggttcatatactatcacagtgttgatcttaaaggggaaaatgagtacttgggtttgggtgttagtcttggtaatgttccaatgtaccatggaacaaaacttaaagtgttagatagaaaggtgaggataacagagttgatgttaaagtgtgtgagccgtagtcttagagttgttgcaattgttcttatggtgattgattcccaagtcaaagagtttttctcctttcaaaagaaagctaaacttacagacatgaaagctttagtgtga

SEQ ID NO: 37852 - DNA, 717 bp, Glycine max
  Peptide Sequence Number=SeqID_129537
atgaagacacctactcatggattcactaaacctattcagttgaatatcttcactgatggtttgagaccacaatccaagcaattgttagacgcttctactagaggaaagattaagttgaaaactccagaggaagcaatggagctcattaagaacatggctgttagtgatcatgctattttgcgtgatagaacacatatacccaccaaacgaagcctgttggaactctcttcacaagacacattgttggaacaaaataagttgttagctaagcagctggaatcactcattgaaacacttagcaaattgccaacacagctacaagtggcccagccttttcattcagttgttatgcaagttagaggctgcagtatttgtggaggagctcatgaatccagctattgtataccccaagatgattctgctaaaattagtagtgcagaactcaacatttgctttatttcaatccttataagtgtttacatactgaatatacatggtctaggtgaaacaaattccttgaggataggatactcgatcttaccgctttatatactacttggctgggctgagcctaagaaatcccagcctgcaagaatatgggccaagcttgggtcaacccgattgtactgtttggctcgatggatgaggtcgggcaaacccaacctgtccattttgctagccctaactaaaagtaaggggggaagtgcattagcatga

SEQ ID NO: 37853 - DNA, 1473 bp, Glycine max
  Peptide Sequence Number=SeqID_129538
atggtcacttatgtcgtcaccaccaccttgttcctcttccttgccatggccatcaccaccctttgcctccaagaaattgaggtgctccaaatggcccaaaaccatgtttctcaagccaagaatttgattggaaactctttgagattgcatggcttgggaagcctaagtctttctgatcaaacaagtgctacaatagcccttagtgattgtgccaaactctatgaggagagtgagtctcggctctctcacatgatggctcaagagagttactacgccaaagaagatgcactcacatggatgagtgctgtgatgacaaatcataggacttgtttggatggattgaaagaaaaagggtatattgaagctcaggttttggataggaacttgaccatgttgcttaagcaagctcttgttgtgtattcaaagaataataaaggcaaagggaaaggaccacctgagggaacaatatccaaatcagattatgctggtattttagaatcatggagtgaatcaagctataagccagatttcacagtggcacaggatggttcagggacacacggaacaatccaagcagcagtaaatgcacttgctgcaatggggcacaaccgtcctgcaagagcagtaatacatgtaaaatcaggggtctatcatgagaaggtggaaattggacagaaactgcataatgtgatgcttgtaggagatggcatagacaaaactattgtcactggcaacagaaatgttgttcaaggttctaccactctgaactcagccacatttgatgtatcaggggatggattctgggccagagacatgacatttgagaacagtgctggcccagagaagcaccaagcagtggcactcaaggtaagttcagacttatcagtgttctacaggtgcagcttcagagcctaccaagacactctctacgtgcactcaaatcgtcaattctaccgcgactgctatgtatacggcaccattgatttcatctttggggatgcaacagtggtgctgcagaactgtgacatctttgtgaggaagccaatgagccaccaatccaacttcatcacagcacaaggaagagatgaccccaacaagaacacaggaatttcaatccaaagctgcagggttaggccagattctgagtttctcacactcaaggaatctttcaagacatttcttggtaggccttggaggaagtactcaaggactgtgtttctgaaaactgatttggatggtttggttcaccctagagggtggggtgaatggagtggagaatttgcactctcaactttgtactatggagagtacttgaacacaggttatggtgcctctacacagaatagggtgaattggcctggttttcatgtgctgaggagtgctagtgaggccacacccttcactgtgaaccagtttctgcaaggggaaaggtggattcctgctacaggggtgccattctcttctggaatttaa

SEQ ID NO: 37854 - DNA, 275 bp, Glycine max
  Peptide Sequence Number=SeqID_129539
atgaagacttatctagatggctttatcaatcctcagggttggatggaatggagtggtaactttgcattgaacacactttattatggagagtacatgaacaatggtcctggttcttctactgctagacgtgttaaatggccaggcaaaagaagcaagggagatggggtggtgggtgtcaacatgaaaggaaagtgtgaaggaggtatagggaagggaggaaggaagaaaatcaaagaggtacaggaagcaaaagctgagaagaaaaccttcaacca

SEQ ID NO: 37855 - DNA, 729 bp, Glycine max
  Peptide Sequence Number=SeqID_129540
atgatgaaggcgtaccatgatcgaaagctagtgaagaggaacttccaaaccgaacaacaagtgttgttgttcaattcccgacttaagttgtttctgggcaaactcaagtccaagtgctggattgtcaatggccaaaggttgaagatctacaatggtggaaatattgagagattgccaccatcatccacctccaagacccatgaggatgtctcacgtcaagctagtgacgttaaagaagcacttactaggaggcaacataggatttctgaccttacccttatggcctctaagaaacgacgagcagctcctagtcagtctcaaggggcgaagcccgcatgggactcctcccattttgtttctgaggtcgcatggcaccgataccaagacaacattcacctccagaacattctttcagagtggaacaggaggcagtggcaccaacgcctctccaacttgcccgagaagggcatcgacctggcattggtgaaagagttctacacaaacatttacgattcgaaggatggctccctggagcagtgtagggttcggggaaagctcatcaagttcgatgaacaaacattgaatgttttcctagagaccctcgtcatcattccagagggggagagcctgaccaccttctctcagttcatgcacacctaccctaatgcccaaaccattgtggcaaagttgtgcatgtcgggtggtcattttgttctgaatgttgagtga

SEQ ID NO: 37856 - DNA, 546 bp, Glycine max
  Peptide Sequence Number=SeqID_129541
atgagggatacgaatctggagttgcaggaatcgggttgggaggagctgcgcaaggaagcgcgcaagatcgagggtgatctcgacgtcaagctctcctcctacgccaaactcggcgctcgtttcacccaaggaggttcaggttatgtagatagtggttcaccacctattgggtccagtaggtcttggaagtccatggaaatggaaatccagtctttactcgagaaactgttggacataaatgattcaatgagtagatgtgctgcatctgctgggccagctacttctgtaactcagaagttggctaggcacagagacattcttcatgagtttacccaggaaaagacctctgcctatgccctctcttctcaagatccgatatactatcttcaggtcattgcatacagccttacccttgcatatgcaaagaggctgtttccggattcgaactcattaccaactgggattggtgagacatctacggtagtatctgtagttgagtttggttcctataaaggaaaaagaggtggaccagggaatacttcatga

SEQ ID NO: 37857 - DNA, 474 bp, Glycine max
  Peptide Sequence Number=SeqID_129542
atggagcagctaaagcaaaaggctcaaggcaatcaagttatagtagaggtgccttttatactacttttgatatttatagcagagaagttagaaggcaattgtcttagtgtagccaattgtttatttaatgtaggagttgaggaaggatttttttgcaatggagaagggttcaagcctaaattacctaaagcatggagctcaatggattggtctcatggattcatccgcaataaggaattaagatgcgaaaacaagaacaatgatggatttaacaaattgactttgctgaaaacgcctgacactacacatagttggctggatcagacaattgggttagaggaatgcaaagtcaagtgcttggataactgttattgtatggcttacacgaatttggatattagtggacaaggaagtggttgtgctatgtggtttggtgatctaattgatattagacagtttgcagttggaggctag

SEQ ID NO: 37858 - DNA, 126 bp, Glycine max
  Peptide Sequence Number=SeqID_129543
atggaggaggagcgcgtggaggtgggagtgatggaggcgcatgaggtcgagggaggtgagaaaggggaacctgaggaagaggttcttgaggaagaagaagcaaatgaagaaatgtcacccaactaa

SEQ ID NO: 37859 - DNA, 459 bp, Glycine max
  Peptide Sequence Number=SeqID_129544
atggaggaatgcaaatctgttagcacactaatgaatcaaaaggagaagttcagcaaggaagaaggtgttgataacattgatgaaggatattatgggagcttgattggatgtctaatgtatctcactacaacaaggccaaacattctattttctcaaaatcacaaaactggaatttttgttgacaatcaagtagtcattgctattgcaaacaatcctgtgtgtcatgggaagactaaacatttcaatatcaagaagaacataataaagaacagagaaaaaatggtggccgacacaaagaatagaacttcaatggcatattataatagagaagagagggattggggacgtgtctgcggcattggcaacgaggaaaatgccagagagggcacattgcaaaggacagcgaagaaggaggacgacaacaacgacgatgagaggcgacaacattggcgacagtga

SEQ ID NO: 37860 - DNA, 313 bp, Glycine max
  Peptide Sequence Number=SeqID_129545
atggaggcaggtagtaatgcttcaattatatcccaagatgaagttcagcttaggaaatccttgcaggaacagctgtggagtgcagctcttgcctatgaatccatgcttaggcaaaaatccagagtgaagtggataagagaaggggatagaaactcatcctatttccacagaatcatcaatcgtagaaggaggaatcagtgcagaccaactctggatgggattcagtttaattctcttgatcaagggcagaggcaaagccttgttgctagattctcggaagggaaaatcaagtctgcagtttgggctagtgatg

SEQ ID NO: 37861 - DNA, 84 bp, Glycine max
  Peptide Sequence Number=SeqID_129546
atgttgagctgcttggttaacgttgcacaagctcaatctacaaacgccaccactgatccttccgaagttggtctaaaagactaa

SEQ ID NO: 37862 - DNA, 219 bp, Glycine max
  Peptide Sequence Number=SeqID_129547
atgcaaggcgtcaacactagtgactccacgcacacaacacaaggagttaactgtgtttatgccacccatcctcacgttggtgcactatcacttgaaaatgccagaaatgcccctgcaatgtttcgttgtggggatcaacttgatccacgaaagactcctacggatcaagttaatccgtgtaacagaggcgaaccaaacgcggatcaagttgatccgtga

SEQ ID NO: 37863 - DNA, 207 bp, Glycine max
  Peptide Sequence Number=SeqID_129548
atgaccctcactgctgtcaccactgctggccgcaactgtgacaatagtattggtggtgacaaaggttgtcacggcagtgatcatgatgatgtggtgatagtgacaacaacgacggtcatgttaatgataacgacggtggtcatagcgacgattatgatggtagtgattgcgacgatggtgatggttgtagtgacgatattgacgtaa

SEQ ID NO: 37864 - DNA, 537 bp, Glycine max
  Peptide Sequence Number=SeqID_129549
atgacaaccctagggacgaatagagagggagctaggctagaagaagaagcatttcctctactctctctctctatctctcgctctcgtctattctttagggaggctacttgggccttgaataccaagagtatgcgcgcagtattgtatgcgcgcttacaggaagaaaagctcatggatgctcgccggccaccaccatatcaccctccaacgaccatcgcgacaaccataaccactcaatcgccttcacccaaccctactccgcctctgttacctacacctcaacgcactacaaccacttccattccttttaaacgccttacaccggaagagctcgcggtttgctgggaaaagggattgtgtttccactgcgacgagaaattctctcgaggtcacaagtgctcatcttcgttgtttctcttggtaacagaagatgaagagcttacaccgcagttagcaccaccacgttcaccatcacctgatttactttcggaaccttctctagcacaactcagtttactcgccctgtctggccattga

SEQ ID NO: 37865 - DNA, 213 bp, Glycine max
  Peptide Sequence Number=SeqID_129550
atggctagcggcacagcgtgctccgcatgtgaagcggggtggccagaatggctagcgggcagggcaaggggagatgtgttggattacaagtgtgaggtgaagtcccacatcgaaatggctagcgggcagggcaagtaccgcaggtggccatggctatactcgtggatgataaaagagttcccaggttaccatgtgaaagagactcacacttga

SEQ ID NO: 37866 - DNA, 615 bp, Glycine max
  Peptide Sequence Number=SeqID_129551
atgcagttcttttcggagaaagaaaatcaagaaacacaccctggagaagggaacgctctagagaagaaccctcactgtgtcgccatggtgttgccagagaaggacaagcctgtcgaggacgtgcgacacagagtgaagaagaccatgaagcgtgagctttatattaaagcatcttcaaaaggacgaccctctacaatcagggaggttaaagctttgaacattggtcaacttgtaagaatttctggctacatctatatggaattccaattagttgatggtaatgatgatatgggagtttctggggatgtgggtttgagtacgtatgaagttcagatgcatcaagaaacatatgaagctctcatgctcacagaggaagtgtctcccagtgaacaacctgatctttttcttcaattagctttaacttcaacattctttgctgggatctttcaagccgctcttggaattctaaggctaggatttatcattgattttctatcaaaggcaatccttattggattcatggttggatcagctgtaattgtagctttgcaacagctcaagggccttcatggaatcaaacatttcaccaaaaagatgcaacagctcaaggactaa

SEQ ID NO: 37867 - DNA, 294 bp, Glycine max
  Peptide Sequence Number=SeqID_129552
atggtttctagaggtatcatccccttcgatagacatattgcggcagtagggactaccagcaacaatatgttatcaaagagaaaaactctagatgagggttcactgttatcaagcaagtcggagacccagcatgaccacagattcacctccactccttatgttcccatggacccggtccgcagtggagtcgccaactgtcgcaacctacccttcgacaggagggcgacgcgagggctcacgggtgtgtcttccatgggaggaaaatgcgcggagtcgccaccaacgtttatttga

SEQ ID NO: 37868 - DNA, 129 bp, Glycine max
  Peptide Sequence Number=SeqID_129553
atgaggtgtctccacgcgctatcaaacttgccgtctccggatagcaaagacttgccgtctctggatgatgaaggtgcggataaccatgaggtgtctccgcgcgctatcggacttgtcgtctccggatag

SEQ ID NO: 37869 - DNA, 78 bp, Glycine max
  Peptide Sequence Number=SeqID_129554
atgtccaacgttagccccgtcggttattcctccacaacaacaaaacgcaccacttgccttcagatggttgggaggtga

SEQ ID NO: 37870 - DNA, 177 bp, Glycine max
  Peptide Sequence Number=SeqID_129555
atgccaagtctctatgaccgaaccacaaagctggaagagactctagctcaatttatgcaagtgtcaatgtctaaccaaaagaccaccgagtctgcaattaagaatctagaagtccagttgaacttgaagaaattgttgaggaagcagaaggtgatgaagaagaagagacaccaataa

SEQ ID NO: 37871 - DNA, 126 bp, Glycine max
  Peptide Sequence Number=SeqID_129556
atgacagggaagttgataggaagaagtccgaccttaacatggctggactttgtggagtgtccaaaggttcaagatgaaaaactgaaaaaccttgagatggacttgatggtgtgcgctatggtttag

SEQ ID NO: 37872 - DNA, 587 bp, Glycine max
  Peptide Sequence Number=SeqID_129557
gattctacccgccgctcgatgggaattgcgcttcaaggcgtctcgtagggctaatccgcctcacgagggtcaccaacggcacgtgcctttggggggccgaggccccctactgctgggtaaaactaacctgtctcacgacggtctaaacccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataa

SEQ ID NO: 37873 - DNA, 441 bp, Glycine max
  Peptide Sequence Number=SeqID_129558
atggctacaccacccagctcccctcctcctcctcctcctactgattcaacatcacattcacgttctaccatgaagaggacaagaaaagtgacccgactaagaccattggctactagacctgttggggcaaagagacccctgttcaagtctgatttaacatcgaaatgggcacttgcaaccgacaaggacggtgtcgatgacactgtttgcaaaaagtacgacattagcaagtggacccaattttgtcagagccacaaagacccttcgtgggaggtacagaccattcagaaacaaaacactgcccctcacgtgttgtctcgtggggattatgaatttgtaaaaaaaaagttgatggatgagaagaaaaagaaacaattggaggaagctgctaaatccagaagcactaacactgtgattgatcctccatctcccaacagatga

SEQ ID NO: 37874 - DNA, 438 bp, Glycine max
  Peptide Sequence Number=SeqID_129559
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatgggccgcgtttgtctcattccacgcctgacactcagttccgggtagggcagttcgcttccaagctggactgtatgcacgaaccccccgttcagtccgaccgctgcgcctttatcccggtaactatcgtcttggagtccaacccggaaagacatgcaaaagcaccactgggcagcagccactggtaa

SEQ ID NO: 37875 - DNA, 87 bp, Glycine max
  Peptide Sequence Number=SeqID_129560
atggaggcggtttcgatgggtctggttgcaggaatcgatgcagggacgcagagtctgaaggtgctggtctatgacccgcggaagcag

SEQ ID NO: 37876 - DNA, 831 bp, Glycine max
  Peptide Sequence Number=SeqID_129561
atgtccgagtttatgatagcctgcggcttcgactacaaaatgtctgtcgagaaagcctattccaccgattccaacatgctgggcgcgacgcacgaagcaaaagatctcgaattccttaattccagcgtgaaaatcgtcaacccgattatgggcgtgaagttctgggatgaaagcgtaaaaatcgccgctgaagaagtgaccgtgcgttttgaacagggtcatccggttgcgctgaatggcaaaacgttcagcgatgacgtcgaactgatgctggaagctaaccgcatcggcggtcgccacggtctgggcatgagcgatcagattgaaaaccgcatcatcgaagcgaaaagccgtggcatctatgaagctccggggatggcactgctgcatatcgcctacgagcgactgctgactggtatccacaacgaagataccattgagcaatatcatgctcatggccgccagttgggtcgcctgctctatcagggtcgctggttcgattcccaggcgctgatgctgcgcgattcgctgcagcgttgggtcgccagtcagatcaccggcgaagtgactctggaactgcgtcgcggcaacgactactcaatcctgaataccgtttcagacaacctgacctataaagcagagcgtctgactatggaaaaaggcgattccatgtttaccgctgaagatcgtatcggccagctgaccatgcgcaacctggacattaccgatacccgtgagaagctattcggctatgcccaatccgggctactcagcgcgtcttccgccatcggtctgccacaggttgaaaacctggaaaatcgcgataaataa

SEQ ID NO: 37877 - DNA, 450 bp, Glycine max
  Peptide Sequence Number=SeqID_129562
atggagtttatttctattttagaccatactcctctagttgtcaccactgaggtggtagtgcctagagatggcttgaagcaaaatattcatggctgtagcatgttcaaggtctgtaagaaattgaaagctcttaaagctccattgaagaatctttttaagcaggagttcagaaacatctccaaccaagtggagctagctgaggctgaatataacagtgtgcttaattctctaatgcaaaatcctcagtatccttcccttcttgctctggcaaaccgcactagagggcagaccattatgcttagaaaagcggagtctatgaagtttgctcagctaatcaaaaacagatatctcctgcaggctgataaatgctccaaattttttcatgctttaatcaagcgcaacagacacagtcgggtttattgctgccataaggctagaggatgggcataa

SEQ ID NO: 37878 - DNA, 108 bp, Glycine max
  Peptide Sequence Number=SeqID_129563
cgtctcgatatatgatgctgtcgcaacctacccttcggcgggagggcgacgcgtgactcgcgggatgcgtgtttccacgaaaggaatacgcgcggagtcgccaccaac

SEQ ID NO: 37879 - DNA, 375 bp, Glycine max
  Peptide Sequence Number=SeqID_129564
atgttggggattggatcgacttttggtcgtcctcctgttcttggttggaactggttatgtgactcagatctggttagtcctactggaattgaacgggttctaaccgaaaaagaccttctggctgacgcatattcagacctagaggcttctatccttgatgaaaaagaatttctcctattgaaggttatctctacctttccggagttatcttgcttaatatgctctatggttggagcgggttggggaatagacggtgttgccttatccataactcatctttcgggaagagttacttcatcccattttatttttcttggaagagaaacattagccttcgtcatatcagtgataaacaaagttgtttctcctctttga

SEQ ID NO: 37880 - DNA, 301 bp, Glycine max
  Peptide Sequence Number=SeqID_129565
gcttatccagctgggtcatttgacacagagcggtatttatggcatttggttcgccagcaggcagccaaccacagggcgcacatgcagacccatgactgtctctaccagctcagcctcagcttgcagagccagggttttgcttcttttccatgccctactccagatcagtttagggcagaggtcgcatggcccggagattggcctgaggcccaggcaagggaggcgcccgcagaggctcccggggatgcagatgaggcccgcatggacgaggagatgacagatctgctcgattttttaggag

SEQ ID NO: 37881 - DNA, 213 bp, Glycine max
  Peptide Sequence Number=SeqID_129566
atggtgagaatagatgtgatttgggaacctaccagccaaggatgtactcgtgaagatgctgatgagttcattttttgtagctacaatggacacaactgggtatcttccaagattgatgccgcactgggcattgtgagtcacaacgatgactttcaatgcggtgttggacccaaattcagagtctctctggtggagcacgctgttgcagcgtga

SEQ ID NO: 37882 - DNA, 549 bp, Glycine max
  Peptide Sequence Number=SeqID_129567
atgggtgaccaagaggagatacaggaacacatgaaagtcgacatgtcggctttgaaagagaaaatggcttccatgatggatgtcatgctaggaatgagacaacttatgaagaataacgtggccaccgctgccgctgttagttcggctgccaaagcagacccaactctcctagctacccgcaccatcctctcccaaacgtgtaacccccatctgggatacaaccgagtgtcttacccttatggattaccgcctgattacacgccaccagtcatgcgtgacgacacgggacatgtcccttcccccatccttgaaggggagtttcctcgacagtcggacgaggttcacgaggatcatagagagcatgcccaaggagacatcgatttctacccccggtccccgtcgaggggccgacacccaacacactacctcagtccaacctcacggggaagcctcgaaacctcccagcacagccaatattcttgtccgcagaaggaccacccccgacagcggaagagaaaaggaaactcgatctcatcgaagagagattga

SEQ ID NO: 37883 - DNA, 363 bp, Glycine max
  Peptide Sequence Number=SeqID_129568
atgccttcttacacggggatcttgaagaagaagtctatatggaatgacccccaggacatccaaaaagttcaaattcttccttgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtg

SEQ ID NO: 37884 - DNA, 792 bp, Glycine max
  Peptide Sequence Number=SeqID_129569
atggcagaggatcattcttctcccggtgtgcctgttgcagtagctacaggttcccctggtgtggctactaggatagaatttgagtctaatcctaatcagcagttgagctctattgtactaaatgagttcaattatcttccttggtcaagagtcttaactcttgcttttggtggaagatctaaattgagtttcattgatgagaaagtttctcctccagatgaaacatctcttgatgatgaatcttggttgtccaaagacgaactagtgcagtcatggattcttaattccacaagcccgcatcttgctgagattttcagctatccaaattctgttgtgcaactattaaccacagttcgtgatattctaaaaagaatgtggaatgaacttgaggtgtatcgtccacacattcttgatgttgctatacttcgtaaaggtgttgaagaggacataattttccagttgctagcaagtcccgatcctgaatatgaagatcttcgcagtcatattcttatgtccccggaactcccggagataagggagtttcaagttctgcaaattcaaattccacaactcttcttggtaagtttcttggtttcttggggaacttcgagcttccttttcatgaaagcaccaaagatttcaattctttttactccatctcatgtgtctgttgccaatggatatgttgttcctgttattgggaaaggaaaacttaagctattccctaatgatttggccttgtatgttccttcttttcctgatcagttgctctcgattcaaaaactcacctaa

SEQ ID NO: 37885 - DNA, 594 bp, Glycine max
  Peptide Sequence Number=SeqID_129570
atgattgaaccctttatctatcccgctgccacgctgattgccggcgtggacgaagtgggccgcggcccgttggtcggcgcggtggtcaccgccgccgtgatcctcgatccggcgcagccgatcgtcgggctggcggactccaagaaactcagtgaaaaacgccgcctggcgctttatgacgaaatcgtcgccaaggcgctctcctggagcctggggcgcgccgagccggcggaaatcgaccagctgaacattttgcacgccaccatgctggcgatgcagcgggcggtggccgggttgcatatcgcgccggacatggttttaatcgacggtaaccgttgcccgaacctgccgatgcgttcgcaggcggtggtgaagggcgacagccgcgtggcggagatcagcgcggcgtccattctggcgaaggtcacgcgcgatcgtgaaatggccgcgctggacagcgagttcccggactacggtttcgcgcagcataagggttacccgaccgccttccacctggagcggctggccgcgctgggcgccaccgagcatcaccgccgcagcttcgcgccggtgaaaagggcgctggcgctgtag

SEQ ID NO: 37886 - DNA, 80 bp, Glycine max
  Peptide Sequence Number=SeqID_129571
tgaatggttgcttcttgaatgtgaaaggaagtgatgatatgaagagcctcaacgtgaatagttgtggaagtaaccgaagg

SEQ ID NO: 37887 - DNA, 138 bp, Glycine max
  Peptide Sequence Number=SeqID_129572
atgaccataatttgtctctgcgtgccaccggacacaactgtgtctgaatggcaaaaaggcccgccgcctctggatgacaaaagggcgcagaatgaccataatttgtctctgcgtgccaccggacacaactgtgtctga

SEQ ID NO: 37888 - DNA, 105 bp, Glycine max
  Peptide Sequence Number=SeqID_129573
atgaagtcgttgagaggaaaggagatcgcattggtgaagtgtatatgcatatatgttcttggtagaaataggagtagtgggggcaagatacgcgagttaggctaa

SEQ ID NO: 37889 - DNA, 234 bp, Glycine max
  Peptide Sequence Number=SeqID_129574
atgcaagtgctggaagcaaccatcaaagccaccacagagaagaaaatggagctggaacgcctgatcaaaaggctctcagacagtggcattgatgaagaagaagcagctgtggaagaagaagcagctgaggaggaagaagaagcagctgagaatgaagaagaagcagctgaggaagaggaagatgcagcagaggatacagaatcagatgatgatgattctgatgccaccccatga

SEQ ID NO: 37890 - DNA, 303 bp, Glycine max
  Peptide Sequence Number=SeqID_129575
atggaggttgaggaaacctaccgggggttatggctaccattgcattatcaagtagataagggagctctttgctgcaaaattccttccttggttggtgttttgacaggctctgtggttgatttagggatggcctttgcggataactgggtggtgggtaaggaaaaggaggtttgttattggttgagtaatgacattgtttgggttggtgggaaacttggccgtataggaatggcagtcacaaacatgggtttctccctcattctcaccctctttattagcccccagttttctcagtcgtcctag

SEQ ID NO: 37891 - DNA, 294 bp, Glycine max
  Peptide Sequence Number=SeqID_129576
atggagcattatctacagcacttggttcgccagcaggcggccaaccaccgagggcaggtgcagatacatgagtgtctctaccggttcagcctcagtcagcagggacagggtttcactccttttgcatgccctactctagagcagtttggggatgaggtcgcatggcccggagattggcccgaggcccaggcaggggaggagcccgcaggatcccccagtgaggcaaaggaggcccgtatggatgaagaaatgacagacttgcttggtttcttgggaggaagcggagtcacgtga

SEQ ID NO: 37892 - DNA, 264 bp, Glycine max
  Peptide Sequence Number=SeqID_129577
atgcatgttctgcatagtcatttgcctcacaagttcttcgagggaaggaatgtatggtctgcttgggccagcagcattttggaaggaaggagcaggctgctgttgttgttgctgagggttggaccatctgaggctactcaattgctccaggttgctgcatggaagggcaaaggtctgtatggtggtcagcagaggagcacaaaccaaaaacccttgcgacaggtacagatttttgattcaaggccagctgggttaccaagttga

SEQ ID NO: 37893 - DNA, 561 bp, Glycine max
  Peptide Sequence Number=SeqID_129578
atggagacgtgtttggaagtagaggaattgttgcaacggatgatagaccaaggtcgactagaagtcggcattaaaggaaaagaagagccgcatatatgcatgcaatctacggaggggagcggtattgcgaagcccaaacccttggtgatatactttactaaaagtgcagcctcgcaaaagcctgggcatcccttaatggtcaaacctgttcctttcccgtaccagaatagtcacgcggtcccgtggagatatacacctccggagaagaaggaagaagaggtcacagacgtcagctcgctgtcggctaaagtaacaaatatcacgggactgagtggtgtgacccgtagtggtcgtgtgttcgcacctccggacctaccggtccaacccgccgacgtcaagggaaaaggaaaggtggtggaggaacaagatggcgaagcaccccacgcttcgaataaagatattccagcaaaggggcccccagagaaaagggatggtagaaaggaggtgtcgctagaggaagccagcgagttccttcggataattcagcagagcgaattcaag

SEQ ID NO: 37894 - DNA, 1018 bp, Glycine max
  Peptide Sequence Number=SeqID_129579
atgggatttgttacctggtgggagaaatattattcgggccgttcggttggagacacaactatcatgatctccagacttgagagtggttttacacaaccaacggtcgagaatatccgctcaaaccttcaagctcgaggcaaaacaatcatgacaaagaaaattgctgaaacgtctcgagctgatgtgagacccaagaaacccactggggtgaagatccaagaatggaaacaagaagagaagaatcataagaaagatgatagcaccgagactaccacgacctcaaaacgctcgaagcgtgtggtcatcgaattcgacgaagaaaaagatgcaagttttattcctaatgaagaagaggaaagacctctcgtaagaaaaagaaaatcacctgagacttcgaccaaatctgctgaccaaacagaggcaggcgattcccaggctcaaatgcctaagaagaaaaagaaagtgaagcagatcgagcctgaaccttctgtgacggtcgagggtggtgagccagtcaggaagaaaaagaagaagaccaagtcttcaaaagaacaaggtgagaatcaacctgctgacgtccaaccaccttcgactgatgttggcggcgctgaaacagaaactactccctctattgctgagatgggcaaccttgtcgaacaaccggacttaccacaagaacaccctaccgtcgaggtacaacaaaatgtttctgtagaagaaataccctcatgtgctcgaacctctcctgctcctgagacggatgcagtgaatgttgaggaacagggtgaaggtcaaggtattggacccagcagtcctcagggatcgaatcagagaagttcatctgaagaacacttttccgatgaagaggccatacaagaggctgaagctggaggttcagacattttcccagcgtcttcgacatctaagctttccgctagcatagggatcgcagaggatacattcattcaaatgcaagacgaagaccctgctgcagcccttcgactcctgctgaacacca

SEQ ID NO: 37895 - DNA, 162 bp, Glycine max
  Peptide Sequence Number=SeqID_129580
atgagttgtacagcgcacgagcacgaacaaggccaccaatttaaacctgaaatcagattttgtgagggcagtttggactgggattcagagctttgcatgcccagggtttctagagagagaaagagaccagagcttgaagcaggagccggtttgagagcttga

SEQ ID NO: 37896 - DNA, 756 bp, Glycine max
  Peptide Sequence Number=SeqID_129581
atgcggaacaggtcgccggcaaagatcgctgcctcgtcgccgccggtacccgcgcgcacttccaggaacaggttgccttcgtcgcgcgggtcgcgcggcaccagcagcagcgccagctcctgctccagttcctgcaggcgcgcctgtgcagcagcgatttcctcgtcggccagctcgcgcaggtcggggtcggcgcgcatgccttcggcggctgccagatcggccttggcacgggcttcatcagccagggcgatggcgatcggttcaagttgggcgaattcgcgcgaaaggtcgcggaaacgagtgttgtcggcgaccacatcgggttcggcgagcaggcgttccagttcttcgcggcgctcggccagcgcttccagcttacggcgcagggtcggcgtcatcgggtctcacgggtgggtggcggtaacccggcgtggccgggaacaggcgctcggcggcgcgggtcaggtcggcatcgccactcagcgcggccgcacgcagggcggcggtcggcggatgcagcaggcggttggtcaggccgtgggcaagcagttccagcacttcatcggccggcttgccgttggccagttgctggcgtgcgcgctccagcagctcggcacgggtggcttcgccgaacgcgcgcagctgccgcagcggcgcctggtgggcgctggcctgctgggtctcgacgaagcgcgacacctgcaggtcgatgatcgcctcggcttcggcggcggcctcgcggcggccacggcg

SEQ ID NO: 37897 - DNA, 261 bp, Glycine max
  Peptide Sequence Number=SeqID_129582
atggtcaacataattaagaatagggcatcagggcccctctctccgatcaatcgtcggagattgataggtcagtgcttgagttataagaggaaaaggcacattcgggaaggtactccactgaaggaacatcttgatgagctaaactctgttctgatggagctacgtgacattgatgtcaagatggaagacgaagttctaaaagccatgcatccaatagctcatctgataattctctatggtatttgcatctgggccacatga

SEQ ID NO: 37898 - DNA, 291 bp, Glycine max
  Peptide Sequence Number=SeqID_129583
atgacaaaatatgtttatcttgacaatgaaggtcatcagaaggatgatccttctgttaagtatggtattgatgtagcaacatgggcagaatttgctaaaagtcgccaaacccctacctggcagtggttatttgtaagggaatacggaaaaaggctcaggaaattcaaaaatacaattactgcccccacttactatctcgtgggggttatgatctactggaaaaaaacctattggacgaaaaaaggaagacacaagaacaacaagcaaaatttactaaaaattcttcactga

SEQ ID NO: 37899 - DNA, 324 bp, Glycine max
  Peptide Sequence Number=SeqID_129584
atggatgaagatcaatggacatatgacaatacgatgtctcaagaagttgatatggattatgaaaatgaacaagaatgtggtgtgaatgaaccgtcacatgttgattgtttagatgcttttaatacttctcaggtctttggtacccgagatgatgttttacagtgggctcgatcggttacctatgaaaacggatttgttgcaatcattatgagtcagtataagtgtaggaagaaagaatttgttagaagagacactgggagtaggaaatgtggttgtcccttcaagcttcgtgggaaaccagtgcatggatgggaaggttggatg

SEQ ID NO: 37900 - DNA, 237 bp, Glycine max
  Peptide Sequence Number=SeqID_129585
atggaccacaacttcctcactagtccatccagtcagaaaagtctgaaccatcctctaggaatgagtatcaaaggtggtgccggtggagctggtggaggtggtagaatctcaacctccggggaagctggtggatctaatactgggggtcgcgactcaactggtgcaggctctatccttgttggtatgggactgggggcacaacctcggaagatcttcctaacgacagctgagctttag

SEQ ID NO: 37901 - DNA, 708 bp, Glycine max
  Peptide Sequence Number=SeqID_129586
atggctgaagtcgtcagcgaagagagtttcgaagcaccggaagaggacgaggaagtccaagctctcaaaagcgagttaggaaaggcgaaacttgccaaggagaagttcaagttggccgctacacacatccggaaggagtgtgccggattacgggaagagaatgcaaccaccgcacgggcccttgaacaagagaccaagagggctcgcaaggaagagtatggccggaataaatttcgcggagctctgtggggtagcaacagtgaactcaagctgcgaagggaagagagggaccagtcgcgagcccacagcatggtcttgaaagaggagttagttgcctgttcaaggtccaaaaagagcttgtctcagcgtttatgtgagacggagaccaacatgctagctatcatcgccaagtaccaagaagagttaggtctagccacggcccacgagcataagatcgcggacgagtatgctcaagtatacgcggaaaaagaggctagagaaagggtgatcgactctttacaccaagaggcaaccatgtggatggatcggtttgctcttaccttgaacgggagtcaagaacttccccgcttgttagccaaggccaaggcgatggcagacacctactccgtccccgaagagattcatgggcttctcggctattgtcagcatatgatagacttaatggcccacataattagaaatcgttag

SEQ ID NO: 37902 - DNA, 285 bp, Glycine max
  Peptide Sequence Number=SeqID_129587
atggtgaaagttgacctctacgtgccgatcaacgtctcattttcgccaaaagttggcccagggcttcccggtatcaacagggacaccaggatttatttattctgcgaagtgatcttccgtcacagctgtccctcctgttcagctactgacggggtggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 37903 - DNA, 336 bp, Glycine max
  Peptide Sequence Number=SeqID_129588
atggcccaggaactgataaaaggaaactactggccccttaaccgggagcgcaagtcttggttaagcatccaagggcaaaggaccttatattctcctaaggtgtggatatggagcacactgaaaatgttgacacgtagccctctaaaggcaagggcgtgcaaccctctgcaggcgaggatgtgcagtcctctgatggtgaggacatatagtcctcttaaggtgataggtactagtacccaagggtccacctttatgagaaagcaagagatcgactcatcgagagggccgatcatccaaaaagattggacacgagatgtaggaaatctatgcagttaa

SEQ ID NO: 37904 - DNA, 296 bp, Glycine max
  Peptide Sequence Number=SeqID_129589
gtgctcatatgggacaccttaggtttatcatactttttggtaggagtaatcagcatgaaaatattaaaaaaggggttcccacgaaccctaagagaataaaggttattcctgagttgtccactccaccaacaccactcattgagttggtgaggaaccatgttccctcatgggaagatgcccaggaaatggggggagagaatgatgcaatcctactcccaaaggcattggatagaagactccaaggagattgggatagagatgcaagagaaggccctagggttctcataagccttagg

SEQ ID NO: 37905 - DNA, 395 bp, Glycine max
  Peptide Sequence Number=SeqID_129590
ttcgccgtcaaatcccagggctcaaccctggacaggcggtggaaactaccaagctggagtacgagacgaaagctaggggagcgaatgggattagataccccagtagtcctagccgtaaacgatggatactaggcgctgtgcgtatcgacccgtgcaatgctgtagctaacgcgttaagtatcccgcctggggagtaccgaagaaccttaccagggcttgacatgccgcgaatcctcttgaaagagaggggtgccttcgggaacgcggacacaggtggtgcatggctgtcgtcagctcgtgccactgccggtgataagccggaggaaggtgaggatgacgtcaagtcatcatgccccttatgccctgggcgacacacgtgctacaatggacgggac

SEQ ID NO: 37906 - DNA, 519 bp, Glycine max
  Peptide Sequence Number=SeqID_129591
atgttttctcataaggtggacccttgggtactagaacctatcgccttcagaggactacacgtcctcgccttcagagggctacacgccctcaccctcagaggactacacgtcctcaccttcagaggactacgtgtcctcgcctttagaggactacatgccctcaccttcagaggaggactacacgtcctcgccttcagagggccacacgccctcacctccagaggactacatgtcctcaccttcaaaggactacacgtcctcgccttcaaagggtcatgtacctatgtctttgtaaggctacacgccctcaccttcagaggactacatgtcctcgcctttagaggactacacgtccccacctttagagggatgcacgccttcgccttcagaggactacatgtcccccttttcaatgggctacacgccctcgcccttagagggcgacacaccctcacctttagaggactacacgccctcgccatcataggactacactccctcgccttcaaaaggcgacac

SEQ ID NO: 37907 - DNA, 309 bp, Glycine max
  Peptide Sequence Number=SeqID_129592
atgaccggaaaagcgattcatgtgatgtgcgtacatctgggcctgcgtgaggcgcaccgtcaggcgcagcttgcgatgctcgccgaatgggtgaatgagctaccggacggcgaaccgccggactggatgagatttttacccgcgcccacggacgcccgggcgcgcacgtttccggtgcaatttcctctactacgactggacaggatctacgtcaaaaatgccagcgccagcgcgccaaccgcgttgccgctgcggacatggcgacacctttctgatcatgcccctttaagtgcggagattcatttatga

SEQ ID NO: 37908 - DNA, 318 bp, Glycine max
  Peptide Sequence Number=SeqID_129593
atggagaattgcactaagcaatcactacgcatgactccaaactcgtgggtggaggatcgcatgaacgaaaacgcaattcatggggctccgaaaaaggggttgagaatggagaattgcactaagcaatcactacgcatggctccagaactcgtgggtggaggatgcatgaacagcgtaggcaaaaaattcatggggctccgaaaaaaaagtttgagaatggagaattgcactaagcaatcactatgcatggttcctaaactcgtgggtggaggacgcatgaacgaaaacacaattcatggggctccaaaaaagggttga

SEQ ID NO: 37909 - DNA, 63 bp, Glycine max
  Peptide Sequence Number=SeqID_129594
atgaaaatacagaaaaaggtgttgagggaaggagcccagagtatgaagaacctcgggatttga

SEQ ID NO: 37910 - DNA, 210 bp, Glycine max
  Peptide Sequence Number=SeqID_129595
atgggtgaccaagaggaagtacaggaacagatgaaagccgacatgtcagctttgaaagagcaaatggcttccatgatggatgccatgctaggaatgagacaactaatggagaataacgcggccaccgctgccgctgttagttcggctgccgaagcagacccaactctcccagctaccgtgcaccaccctatcccaaacatgctaggataa

SEQ ID NO: 37911 - DNA, 1002 bp, Glycine max
  Peptide Sequence Number=SeqID_129596
atggcttcgagaaagatttccacaaagcgatctaggaaggacgccacgaccgaaggaactagtgccgctcccgagttcgatagccgtcatttcaggagcgctgaacaccagcagtgtttcgaagccatcaagggatggtccttccaccgagagagacgcgtccagctcagggacgatgagtacacagatttccaggaggagatagctcgtcggcgttggacgtcgctggtcactcccatggccaagtttgatccggatatagttttggagttttatgccaatgcttggcccacggaggagggcgtgcgggacctacggtcatgggagtgcgagtatagtcagagaaggaaccgggccgatggatttgacgaggaggccattgcccagttgctatgcataccaggtcaggatttttctcggaccgctgccgggagacgggtgcggatcatgcgcaccaacatgactaccttgacccagacatggatgacgttgctcctcagcaacatcctgcccagcgatcataattctgacctccctctgcagaagtgtcagctggtgtatgccatcctgacacggatgagcgtccatgtggctcagttgatcgctgatgccatttatttatttgcagccttgatcacgagtctctgccagtcattcggggttcccgtcacacctagtaaggtgatccggccgtcgatcacccgagccttcattgagaagtattgcacacctagacaggcacagggtgatgcaccgcaggccgcagatgcaccgccaccacctcatcaggctgatcccgctgggtcatttgacacggagcggtatttacgacatttggttcgccagcaggcgaccaaccacagggcgcatgtgcagacccatgactgtctctaccagctcagtctcaatctacagagccagggtttcacttcttttccgtgccctactccagatcagttcagggcagaggtcgcatggcccggagattggcctgaggcctag

SEQ ID NO: 37912 - DNA, 285 bp, Glycine max
  Peptide Sequence Number=SeqID_129597
atgagagcggtgttgccccagttgacgttcgcactgaagttcggtaaccgtgttggtgccgttgttcgtgataatcttccttggcaaaccatatcggcagatgatctctttcttaatgaacctgaccaccacacccctcgtgacattggtgtaggaggccgcctcgacccacttggtaaaataatctatcgctacgaggatgaagcgatgaccattcgaggccttgggctcaatggccccgatgacatctattccccacatggagaaaggccaaggggcggatga

SEQ ID NO: 37913 - DNA, 189 bp, Glycine max
  Peptide Sequence Number=SeqID_129598
atggagaggatccaaaagtccacttctggtgataactcccaagggtggtttcatgaactatcaacaacaatgcatcaccaaaagaggaaaactttagatgaggcttcactgttatcaagcgagtcggagaccttgcatgaccacagatcgacctccactccttatggctcacccgggtatacgccctaa

SEQ ID NO: 37914 - DNA, 246 bp, Glycine max
  Peptide Sequence Number=SeqID_129599
atggaacggtatctacacacttggtcacagcaggtgcccaaccaccgggggcagggccagggtttcgctccttttacgtgccctactccagatcagtttagggctgaggtcgcatggcccggagattggctcgaggcccaggtaggggaggcgcctgcagtagctcccggcgatgcagaggaggcccgcatggatgaggagatgacagacttgctcggtttcttgggaggaagcggagccacgtga

SEQ ID NO: 37915 - DNA, 246 bp, Glycine max
  Peptide Sequence Number=SeqID_129600
atgaaagtttgtatgatatatatttcgagtgtgtgtaggaaatggccccaaggaagcttgcctcaaagagatccaggaaggataaagcggctgaaggaaccagttccgctcccgaagaagacaaccatcattttaggagcgctgagcaccagcagcgcttcgaggccatcaacggatggtcatttctcagggagcgacgcgtctagctcagggacgacgagtataccgacttccaggaggagatag

SEQ ID NO: 37916 - DNA, 483 bp, Glycine max
  Peptide Sequence Number=SeqID_129601
gattgttactgcttaactgttggaacagttgacgaaatcatcattgatgctccatggagttatgacagttgtcctaactgtacaaccacatttgatccatcaaaaggtggcccagcttgtcgttcttgccataccagtgtgatcgatacagttccacagatggagcataatagggacaaaggaaacttccttctctgggatgcaacatgtatcaagctatttggtaagactgctggagaatgtcgagatgagttgatagcggctgtcagatttaagtttcgttcacaattacgccaatcatctgtgttggatgtgagtgaagaactccatcatattcaatcattgatagccacccttgggttgaagccatcgttgtcacagtcttctgattacgatcccggaaactccacctgtttaactccaaccaaaaggattaattgtcagcaaaccagttctaattttgattctgatgagcatacatag

SEQ ID NO: 37917 - DNA, 492 bp, Glycine max
  Peptide Sequence Number=SeqID_129602
atggtcattgaccaatccctcttctatgatttgacccaattgcctagtgaaggtgtaccatttgaaggtacactggatgatgattggaaatttgatttttctgtgcatgatgcccgccggttggtttgcaccaaccaagcggatatgaccggaaggctgcttgccgattcattggctcttgaaagccacatccttcactatcttattgttcgtatcttactctcaagatcttcaaaccttgcacaggtttctgaagaagatcttatagtcatatctttcttgatcggtgctgctgtggttgcgtcctttggttaccgcaaagagcgtgatggctcttgggtaaaaaagggtactcaacctaatgatgatgaaggacaattaccggttgaaggcgactcttctctgcttcagagtattttggacaggtttgatggacttcaaacctatgttggtgaaaggtttgatgctttggaacgacaagtggacacgtga

SEQ ID NO: 37918 - DNA, 863 bp, Glycine max
  Peptide Sequence Number=SeqID_129603
ccttcagaggactacacaatcctctccatcagaggactgcacgtcctcgcctttcagaggactacatgccctcgccttcggaaggctacacgccctctccttaagaggactacacatcctcacctttagagggctacacctttcgccttcagagggctgcacgtcctcacttcagaggactccacgtcgtcgccttcagaggactgcacgtcctcaccttcagaggactacacgcctcactttcaaaggactacacgtcctcgccttcagaggactgcacgtcctcgccttcagaggactacatatccttgcctttcagaggtctacacgccctcagccttcagaaaactacacattcttgcctttagagcggttacacgaccctcgcttttcagaggactacacgtcctcgccttcagaggattgctacctcccctcttcagagggctacacgccctcgccttcaagaggactacaccatgtcctcaccttcaaagagggctactgcccttcgccttacagaggactacactcctcgccttccgagggctacacgccatcgccttcagagggactgcatcgtcctcccttcagaggactacacgtcttcgcctatcagagggatactgcatcgctcaccattcagaggactacacgccctcacctttcaagaggactacacgtcctcgcccttcagagggactacacgtcctccccttcagaggactacatacgtcctcgcctatcggagggctacacgcccatcgtcaccttcagaaagggctacacgtctgcctttcagaggtctgctacagaccctccgtcagaggactacatgtcctcaccttcagagggctacacgt

SEQ ID NO: 37919 - DNA, 149 bp, Glycine max
  Peptide Sequence Number=SeqID_129604
ctggccctagaggcaatgttcaagcagagctattattccgaaaggataacgcaacttttacttctgacaagggttgggcttttcctagaaggatctacttcaatggtgacatgtgtttgatgccaccacctgatgcttatccattttaa

SEQ ID NO: 37920 - DNA, 423 bp, Glycine max
  Peptide Sequence Number=SeqID_129605
atggccgaaaagggaaagggcggatcatctaaaaggaaaggctcagggccattgaaggaggtgctggactttgacaagtacaaggggactacttgtctcaagaaccatctaaagatgtattgtcagaagatgggggaatacgcaaaagatgaggaattgctgatacattccttcctagaaagtctttactggggtagctgttacctgaaaatttgcaaaaagggggacggatctttcaaagaacacgcccaaaaggtggagggatctagcggcccaagtggtacccccaatgatggaaagggagacgatgatcgtgatggtagacacattatcgatactctactatggaaagatggtgggctacgcaccctcaaagctttgcggatttggtcttcgccagtgaaaggatcgaagttgatctga

SEQ ID NO: 37921 - DNA, 339 bp, Glycine max
  Peptide Sequence Number=SeqID_129606
atgccttaccttctttccaaagccgtcaatcacattaagaattccttttctttagatgcctgtacctctttctttttactccgactcgacttcaaaggcacagttgactcgaggtatgaaaggattgaaccagagcctgagggtgaaaatctagaggaaagtctccccgttgggcgcttgtctgattgggaaagaggctatctgagagttccgacttcgataggtcctaattccccaaagcaggcttggcatgacgcccattgtcacttccttttcagtttatgcgcaaggtttttgcctttcaaaagaatccgacgcggaaagcgtcactcaagctga

SEQ ID NO: 37922 - DNA, 246 bp, Glycine max
  Peptide Sequence Number=SeqID_129607
atgcaacagggacaggcagatatcctcatagctaggttccctgaccctagctatggtgttaaaacggacgttagaaatggctttggaagaaagaaagaagaagaaatggtgtttttcctaagctacgtgaaagcaaaggctgaaaacgctcaagtgagaaatggtctcggacacagaaacgtcgcgcacactccaaacatcttctctacgatcccaacggtcagaccgtggacaagtgtcttgtga

SEQ ID NO: 37923 - DNA, 504 bp, Glycine max
  Peptide Sequence Number=SeqID_129608
ggccttgggatttcccgccttgatcacaggactctgccagtcgttcggcgccccgtcacacctagcaaggtgattcggccgcccatcacccgagcttttattgagaagtactgcacgcagagacagatccaaggtgatgcacgacaggccgcggacgcgccgccacctcatcaggctggtccagccggattgtttgatacggagcagtatttgcggcatttggttcgccagcaggcggccaaccaccgggcacatgtacaggcccatgattgtctttatcagatgagtctcagcctgcagagccagggctttacttcttttccgtgccctactccggaccagttcagggcagaggtcgcatggcctggagattggcctgaggcccaggcaggagaggcaccagcgggggcaccagcagaggctcccgccgaggcagatgaggcccgtgaggacgaagagatgaccgatttacttgatttcttaggagggagcggtgccacatga

SEQ ID NO: 37924 - DNA, 261 bp, Glycine max
  Peptide Sequence Number=SeqID_129609
atgatccaaagggaatggaggaaggaattggcgtttcctgtgacccgaaatgccgttgactccgactcaaagtgcccttttgcttcttcgaagggatgcattgtaatcgattacacaaatatggtaatcgattaccagaaagcaacattgccagaaataactgcttgtaatcgattacactattatggtaatcgattaccagtggttattttagccagaaaacaaaaaccaaaaggctttctaggagaaaagaaattttga

SEQ ID NO: 37925 - DNA, 150 bp, Glycine max
  Peptide Sequence Number=SeqID_129610
atgacttcgcttgttcgtttggcacggtcagcgcatgatataatgtttgttcatgcaaagcaatgggcaattccatatattagtagaatgcaggaatacacaagcttgatgtcattcaaaacacactatgtagacctaaatgaagactaa

SEQ ID NO: 37926 - DNA, 350 bp, Glycine max
  Peptide Sequence Number=SeqID_129611
atgggatcaagtcaaacgccttcgcttaaaaagaggttctatcaagtcaagctccaacggcaagcttttcgtaaagcttacggtaaaatctgggacctagccatggtagaagtctccacagaggccattgcctccctcgcccagtattatgatcagccgttgaggtgctttacctttggggatttccagctgtcacccatggtggaagaatttgaagagatcctaggatgtcttctagggggatggagaccatacctcttctcagggttctatccctcaccacagaaagcaagtcggaaatggggtggttggaatatcgagaaaatatttggaggcaaaagcagaatctg

SEQ ID NO: 37927 - DNA, 87 bp, Glycine max
  Peptide Sequence Number=SeqID_129612
atggagaaaaatgaagaaacaacaatggaagagaagcggaaggcaaagaagaagaggataggggaggcaccatccactagggaataa

SEQ ID NO: 37928 - DNA, 453 bp, Glycine max
  Peptide Sequence Number=SeqID_129613
atgagaatttccatcctcgcccttggaagaaaacaaaaaggaaagagaagttcccgatcaaaggtcggaagaagacaaaagaaaaagaaagttcccgatcaaagatcgaaagaaagcaaaagaagaaaattcccaatcaaagattggaagaaagcaaaaaagaaagaaaaattcccgatcaaagatcggaagaaaactaaagaaaatatacagaaaggtctttggaccagacaatatctaaacaatacacaattgtcacaagcaaacaagaaaagaaaggaaaccacgactggaagtggtcctctccctttgattaccaaccaaaatcttgtgcgctggcaactttttcgccccgcactaatcaaaagcagaaaaggaaaaagccaaaacactcaaagccaaatttccctccataaaacactactcccaaagaaaattcctattgatccatga

SEQ ID NO: 37929 - DNA, 480 bp, Glycine max
  Peptide Sequence Number=SeqID_129614
atggtcattgatacacatggtgcacaagataagaaagcttgcactcaatgtagatgtgaccatatgaatctcccgaaggacttttataatgtcacaagggatatacataaccaaaaattgactacaaattataaaggaggtctcttttgttgtcaggacaacttacaatgcaagcaagtagagggttttcaaggttcaaggagaatggtttccttaagatacaaaattagttgggttgattgggacatataccaaataccagttaaggtttacatacttgattccaccgacaaagtgaggtcaaatggttccaaaatacttcatgattgtctggcagagtataccattccagcaacgggtggtggtggtgatactcctcatgtccaaaaagcaaacatcccaatggaaaaaggaggttatctaatttatggcactactcatatgcattcaggtgttgtaaatgcaactttatatggacag

SEQ ID NO: 37930 - DNA, 538 bp, Glycine max
  Peptide Sequence Number=SeqID_129615
atgcagatgacaaacagaggtagaggtagtggtcgtagaacatttaatcgtggtacaagacatggtacccacagtttgagagctccaattaccgccaatccttccccctcatccattcacatatcaacctcagagtcaatgattcatgttgttgcacagactccaaacacacttcctacagctcaagaccaaccaaatcctacctttgtaagggagtcaattcctactacccctattagagatgcttcaccttcagcaccagatgattctgttacacctgagtacccaacaaatccaaattatgaacatattgttaatgaaaggcctttcattcgtgcatataaaggagagtttcaaccaacatatgggtgttgtaatatcatatcaaatattattagggcaaaatttgatgaactagctccaagttggttgaatgtgtcagttgaccttcgcgataggtggtttggagagtttaagaaagagtatacatggcacccacaagaagagcgagccattagagctgtttttgagacaaaag

SEQ ID NO: 37931 - DNA, 309 bp, Glycine max
  Peptide Sequence Number=SeqID_129616
atggaaaaatctgaaaagaaaaatcatagtgaaaagaaactgaagaaagcatacattacatgggatgaaaatgatatggaatcctctgaagattctgaaaatgaagagataaatctctgccttatggctaaaagttacgaaagtgatgaagaggtatctttgagaaagaagtggtacatagatagcggatgctcaaaacatatgactggagatgcatcaaattttacacatatctctccaaagaaaagcgggcatgacttaagcatagactgcttagcgttagtcaactatgtgacaaagactatctag

SEQ ID NO: 37932 - DNA, 285 bp, Glycine max
  Peptide Sequence Number=SeqID_129617
atgcggaggaactcgcctgcctactctagagatacttctttcttgccacaaccatcctttttcttcggaagaccttttactggaacatcctcggggtgcaaacacgcgaccgctgcgggtcacgccgctcagcctcgtgatattggtttaactaccgaggggtatcgaagcatttggggagatgcgtctctggtgaaatataccaccaaaggattaggccttccaaaacttctctcatttgcgactgcatacatatatgctgctcttcactcccctcattgctga

SEQ ID NO: 37933 - DNA, 348 bp, Glycine max
  Peptide Sequence Number=SeqID_129618
atggtcattattgtcaatgcggaagcttgtggttacgtgagcctgaactactaccaatatatagatgttgtttatacaaatgagcacatcgtaaaagcttactccgcacaatggtggcctcttgggaatgaagcggttattcctccttctaatgacgcatggacacttatccctgacccaacaacaattcgtgcgaaaggtcggccaaaatcaacaaggataaggaatgagatagattgggtcgagccctctgagcaccgacaaaaatgcagtagatgtggagccgaagggcataacaggcgtcgctgtccaatgcaatatgagcgtgggagttgttcaactcgttga

SEQ ID NO: 37934 - DNA, 798 bp, Glycine max
  Peptide Sequence Number=SeqID_129619
atgttgcggctgatattctctctcgttttgcaggaatacaacaaaatgaaaccttgtaaggtttcctaccaaaacataaagcagaagatgaagttcggtaatcaagaattgccgataaccaaggagttcatcttcttacaaaagcctctccttctggaaaaggctatacagcttttgtcctgttatcaggaccacataaaggtgtttataccaatttcaaagacctttgccttgcaaagggagggtattcaaagcccaatctacaaaggtttctattcaagggaagaagcagaaaaagcccttgaattaaataccacagacattaacaaaataaaaaggtctcttgaaccagaaaacccaaccataatcataaacgctggccaaaccaagaccagccaaaagacctacaaagacacggtcagcccaaataccccaggctcaacaaatgacctaaacttagacaattttaagaaaatacaaagtttattgtttaaggtacacaataatcaaacccaaattccgggattatacataggcgtacatgcttattttaaccaaaaatttgtatgtattaataaaaccccatattgccaagacaaaaccaattgtccttgcaagataaaattcctctttaggaaagccaggctagacatggaccagtttaaatctttcggatatgaagacttagcaatttctgcaaaaagtctattggactacggatgtttggaatcaatcctgattcctccatctgatagattcgaaggatttaatccctcaatcaatgaagccataaattga

SEQ ID NO: 37935 - DNA, 836 bp, Glycine max
  Peptide Sequence Number=SeqID_129620
atgggtcaacttcaacggcaagccttctgcaaagcctatggtaagatttgggacctagctagggtagaagtctccacagagtccattgcctcccttgcccagtattatgatcatccgttgaggtgcttcacttttggggacttccaactatcacccatggtggaagaattcgaagaaatcctaggatgtcctctagggggaaggaaaccatacctcttctcagggttctacccctcattggccaggatttctaaaaaaaaaagtccaaatctcggcgcaggaattagaccgccaaaggcaagtcgaaaatggggtggtcggaataccgagaaaatatttggagtcctctttccaaatgtggatgggttggtggacctggcagcgatcgacgtttttctcgcctatcataaccacaaggaaagtccgctctctatgtggggctggtttcacacctttttctccaagaaaggtaggcccgtctatccgctacaaggttaccgctcgtgcgtcgaaaaaggaaaggcgaattgggaccaactcttggctagcatgggggggcgtctgttaattggttccctcgctaagaaggaaggaagaatcaagattctatcttcatgcgaaggatgtccaaatgttcccttgatgggaacaagggtgaccacaacgcgagggtactccaaggagtttgcaaggcatgggatgcggcgtgaagaaaggacagagagcttaggggaagcagtaatgggatcatcggttaaagcttcggaagaaagtgatgaggtacaagccctaaaggcagagcttgaaagagcctgggtagtcgaagagaagttcaa

SEQ ID NO: 37936 - DNA, 372 bp, Glycine max
  Peptide Sequence Number=SeqID_129621
atggtggattacacaccttcaagctttgctgatttagttttcgccgatgaaaggatcgaagcgagtctgaaaagaggcaaatttaatcatcctacttggacgaatgagaaaactggggcaaatgaagagggtgagatgaaggagaaacccatcctgcgattgtcgttcctacatggaaacttcccaccagccaaacaatgtcattactcagccaataacaacccttctccttacccaccacctagttatccacaaaggccatccctaaatcaaccacaaaacccaccttccacacaaccaatgctaaacaccacctttagcacgaaccaaaacaccaaccaagaaatgaattttgcagcaaaaagcctgtag

SEQ ID NO: 37937 - DNA, 424 bp, Glycine max
  Peptide Sequence Number=SeqID_129622
atgcatagatctcccacaggcaatttagttcctctggacttggaaattgaagctacattgagaaggaacagggccgagaggagaaggaaacttctacaagatagaacagttacatccattcttgaggaagaaactgatttttctgattcattatcacctgattcaccatcatcaagggaatccactactcaattgcctgaaaccactatcatggtagacgagcaacaccagaggatcacccttgaggattattcaagcagctcagtaccacaattctttactagcattgcacgtcctgaagtgcaggctcacaacatcaactatccgcattctttaattcatttaatacaaggattacctaatgaaggcgcctatgcacatttggcaacgttcattgaaatatgcaacacttttaagattgtcg

SEQ ID NO: 37938 - DNA, 627 bp, Glycine max
  Peptide Sequence Number=SeqID_129623
ggtggagagcgcgacgataatccaactggtgcgccgctgctggcgatcgaagttgatgtcggtattgcgcgtcaggcgctcgaccggggtggtgagcacccagccgacgatctggttgttgtagcggatcgggtggcgcggcccctctttcggcagggggccagaatgcccgaccaaacgattgaactggctgtccaccacccaaaactgggtgcgccagcccttgggcggcagattgtggctgctgtcgctgttctgctcgaacgagcgcatgatctggtagaccacctgatcgttgttgcgcaggaatatccagttgccatggtggctgtactgttcctccagcgcttcgctcagcatgttgatgcgttgctcgttgctgctcttgatgtaatcgataaagccgcgctcaaagctgacgcgcaccccccaatgcatggtgatcaacaccagcatgcaggtagcgaaaatggccaggaacagtttcccggtaatgcctatcctcattgcaacctcgttgagccggtacccggctctttggtcagcgtgcggttgggcgcgctatcggccggcacgcgcgcgaaggccagcgcgggcagagcgataatcaacgccatacagcagtag

SEQ ID NO: 37939 - DNA, 135 bp, Glycine max
  Peptide Sequence Number=SeqID_129624
gggcaggatcgtcttgagctatcttctgggatagagacaaaacatgaacagcagaaatcaatcaaggtacttaggaacggatgcaagtggggatggagtcacgaccgactgatcgttgccctttccctgcgctaa

SEQ ID NO: 37940 - DNA, 420 bp, Glycine max
  Peptide Sequence Number=SeqID_129625
atggtctcccgtggcagaggcgaaagggacgagtgtttgtttcacctcggggagtcgcacgacatggaaacctgttccgcggtagaagaattgcttcagcagctcatggattgggggcagcttgaagtgtccaaaggagagagggaagaaccacaaatttgcatgcagtcggaagaaaagaaggttcctctaacccccaaggccctagtaatatgttttactaggaaggggaccggctccacacccgtatacccccggacagtgtccaagccgacgccttttgcatatcaaagcaataaggccgttccgtggaagtatacccctcccgcgttcagcgaaagagttgcaactgaagttgactccctgtcaactaaggtgaccaacatcaccggcctcagtggcgtgacccgcagtggccgg

SEQ ID NO: 37941 - DNA, 201 bp, Glycine max
  Peptide Sequence Number=SeqID_129626
atggccaagaattatgaaagtgatgaagagatttccttgaagaatagttggtacatagatagtagatgctctaaacatatgacaggagatgcatcaaaattcactcatatttctcccaagaaaagcgaacatgtgacttatggtgacaacaataaaggtagaattcttggagttggaaaaatagaaggattgcccatataa

SEQ ID NO: 37942 - DNA, 297 bp, Glycine max
  Peptide Sequence Number=SeqID_129627
atgaatatgagatttcagaagccgcgcgagttcgaaaaccttgccctacctcttctctttgtcatcctcctgcctgaaattgctgttctctttctcctcccgcccgaaatctgccggaaaccgctccgtcgacacccacattgtcattggtcaaacccacagaaccccctacactgccggaaaacccacattgtcatcgctggaacccacaaaaccccctatgctgccggaaaacccatattgtcgtcgctcaaaccccacagaacccacattgtcctaggtcgaagaaaaccctag

SEQ ID NO: 37943 - DNA, 600 bp, Glycine max
  Peptide Sequence Number=SeqID_129628
atggtcatagatcagtcctttctctttgaactcactcaattatccaatgacggtataccgtttgagggtacacttgatgatgagtggaagttcgatttttttgtttctaatgcccgccggatggtttgcaccaaccaagcggatatgaccggaaggcttcttgccagttcattggcattcaaatgccgcatcatgcactacttgattgtgcgcatcctactccctagatcatccaaccttgcacatgtttctaaggaagatttaataattatgtgggttttcttaaccggtcgtcaaatcgactgggcccatcttagatctttctctatcggtgcgaatgtggtctcctcttttggataccgcaaagagagagatggttcttgggtgaagaaagatgctccagtacaggccgttgaagaccattctccatcaccgcctcctcagagagatgattcttcatctcttatgcacaacattcttgacaggttggatggactcgacaccttcgtcagtgaacgctttgactcattggacagtcgtattgatgctatggatgcacagtttgcaggaatggatacacacatcagtgggatcctctag

SEQ ID NO: 37944 - DNA, 148 bp, Glycine max
  Peptide Sequence Number=SeqID_129629
ctggacgccttatgacttgtcggtcactgacctagtactttgcttacctttggctttggacttggtcgcctattggtcggtgtcataccctaatttcgtccggggacctttgcttgatgacatgcgacctttctttggtccttgtgag

SEQ ID NO: 37945 - DNA, 519 bp, Glycine max
  Peptide Sequence Number=SeqID_129630
atggccccgaggaaacttgcctcaaagagatccaggaaggataaagcggccgaaggaactagttccgctcccaagtatgatagtcaccgctttaggagcgctgaacaccagcagcgcttcgaggccatcaagggatggtcatttctccaggagcgacccgtccagctcagggacgatgagtataccgatttccaggaggagatagttcaccggcggtgggcatcactggttacccccatggccaagtttgatccagacatagtccttgaattttatgccaatacttggcctacggaggaaggcgtgcgagatatgaggtcttgggtaaggggtcagtggatcccgtttgatgcagatgctatcggccagctcctgggatatcctttagtgctggaagagggtcaagagtgcgagtatggccagaggaggaaccggtccgatgggttcgatgaggaggccatcgcccagttgctatgtataccggggcaggattttgcccggactgctgtcgggagacgg

SEQ ID NO: 37946 - DNA, 957 bp, Glycine max
  Peptide Sequence Number=SeqID_129631
atggccaagtttgacccagacatagtcctggaattttatgccaatgcttggcctacacaggagggtgtgcgggatatgcgatcttgggtgaggggtcagtggatccctttcgatgctgatgccctcagccagttcctgggatatcctttagtgctggaggagggccaggagtgcgagtatggccaaaggaggaatcgagccgatgggtttgatgaggaggccatcgcccagttgctgtgtataccggggcaggattttgcccagactgctgctgggagacaggtgtggatcatgcacaccaacatgactaccctgacccagatatggatgacattgctgctcaacaacatccagcctagcgatcataattccgacctccccatgtcgaagtgtcagctggtgtatgccattctgacgcggatgagcgttcatgtggctcagttgatcgctaatgccatttatctatttgcaggtatgccacctaccaggcaccctttagacccagataattctaacagggccttgggttttccgggattgatcacgggtctctgccaatcgttcggggttcctgtcgcacccagtaaggtgatccaactgccgatcacccgcgctttcatagagaagtattgcacagctagacaggcacagggtggcgaccctcaggccccagatgcaccgccgccacctcctcaggctaacccaactggatcatttaacatggagcgacccatgactctatatcagcttagcctcagcctgcagagccagggttttgcttcttttccatgccctactccggatcagttcagggcagaggtcgcatggcccagagattgtcctgaggcccaggcaggggaggcacccgcagaggctcccgacgaggcagatgaggcccgcaaggacgaggagatgaccgatttgcttgatttcttgggagggagcggagccacatga

SEQ ID NO: 37947 - DNA, 741 bp, Glycine max
  Peptide Sequence Number=SeqID_129632
atgtctgaggtgcatggtacttctatggtcattgatcagtcactattcttttctttgactcatttacccagtcaaggtgcaccttttgagggcaccattgttgatgactggaaattcgattattcgagtcatgatgctcgtcgcatggtctgcaatgatcaagctgaaatgaccggtagattgttggccgggtcattaacttttgataatcgcatcatgcattatatcattgttagaattttgcttccttggtcttcaaatttagcacaagcctctgaggaggatttgattcttatgtgggcttttcttaccggtcgtcagatcgactgggcccatttggttcggtaccgaatgcataaggcattacgggccaatgcacctcttccttatccacaattgattactctgtttttgcgtcattttcaaattccgcttgatgatgaaccctttgttcaagtcaagcgttcttttgcaattggtgctggtgcagtgacctcctttgggatgcactccctcctcaaagatgaacgtactccttcacctcctcctcaacgtgaggattccgcactcatgaatgaagtcctctccgaattacggggtcttcgttcgtatgttggtgaccgcttcgactcgttagattcacgctttgccggtatggacattcgtcttacacagcttgaagaggatgtcggatacattcgtcagagtttcgatcttccaccaccacctccgtcttcttag

SEQ ID NO: 37948 - DNA, 219 bp, Glycine max
  Peptide Sequence Number=SeqID_129633
atggtcctcctggttggacattcagaagaaatatgtcctctgcctaagcacttgaagcattttatgtttctggttccagtattggatgaggaagtggaggtgttatgtttgcttccacctacactggacgctgctgactttccctgcggggatgtggctgcagggtggaacgaattacctccctccttcttggatctgttggcccagttctggttgtaa

SEQ ID NO: 37949 - DNA, 615 bp, Glycine max
  Peptide Sequence Number=SeqID_129634
atgtataccggggcaggattttgcccgggactgctgcaggatgtcctggacattatatccgacgatcgtgcaatcgcgcagccaacatttgacctttaccctgcagcccagatattcttggatgacataacgttggactcatgtgcagcaactccagctttccttcattgtctaagaaatggccccgggacttgcctcaaagaggtccagtgttggacagtgctctaccgaaggaactattccgcccggagtatgacagtcacccgggcttttattgagcgctgtacccagagacgcttcgaggccatcaagggatggtcatttctccgggcaggcgcgccccccccctcatcaggctcaggggacattgacagagcagtatacgcatttttgccagcaggaaatagggccaaccaccgagcacactggtacggacccatgattgtttgtaccagaatgagccttgagcatgcagagccagggcttcgcttctttttcatgccctactccagaccagttcagggcagaggttgcatggtcccggagatggccgaccaagcaggagaggacccccagaagctccggcgatggagaagaagcccacgaggaatgtga

SEQ ID NO: 37950 - DNA, 246 bp, Glycine max
  Peptide Sequence Number=SeqID_129635
atgacatacatgcaaatcgtaatgatcatgatgaaggtctatgggagaacattcccacataactgcgttgagtcaaaggtcattggaacactgccaaggtcccctccgcatccagaaggtcattcagagataatgttcaggaagagtagacaatcgacacggctaagaaggttgactttaggaaccttgcatcagccaaggtcggtagttcacatcaaccttgtaactaggagaggatcaagctaa

SEQ ID NO: 37951 - DNA, 279 bp, Glycine max
  Peptide Sequence Number=SeqID_129636
atggccgcttttagagagaaaaaggtagcgacggacttggttccacagcggcgcagctcaccacctcaaaagattggaaaagtcgtttccaatgattcttccgctgcttctacgtacggtgcggaggaggggcagctcactaacatatcctcttcacccgacactatcactaaaaagtccacccactgcgaacttcaatttttggtgaagtgtcgaagggaccactcccagggcatgaatccaaggtctccccaagaggcagctataggcgggatttga

SEQ ID NO: 37952 - DNA, 276 bp, Glycine max
  Peptide Sequence Number=SeqID_129637
atgtcccaagtggagtcgccaactatcgcaacgtgcccttttgcgggcgggcgacgtgtgactcgcgggatgcgtgttccacgaaaggaatacgcgcaaagtcgccaccaaagtttatttgaggaaaacgtcggaaaaaccgaaggaaaaccggacaaaaaaaaaattctaagttcgggagttgtatttacgcttgaggaaggtgatcattttaaggcgttggaccttgaaaatgatccattttacttagtaagaaacagaaatgataaactttga

SEQ ID NO: 37953 - DNA, 309 bp, Glycine max
  Peptide Sequence Number=SeqID_129638
ggtccgttcttgacgtcgaagaacacattggagaagggaggaatccaatcgggaaaataacaaagatcacatttcccagtcaagagggtctgctcttgacggtgaataacacgttggagattggaggattcaatcgggaaaataacaaagattacatttcccagtcattagggtccgctcttgacgatgaagaacatgctggagaatggaaaaatccaatcgggaaaataacaaagatcacatttcccagtcaagagggtccgttcttgacggtgaagaacacattggagaatggaggaatccaatcgg

SEQ ID NO: 37954 - DNA, 204 bp, Glycine max
  Peptide Sequence Number=SeqID_129639
atgtcatcaagtttcaccgagatcgacagacccttggcatcactctacgatcttaaatcgggaaagtttcacttggttttgggttttgatgatgccaaagtagaatcaaacaacaaggttgtttcaacaaacattcaaaattcaaaggttaagcattgctttaagattaatgcaaggttgcttcaacaaacattcaaaggttaa

SEQ ID NO: 37955 - DNA, 1097 bp, Glycine max
  Peptide Sequence Number=SeqID_129640
acttagccgccattgatgctttcctcgcatatcaccatagcaaggaaagtccagtggtggctatcttggcagatttgtttgacacctttgaccggaggtgtgagaaaaacagtgcacggattgtctgttgtttacccgctctctgtgtgtggttaatttcacacctattccaacaagatacaagacacccgtgtccgcttcaaagttattgctcatgcgccgaaaaaggaagagtcgattgggaccagcatttggctgggatagggggcagcgcgatcaattggtttcctcgttggaaggaaggcaaggaaggagttcttttctcgtgtggggaataccctaatgttccattgatacggactagggggtgtattaattataatcccgcactcgccataagacagctagggtaccccatgaggggagcgccaacggaaaggagtctctcacctttccttgtgaaagatttaggcacgcaaggtctcaaggttatacaaagaatccacaaagcgtggaggagtccgttgaagaaagacaaggagcttaggggcatccgtaatggcgtcatcggaggttatcatggatggctaagaattcacacgcgagggttagattggctctccaaattgaaagttatcgatgaggagaacttcgaagctccggaggaagatgaagaagtccgagctctaaaattagagcttgggaaggcaagattcgccaaggagaagttcaaatcagctgctacacacatccggaaggagtgcaccgagttacaagaggaaaacgcggccactgcaagagcccttgaacaagaaaccaaaagggcccgcaaggaggaatatggccgagagaaattccgaggagcattgtggggtagcaacaatgagctcaagctccgaagaaaggagagagatcggtcacgggtgcatggcatgatcttaaaagaagagttagttgcttgcgcgaggtccaaaagaagtttggctcaacacttggaagccacggagcaaagcatgctagctatcatagggcaatacaaggaagaattgaaccagtctatggcccatgaacaaaagctagtggaggattttgcataa

SEQ ID NO: 37956 - DNA, 510 bp, Glycine max
  Peptide Sequence Number=SeqID_129641
atgttggtaagctgcccctcctcggcaccatatgtagaggcagcagaggaatcattggaaacaactttccaatccttcgaggtggtaagttgtgcctctgtggaaacaagtccattgctaccttgtctctctaaggcggccctgatggtggcgcgggtaatgctcaggcacggttatgagcctggaatgggtctgggcaaggacagccacgggaatgccaatgtggttgacgttaggggtaacccgcacaaatatgggttggggtatgagcccgggaaacctggaagaaggaatgcaccatcaagactccgggcagatagggcatggcccggtcatgttagccagtgtttcacaagtgccgagataatgttcgaggaagaggttgcggcaataggagaagaggctccacaagatccgccgagttttgtgcgaccgtgccatcccaatttccaaccggggatctggcacgtgacgagccagtcggaagtctataccgctgattcaatgtaa

SEQ ID NO: 37957 - DNA, 660 bp, Glycine max
  Peptide Sequence Number=SeqID_129642
atgaccaccctgactcagatctggatgactttgctgctcagcaacatccagcccagcaaccataattccgacctccccctgccgaagtgtcagctggtgtacgccatcctgacacggatgagcattcacgtggctcagttaatcgctgatgccatctatctatttgcaggtatggcgcctaccaggcaccctctggacccggataagtccaacagggccctgggatttcccgccttgatcacaggactctgccagtcgttcggagtccccgtcgcacctagcaaggtgattcggtggcccatcacccgagcttttgttgagaagtattgcacacagagacaggcccagggggatgttccgcaggccgcagacgcgccgccacctcatcaggctggtccagccggatcgtttgatacggagcagtatttgcggcatttgatgagcctcagcctacagagccagggttttacttcttttccgtgccctactccggaccaggtcagggcagaggtcgcatggcctggagattggcctgaggcccgggcagtagaggcacctgcagagacaccagcagaggctcccgacgaggcagatgaggcccgcgaggacgaggagatggccgatttacttgatttcttaggagggagcggagccacataa

SEQ ID NO: 37958 - DNA, 83 bp, Glycine max
  Peptide Sequence Number=SeqID_129643
atgaccatgtcatacaaggatttgcacgagatgctcccattcgcgttacatggttaccgaacctcagtgcgcacatcaaccgg

SEQ ID NO: 37959 - DNA, 252 bp, Glycine max
  Peptide Sequence Number=SeqID_129644
atggcttaccatgctagctcaaaagccaatcaaaattcaatgaaaaatcatgaaattcattttggcaagagctactcaatagaaaactttcaagggggaccagagttacaaccttactatcaaaatgaagcagaaagaggttccaatctggataatttgttgatgcaattcaaggaaacaactaaatcaactcaacgagcactccaaagtgtagaaatccagaggttgaagctcaagaggaaaaccctataa

SEQ ID NO: 37960 - DNA, 731 bp, Glycine max
  Peptide Sequence Number=SeqID_129645
cggatctccagctacattacaatacctcgccccttatacaggagcagctctggctgaatattttatgtaccgtgaacgtcacactttaatcatttatgacgatctctccaaacaagcacaggcttatcgccaaatgtctcttctattacgaagaccacctggtcgcgaagcttatccaggggatgttttttatttacattcacgtcttttggaaagagccgctaaattaagttctcagttaggcgaaggaagtatgactgctttaccaatagttgaaactcaatcgggagatgtttcagcttatattcctactaatgtaatttccattacagatggccaaatattcttatctgccgatctattcaatgctggaatcagacccgctattaatgtaggtatttccgtttccagagttggatcggcggctcaaattaaagccatgaaacaagtagctggtaaattaaaattggaattagcacaattcgcagaattagaagcttttgcccaattcgcttctgatctcgataaagctactcaaaatcaattagcaagaggtcaacgattgcgcgagttgcttaaacaatcccaatcagctcctcttaccgtggaagaacagataataactatttatactggaacgaatggttatcttgattcattagaaattggacagaagtcctttgaacgaagctattcaagaacagatggaactctttttactacaggaacag

SEQ ID NO: 37961 - DNA, 273 bp, Glycine max
  Peptide Sequence Number=SeqID_129646
atgccgtatgtcatcaacgatcaccacaacaccgaacaccagaacgcaccttcaccttcatgcaacctaatggttcaccgaaccaaaccgatcgcaaggaaggaagcactacgcaccgaagagagaaaagaaggagacaatgcgcaaatggaagcattcaactcccaggaatcaatcgactataggatcagccaaagatcttggtccaagggaataaaccatgggcccagacaaagagctcaacccaatggaatgatcccagagcttggctaa

SEQ ID NO: 37962 - DNA, 303 bp, Glycine max
  Peptide Sequence Number=SeqID_129647
atggtttcaaggtatgctttaaaccagattgctgctgaatttgagcatgttcactatgctagcaagaatccttccacttgtggttgtgtgatgagaaccacgcacggtcttccttgtgcttgtgagctatccaaatatgttgttggttgcatcccactggattcaatccatatgttctggaggagactcagtttttcagaccaaggattatttgagctcgaagtgagcatcaaggaagaaatgcaacattatagaagcttcacgatgtataaaagagactgtgttgccttaaatgatgattga

SEQ ID NO: 37963 - DNA, 357 bp, Glycine max
  Peptide Sequence Number=SeqID_129648
tgcaagactaggggaaatccaggggatttacaaccctttgatcctaaaatagatagaacctttcatagattagttaggcatagtgtgcatccaggtcattctgtgcattttgagcattttgagcattctgttgagggtgattctgaatattctgattttgagcattccactactaattttcatactgagaacatggctcaacctccacctcgtgagaggaatctttgggagatggttgcacctgatttcacttatgaaagcttctgcattcaatattcacttaggatcaacatttcagccagcaattcaatcaccaaaactcaaattcacaatagacacaatcataaggaaacctaa

SEQ ID NO: 37964 - DNA, 372 bp, Glycine max
  Peptide Sequence Number=SeqID_129649
atggtgcaaacgtccttggctggacgggagctgagctggaagagtttccggcacgggctgaaaaactcgagtggtgttgagcgtattgatgagtaccatgcaaggcttgttaaggcttcggtcaggggagacacagtcaaatttcccctttttcaggcccacttctatcttatcgcctgcgaatacaagatccgcaaagctagagggcatgtagcctaccaacttctcatagtagaacaccgacagagtgtctactatcatggtaatcatctccctttcaaccatgggaggtgccacttgagccgccaaatccctccacctttgggcgtactccttaaaggattcgtgttcacgtttgctcatgttttgtaa

SEQ ID NO: 37965 - DNA, 273 bp, Glycine max
  Peptide Sequence Number=SeqID_129650
atggttattagtgagcaatggtcttcttataaggcagatgatattaacaaggcaaaatttgtgaaagagacagcattggatgacatttggtgggacaaggttgattatatactttctttcactactcctatctatgatattcttagaaaaacagatacggatgtagtttgtcttcatttggtgtatgaaatgtggaactcaatgattgaaaatgtgaaggtcatatatcgacatgaaagaaagggagaagatattatagtcatgaatggctaa

SEQ ID NO: 37966 - DNA, 565 bp, Glycine max
  Peptide Sequence Number=SeqID_129651
atgggtaaagtggacgaggtgcaagagcatatgaaggccgagatggaggccatgaaagagcaaatggccacaatgatggaggccatgataagcatgaagaagataatggaagccaatgcggttgcagttgcctctaccagcgctgttgctaaggtgaacccgatgcccccatcttgcctcaaccaaatgaatcatccaacctcagctatggtaggcaaagatttgggaagtacggacgacacttattatgttcaaattcaaaacaagcatgccttcccaccatatggcttgcctcccaactatacaccacccaatgtggcgtacactctcggtgaggatgtcaataactccactcccatactcattgagagccgacaacctcatcatgcacatgtctctcaacccatgggggacacacatgaaatgccccaccacaatctagccgacttcgagccttgcctcagatatgccattgaagggcaagcagttggtggtatacccctgcaaaacactttggagggcccacaatatcacccacaaccacacccattgcattccacagtcg

SEQ ID NO: 37967 - DNA, 141 bp, Glycine max
  Peptide Sequence Number=SeqID_129652
gatcagcacaggcttaaaggagcacgcaaaccaagtgtatttacccgcaaggcctacactccgaagataccttcagggcctattcctcctgattcaggtccaacccctaaaacaatttttacatgcagacactgctcgtga

SEQ ID NO: 37968 - DNA, 318 bp, Glycine max
  Peptide Sequence Number=SeqID_129653
atgacattctctgctgggtttgcatatctggagggtgagcgtgttaataatattgtatgggctttggaacggtttcaaatcgataagaatgtcaaggccaagtgcaaatctttaatcggtaaaaaaaatgtctgggactatgtgatggataactggggtactttggttgattgtccatccaaacaacaattcgctgagtcccttcacaagtttcaaattgcttgttcaccttggccaatgttcattgactatgttaactacacatggattatcccacacaaggaaaaatttattacagcctggacgaataagggttga

SEQ ID NO: 37969 - DNA, 210 bp, Glycine max
  Peptide Sequence Number=SeqID_129654
atgacattgccgaaaggaagaataggcatcttgttgagactgctcggacattattattacttcatgccaatgtacctgtccggcattaaggtcttgataagcttactgctcgggccatcaaatgtgttttccttggatattccagattacaaaaaggttaccgatgttactctcctgttcacaatcattattatatctcagcagatgtaa

SEQ ID NO: 37970 - DNA, 252 bp, Glycine max
  Peptide Sequence Number=SeqID_129655
atgaatatcgaggaatccattcatgttacctttgatgaatctaatgctatcttgtcaagaaagaatatgctagatgatattgcagtttctttagaacatatgaatattcatgaacaagattccaaaggaaatgataaaggaaacaatgaagatccttcagaagaagtcaaatccaattatgaacttccaagagaatggaaagcttcaagagatcatcccctcgacaacattattgatgatatctcaaaaggg

SEQ ID NO: 37971 - DNA, 255 bp, Glycine max
  Peptide Sequence Number=SeqID_129656
atgggaaagttggatcatctagaggaaaggctcagggccattgaagaggatgcgactacagaacatgtgcaaaaaggggcacagatctttcaaagaatacgcccaaaggtggagagacctggcagcccaagtggcaccctcaatgacggaaaaaaaatgaggacaatgatagtagacacattaccagtattctactatgaaaagatggtgggctacacaccttcaagctttgcagatttggtcttcgctgggtaa

SEQ ID NO: 37972 - DNA, 230 bp, Glycine max
  Peptide Sequence Number=SeqID_129657
ggtacatcctttgtggtacaagtagagggtacatctacttgggtttgactgagaacaagagagggtacatctcttgtggatcagttctagtggagggtacatccactaggttcaaagagaacaagggagggaataggttattccaagatcatgatgaagacaaagtcaacttttgtctcatgacaaaatctcatgaaaacaacaaagaagaatctgtaaggaagaagtga

SEQ ID NO: 37973 - DNA, 513 bp, Glycine max
  Peptide Sequence Number=SeqID_129658
atgtctcttgccactctatttggtaaattgcaggaacacgagatggaacttcaacgcctcaatcagaatgaagaaaatgacaaaaagaagagaagcatagcccttaaagcctcatcttcaatacaagaagaaaacgaagaagaagatacaggtgatgaagaagatttttccttctttgttaagaaatttccgaaatacatcaagaaaagaagaattgcaggcgtcagaatttcaataatagaagaaaatcacaagatgattctcaagtccttaggtgttacaaatgcaaccaaattggtcacatcaaggccaattgtccttcaaatgaagaatggtcatagctgttttctaataaacgggactcaatcaaacatccgagtaaaaagttattgtcgtttgaatttgctcagagcatcaagattctatttcgagcgtgtcgatatattttgggactcaatcagacatccgagtaaaaagttattgtcgtggggagggtgctcagagctgccgtag

SEQ ID NO: 37974 - DNA, 415 bp, Glycine max
  Peptide Sequence Number=SeqID_129659
accgaagaacaatgaagaacgaacgatgaatgtcgaagaacggttgaaaatcttcgccaaaatagaggaggagcttgccacccagctcgcccaggcgagccaggttgcttcctctagaagcaaccgccttctggaggaagaatctggaaggcccaaggtgccaagtactttgaagtggtcaattaaaggttgcatgccatcaagcaatagtccccggacgaaattagggtatgacaacatgatgctgagggacgctcgcccgctcgagaggacctatgttggagagagatttgactccttggagagtcaagtagacattcgattcggagagatggtttctaggatcacgaagattgaaagcgacattacttacatcagagattgcttcgaccttccaccgccaccatccacttag

SEQ ID NO: 37975 - DNA, 174 bp, Glycine max
  Peptide Sequence Number=SeqID_129660
atgcccacttgggccttccaggatgtttctccagaaggcggttgcttctggaggaagcaaactggctcgtttgggcgagctgagctcgcttggggcgagctaggtggcaagctcctcccctattttcctaaaaatagagggaggagtgaaggagaaaggggttcagcccttctg

SEQ ID NO: 37976 - DNA, 320 bp, Glycine max
  Peptide Sequence Number=SeqID_129661
tcaagcgttcctttgctattggtgctggtgcaatcacttcttttggataccgtaaggatcggaatggtcaattactgaagaaagatgcatttcctccacaagatgagcgtactccttctcctcctcctcagcgagatgattcagccctcatgactgaagttctttccgagttacggggtctttgtacttatgttggagaacgttttgattcattggataatcgctttgccggaatggatatctgtctcacacatcttgaagaagatgtgggttatattcgccagagcttcgatcttccaccaccacctccaccttcttag

SEQ ID NO: 37977 - DNA, 285 bp, Glycine max
  Peptide Sequence Number=SeqID_129662
atgtcacggaacttcacgaatcgcctagcgatgggtgccaagtacctcgaagtggtcaaacgagggtcgcatcccaacaacgggtggtccccagacgaaattaggggcgcagaatcgtatttctacgcgtttacccactcagcctttgtcttcctgaatgataaagggcacaatatctattgttgcacatttacccactcagcttgctatcatgctttgagtcttagagatagcaaaagaaagtttatacggataaccactcgggtatctccgcctgtcacgtga

SEQ ID NO: 37978 - DNA, 357 bp, Glycine max
  Peptide Sequence Number=SeqID_129663
atgacattgagcatcccagagcttttcttgaggccttaccaggttacatgggatgccaccatgtttggggtctttaatccagacttcccactctacataaagcacgaagacctctccgagatggcacacggtggtcaatgtctcaacatatcagtgttacagttgtggattctacaaaaaggaagtactgagtgcggctactatgtcatgcactggatgtccaccgtcattttaggaagttttaggaataactgggaagcgtattttaacgatcctagaccgttggagccagagagattaaaggcgttgcggatccagtgggcacagtattatctccgagttagagaccagacctag

SEQ ID NO: 37979 - DNA, 453 bp, Glycine max
  Peptide Sequence Number=SeqID_129664
atggccaaaatcaaagaagaggttgccaagctccgagcgtcaagaatatacaatacaaagattcaacctccagcctttcaattcgacgacctcatatggcaagtccgaggtgaagccaaaaataatccccaagcaagaaagcttggacccaactgggaaggccaattcaaggtcgtatcaagcctaggttcgtccttgttgagccttgacaaaccccaggatagacgtgtccttggtcacttctccaaaggctcatcaaacccaaggtctgcccttaatgagtctcacatctccaaaggctcgtcaaacccaagcagtggagctaagctcagcagttgggctaagcgcatatccaccgctaagcgtagcttcaacgcgctaagcgcagcaggtgccttcagccaggcaaagcgcgagactggcgctaagcccaatttcacttactcacgctaa

SEQ ID NO: 37980 - DNA, 711 bp, Glycine max
  Peptide Sequence Number=SeqID_129665
atgttttgccgcgaccccacggtgggcaccaaatgtacttaccagaatctggagctgtcccacattaggatggacgtggccaaagtaggctccaatatctcggatgttggacagagagtagcctttgttaagaggacaagatggggagcctgcaaaataaaggactctgatgctcaagtgaccatagttgacacgtgtacttacaacagcaagccccaagagactcaacataaggatgcacaggccaaagttgagtatgtgaaaagattgtatgaccaagtgaaggtgcatattgcaaagaagaatgaaggctatgccaagcaagccaacaagaaaaggaaggaagtggtacttgaacccggtgatgatcctggagatctgagggcaaatgttttccaagaaggagggaatgatgagaatcctaaaattgtccaaatacagggacctatgaccaggagtaggaccaaacattcagtggataccctccaacaaatggtagcagacatacttagcaaggcccaagtggacaaggacaaaagcccaaatggagaaggacgaaggccgaagtggaaaaggacgaagccccaagtggagaaggacgaaggcccaagtggagaaggacgaaagacccaagtaaagaaggatgaaggcccaaaagcaaaggcactactaagcatatcaatcgttgctgaaggcccaagattaatctga

SEQ ID NO: 37981 - DNA, 342 bp, Glycine max
  Peptide Sequence Number=SeqID_129666
atggttatgggggattccatcagcagactctccttccctgaaaacaccgagactttttcaagtctcacaagttatccagaactacgtaggtctgagttcctcattggaggatacgtaggagcaagagccttgcttttgtcgaccacaccaccttttgctgtcatgacccaagagctggtaacccgcggagacaccttacggttatccgcacctcgtcattcagtgacccgaagtgtgattgatgagcaaaggccagtgtggtcatttgcaccctttccggagatgtcaacatcttctggtcgagactttttcaagtctcacaagttatctagaactacgtag

SEQ ID NO: 37982 - DNA, 201 bp, Glycine max
  Peptide Sequence Number=SeqID_129667
atgatggcacatcacttacactcggaggtgtatacctccacgggactgcgtggctgttttggtatgggaaaggaacaagtttattctataattgatgcctatgttataccaatcttagttctgaaatttcaattgaaaattactgtgaaaacaagtgccaaagctagagggaataggaaggaggattggttccatccctga

SEQ ID NO: 37983 - DNA, 264 bp, Glycine max
  Peptide Sequence Number=SeqID_129668
atgtggccacatccagaagattcatctaccagtcgctgcaggcagcatgcatggtctctggtggcggtgacaaaagcgatgaatgtctgtttcatctcggggaattacacgacatggaaacatgccccgcggtggaagagctacttcaacggctcctggactgaggacagctcgaagtgtccgagagaggaatatgaccagccccaggtccgagtaccccctgacagtgcccaagccgatgccattttcctatcaaagcaataa

SEQ ID NO: 37984 - DNA, 621 bp, Glycine max
  Peptide Sequence Number=SeqID_129669
atggcgaatcaagatgagtgggtcccattcatggatgtattagcaatgttaatctttggggttgtcctctttccaaacgtggatggtttggtggacctagccgcaattgatgctttccttgcatatcaccatagcaaagaaatcccgatggtagctgtcttggtagacttatttgacacatttgaccgaagagtagattgggaccaacacttgccgggattggaggcagaacagtcaattgatttccacgatggaaagaaggaaatgaggttagggtaccctatgaggggagcactgacggaagaaagcctgtctcctttccttgtgagagattttggcgcgcaaaatttcaaggttatacaaagagtccataaggcgtgggacagcccattaaggaaagataaagaacttaggggcattcgtaatggcatcattggtggttatcaagaatggctgaaagtttgtacacggggtttagattggctcgccaagttaaagattatcagcgaagagaatttcgaagctccagaagaagatgaagaagtccgggctctgaaaaccgaactaggaaaagcgagacttgctaaagaaaaattcaagttggtcgctatagatgtccgg

SEQ ID NO: 37985 - DNA, 213 bp, Glycine max
  Peptide Sequence Number=SeqID_129670
atgagaacggcgttgccccagttgacgttcgcactgaagtccggtaaccgtgtaacgcgaacgggagcatttcgtgccaatcctgttggtgccgttgtccgtgataatcttccttggcaaaccatatcgacagatgatctctttcttaatgaacctgaccactacacccctcgtgacactggtgtaggaagccgcctcgacccacctggttaa

SEQ ID NO: 37986 - DNA, 186 bp, Glycine max
  Peptide Sequence Number=SeqID_129671
atggcccaggtggtggaaggtaaggtcgaagctcaacacccaaaattcggacagacccaggtggtggtgggaggctcctccatgatggacaagaggtcaagtgtcacccgagatgacctgggtcgcaacatcagtcgtgatggtgatggcgacaacattgaggtgactttcttgtcatctacatga

SEQ ID NO: 37987 - DNA, 483 bp, Glycine max
  Peptide Sequence Number=SeqID_129672
atgccatatgatcatgatgatttgatgccttatgaaaatccgcttctcaagtttaattcaagaacaaaattcaataatacaagacacaacatcaagaagatctctattgttttaggaagggaattccaaattgaaactgcaaaaggtttggccaagaaatttaagcaaaaatgtctttttcaagagatttactctctgatatctgaggccacttgtctaacaaggagctatatcaaaaagatacttaaaaggtttggcatgcaggaatgtaaatctggggatactccagttgctaagggagacaactgcagggagtttgatgtatgcccaagtatgtatgcattcggatatagcattcatagttggggtattaggcagatatttaagcaatccaggaatgaatcattggaaaacagccaaaagagttatgagatatttgaagagaacaaagtattatatgctcacatagaagaggtcagatga

SEQ ID NO: 37988 - DNA, 394 bp, Glycine max
  Peptide Sequence Number=SeqID_129673
gtcgactctagaggatcccacacaggctcagggggaggctccacaggccgcaggcgtgcccccaccacctcatcaggctggccaggctgggacatttgacatggagcagtatttacggcatttggttcgccagcaggcggccaaccaccgagcacatgtacggacccatgattgtctgtaccagatgagccttagcatgcagagccagggcttcgcttctttttcatgccctactccagaccagttcagggcagaggttgcatggcccggagattggcccgaggcccaagcaggagaggcacccccagaagctcccggcgatggagaagaagcccacgaggatgaggagatggccgatttgcttgacttcttgggagggagtggagatacgtga

SEQ ID NO: 37989 - DNA, 251 bp, Glycine max
  Peptide Sequence Number=SeqID_129674
ctgaagccatcgcatggggtggtggtgacgtgacgccctatcagacgaacgtccccgttgttatcggtggggtaggtgtgcatcctggtcagtacgtattctgcgacgcttccggcgctgtcttcattcccgagtcagacattgatcgagttctcgaggacgctcatcagattcggcgggatgattcctctcatcgcgccgcgatagccctggaggaagtgggtgggatcgccgacggaaccgagcgctga

SEQ ID NO: 37990 - DNA, 366 bp, Glycine max
  Peptide Sequence Number=SeqID_129675
atgagcagtgcttatgtggaatctccttcggtgatgccacgcttatctggtgccactttgatggtggctcgggttatgttaaggaacagatatgagcccgaaatgggtttaggccgaagcggggatggcacgacaagcttggtggtgttcgctgagaatcgtggaagattcatgttgggttacgagcctacacatgccgacaagaggaggatcgccttagaaaggaaggagagaagcctggcccatctacaagggcgaagactacaagcggaaagggtccctatttgtcacatcgacaaaagcttcgtcagtgcaggatggatgtgcgagggtcaatctacgatgatagacaaagaaaccccttaa

SEQ ID NO: 37991 - DNA, 501 bp, Glycine max
  Peptide Sequence Number=SeqID_129676
atggcctcccgcaaacgccgagctgtgcccacacctggggaagcatcaagctgggactcttcccgcttcacctcggagatcatttggcatagataccaggataacattcagctccggaacattcttctggagaggaatgtcgagctcacacccaggatgtttgatgagttcctccaggagctccagaggtgcagatgggaccaggtgttaacccgacttccagagaagaggattgatgtcgctctggtgaaggagttttactccaacttatatgatccagaggaccatagtccaaagttttgtagggttcaaggacaggtcatgtggtttgatgcagagacgattaacgacttccttgacaccccagtcatcctggcagatgtagaggagtacccagcctactctcagtacctccgcactcctcccgatcatgatgccatcctctccactttgtgtactccagggggacggtttgttctgaatgttgatggtgccccctag

SEQ ID NO: 37992 - DNA, 141 bp, Glycine max
  Peptide Sequence Number=SeqID_129677
atgaacaaaagcgcaaaacggaatcaaaaaaatgcgaaaaaggatgaccctggggctgcaaactcgtcaatcccgtgggtatggcttttgaaagggggggaaaagaagtttttgaatgggtggctcgcccaggcgagctaa

SEQ ID NO: 37993 - DNA, 952 bp, Glycine max
  Peptide Sequence Number=SeqID_129678
atggcgaatcaagaggagtgggtcccgtttatagacatattagcattgctaatctttggggttgtcctctttccaaacatggatggtttggtggacctcgctgcaattgatgctttccttgcatatcaccatagcaaagagagcccggcagaacagtcaactggtttccacgatggaaggaaggaaaggagggattctcttctcatgtgggggctacccaaatatcccgttgataagaacgaagggggagcaccggcagaagaaagcctgtctcctttccttgtgagagatttcggcgcgcaaagtttcaaggttatacaaagagtccataaggcgtgggaaagcccgctaaggaaagataaagaacttaggggcattcgtaatggcatcatcggcggttatcatgaatggctaaaagttcgtacacgagggttagattggctctccaagttaaagattatcaacgaagagaacttcgaagctctggaagaggatgaagaagtccgagctctaaaaacagaactaggaaaagcaagacttgccaaagaaaaattcaagttggtcacgacagacgtctggaaagagtgtgccgggttacgagaagaaaatgcagctaccgcaagagcccttgaacaagaaaccaagagggctcgcaaggaagagcatggccgtgacaaatttcgtggagctttgtggggcagcaacagtgagctcaagcttcaaagggaagagagagaccaatcacgagcacattgcatggtcttgaaagaggagttagctgcttgctcaaggtccaaaagaaacttgtctcagcgtttatgcgagacagagaccaacatgttagctatcattagcaagtaccaagaagaactaaatctagccacggcccacgagcacaaagtggcggacgagtatgcccaagtgtacgcggaaaaggaggctagaaggaagg

SEQ ID NO: 37994 - DNA, 288 bp, Glycine max
  Peptide Sequence Number=SeqID_129679
atgcgtggaagatctgcagcacttgtgagcagtgtcagagagcaggaatttactatgtttcaaaatgggtggaagccaagcccactagaactaatgatgctaaagttgtcgcagactttgtcaggtctaatctgttttgcaggtttggagtacctaaagcaattgttagtgatcaaggaacccatttttgcaacaggacaatgcattccctgcttaaaaagtacggggtggtacacagggtatccacaccataccacctccagaccaatggtcagtgggatcctctag

SEQ ID NO: 37995 - DNA, 333 bp, Glycine max
  Peptide Sequence Number=SeqID_129680
atgtggctatccaagaaatgtggctatgtcttcacttggaggctcctcaaggacaggctccccactaagggtaatctcttaagaagaaatgtggctatccaagaggctgtttgtcctctctgtggtcaagtgcaggaggaagtgggtcatctcctctttaattgtaaaaggaaaataggtctatggtgggaatccatgagatggattcaggctgtaggacctcttccagcttccccagcaagccattttgcccaattttgtgatgggtttggtgcagacataaatgatagcagttggtgtgggtggtgggttgctctaactagtgctatatga

SEQ ID NO: 37996 - DNA, 49 bp, Glycine max
  Peptide Sequence Number=SeqID_129681
atggataagagcttgaaggtaggaaaagatgagtggagggagaaggaga

SEQ ID NO: 37997 - DNA, 96 bp, Glycine max
  Peptide Sequence Number=SeqID_129682
aatcttactccctgcaccctaccactgtcattctgctcccacgaacaaggttcgtgatcatcacaagtatcaaccacacgatacaaaattgcaagg

SEQ ID NO: 37998 - DNA, 132 bp, Glycine max
  Peptide Sequence Number=SeqID_129683
atggatactccaatgagtactgcttgctatttggataaggatgaaactggtcagtcagtagacattaagaaatatcgagatttcaagcaaatcccaaagaatcacatcttagtgcagttaagagaatcatga

SEQ ID NO: 37999 - DNA, 198 bp, Glycine max
  Peptide Sequence Number=SeqID_129684
atggtgtgtgagcaacgagtgatatataaagaaaattgtatacaaaagaaatgtgtgttgggaaagaaggccgaaaaaaaagtgaaggatgtaccggcaaaggaaaaggtgtctcttcctcataaaggaccacaaggtcgttctgatggaatgaaacaaagaggaaaaaccgaaagaaaacccaggtcactgttatag

SEQ ID NO: 38000 - DNA, 318 bp, Glycine max
  Peptide Sequence Number=SeqID_129685
aacaatagtctacttgtcgacggttccctaacttcaacggggatcatggtgtttgtgccatatggccctgagaatcactctgttagctgccccttcccgactgttggtttgaggatgtttgatagagatgaggtgtttctaggtgaatttctccacctcactagccgtaatttccctatgtccattccctacatagcgaagggccaaggggagcttagactgtggacattgttaggaggagtctcgcaccactttggtggcaagggagcatcctccgatgtggagactacatatcccttcatgaagttctctcatgac

SEQ ID NO: 38001 - DNA, 390 bp, Glycine max
  Peptide Sequence Number=SeqID_129686
atgactcctcaaccattgaagaaactgagacaagaaaatgaaaaacttgtttcaagctataaagccactagttgtgtttgtgcttctacttctattaatatggatgattacaaatctttgcaaattgagtttggaaagttcaaaagggatcactatgaaaaatgtatgaagtttcaaattgagctttcctatcttaaagatctgtttagaaaaatgaacaaaggaaatagtgatcttagtcacttgcttagtgttcaaaagcatactaccgataagactggtttgggatataacaagcaaactaccatttcaaagaaaaccaagtttgcatactccaaaaaggtgaaccctaacaaagtcttcaaaaataaaaacataatgtatttttag

SEQ ID NO: 38002 - DNA, 573 bp, Glycine max
  Peptide Sequence Number=SeqID_129687
atggagaggagtatgattgatgctaccagtggtggagctcttggtgatatgactcctgctgaggctaggaatttgattgagaagatggcttccaactcccaacaatttagtgcaagaaatgatgctattgtccttagaggagtctatgaggtggccacgaattcaacttcatctgctaaaaataaaaagcttgagggaaaaattgatgccttggtcaacctagtaactcagcttgccatcaatcagaaatctgcacctgttgcaagagtctatggtctatgttcttctacagatctctgttcttctttgcagcaatctggagtcaatgagcaacttgatgcttatgttgtaaacatttataatagatctcctcaacaacaaaaccaacaacaacagaataattatgatctttcaagcaacagatacaatccaggttggaggaatcatccaaatttgagatgggcaagtcctccacaacaacatcagcctgtccctcctttccagaatgctgctggtccaaggaagccatatgttcctcctccaatacagcagcaacaacaacaacagtcataa

SEQ ID NO: 38003 - DNA, 354 bp, Glycine max
  Peptide Sequence Number=SeqID_129688
atgaggttctgtgcaacgctccgatcacggatctccaaatcaaactcttggagccaaagcatccacctgatcaatctaggctttgattcagccttcttcaataggtacttcagagctgcatgtgtaatttgcttgggcaacgtccaaagttctggaagcgtagttgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 38004 - DNA, 372 bp, Glycine max
  Peptide Sequence Number=SeqID_129689
atgaagaagctggaagagactcttgctcagttcatgcaagtatccatgtctaatcaaaagagcacagagtcagccatcaagaatctagaattccaggtgggacaattggcaaaacaactggcaaaccgaccgtcaagtagctttggagccaacatagagaagaatccaaaggaggagtgcaaggctgttatgactaaaagcaaaatggtgagcatgaatgaaggtgagaagaggataggtgaagaaaaacaacagctggtgactgaaccagaaattgacccagtggtggaacttttgagtgagacagaggaagaagtggaagcagaagatgatcaacagaaggagataccaataatagtgagtgaaaaataa

SEQ ID NO: 38005 - DNA, 360 bp, Glycine max
  Peptide Sequence Number=SeqID_129690
atgcatttctcggaccacgtagtagttgtgggtgacctttgtgtagtgcctgggcaggtatttgcagattacatggagtggtttttccagatatctcacccattcatgataccgacccaggcaggtgaccagcccagacatgcacctgccccagaccatgaggactacatgcagccggacatcccacaggttctagtggcatttgacccccctcgacatgtagtggattgcctaaggatcgccaggggggtgccagcgcagatggaagtgttagggctcgacaaagacggcgcacagagcattgatgatgatttggagccttcacacatgttcaagtatccatgttcggggtttttctaa

SEQ ID NO: 38006 - DNA, 284 bp, Glycine max
  Peptide Sequence Number=SeqID_129691
ggaagtaaaccacattagatatgcaaatggagtttttagactaaagatcaatccaggtaagaacgatggaactcactttgatcttatcaggtgcctattcatggaagtcttccaaggatcaaactggttgagaaacattgttaggcatgatgaaaattgccattgtgggggaaagcggtctataccagtttctcttcattgtgactctgaagtagctattggaattgctaagaacaatgtttataatgttgaaaaaggagacacatatgttagacacagtgact

SEQ ID NO: 38007 - DNA, 495 bp, Glycine max
  Peptide Sequence Number=SeqID_129692
atgaagccccttagtggcgaaggcccacaacatcttcacataggcaacaggaagttgcacatgttgctgtggatgttgagcatgtggatcatgaagctgacgaggtccatgaatagtctgaagaggcagcttctgatgaactatgttcatcatgtgacattatcctcccatggaaggaaggtagagaaattgggcaggcttgctccagagattgaaggcttagtggcttccacaagattaagtcctctaattgcatattccttggatactagtgacaggggacttatatcggctcttgcgaaaaggtggaaaaaggaaacttgtagtttttatcttttggtaggagaggtcactatcactttggatgatgtggaatcattgctatatctgcccattacagacgccttccatagctttgaggctgttcatgtggacgaagttgtggacctgttagttgacttgcttgaagttagttcagaagaagcaaaagattag

SEQ ID NO: 38008 - DNA, 191 bp, Glycine max
  Peptide Sequence Number=SeqID_129693
catctgaacacaagggatgagttgtccttgtgtggtttagactttgtaaaggattttacaaagatagtggaaatctcaagtgggttgcttgagtactggacgaatacgcgcggagtcgccaccaacgtttatttgaggaaaacgtcggaaaaaaccggaaaagacgcgatctacgaactttttggtgaaag

SEQ ID NO: 38009 - DNA, 228 bp, Glycine max
  Peptide Sequence Number=SeqID_129694
atggaaagcaagaaagagaacaggagatcttcggaccagataaattttcgacgaggtgaaaaacccggtggaccattcggtcctaccctcaaatcttatccggagccccatgaattgattgtcattcatgcatcctccaccaacgagtctggagccccgcgaattgagtgcctagcgctgttcgcctatcctccaccctcaaatcttattcggagccccatgaattga

SEQ ID NO: 38010 - DNA, 822 bp, Glycine max
  Peptide Sequence Number=SeqID_129695
atgcatgatgcacagatccgtgtcgccattgcgggcgcgggtggacgtatgggccgtcagctgattcaggcggcacttcagatggatggcgtagcacttggcgcggcgctggagcgtgacggttcatcacttctggggaccgatgctggcgagctggcgggcgcgggaaagaccggcgtcaccgtacaaagcagcctggacgcggttaaagatgacttcgatgtgttcatcgattttacccgtcctgaagggaccctcacgcatctggcgttttgccgtcagcacggcaaggggatggtgattggcaccaccggttttgacgatgcgggcaagcaggctatccaggatgcatccaaagagattgcgattgtcttcgccgcaaactttagcgtgggcgttaacgtcatgctgaagctgctggagaaggcggcgaaggtgatgggcaactacaccgatattgagattgtcgaagctcaccaccgctataaggttgatgcgccatcaggcacggcgctggcaatgggcgaagcgattgctcatgcacttgataaagatttaaaagactgcgcggtctatgcccgcgaaggccacaccggggagcgcgtgccgggcaccattggtttcgcaaccgtccgggcgggtgacatcgtcggcgaacataccgcgatgttcgccgatatcggcgagcgcgtcgagattacgcataaagcgtccagccgaatgacgtttgccaatggtgccgttcgatccgccttgtggctgaaagagaaggaaaatggtctttttgatatgagagatgtgcttgatctcaacaatctgtaa

SEQ ID NO: 38011 - DNA, 294 bp, Glycine max
  Peptide Sequence Number=SeqID_129696
atgggtgccaagcaccttacaagggccaaacaaaggtcgcatgtcatcaagcaaaggtccccagacgaaattagggatggtatcattatgtctgaggtgcatggtacttctatggtcattgatcagtcactattcttttctttgactcatttacccagtcaaggtgcaccttttgagggcaccattgttgatgactggaaattcgattattcgagtcatgatgctcgtcgcatggtctgcaatgatcaagctgaaatgaccggtatgttagtgcttagctttactgagttttaa

SEQ ID NO: 38012 - DNA, 1180 bp, Glycine max
  Peptide Sequence Number=SeqID_129697
gggtataggcaaaggccggggtggacaggatgagcatcatccagatgatgttccttggcagagtaggcctatcgcatccgtccgtaggcaacgagtacgtgttgctgaggaggatgttcctgcagctggtgtagagggcttagttgctgatgatgttgctgcgggatcagttgctgagggattccttggtgagccacgtgacctatcagtgctgacttcctatgctgatcatgttgcacacaacatatggactggagaggaacgtcctgacttgaagttggcctcccacggtaggaaggtagagaaaattgggaggccagcacctgagatcgaaaggctagtcactgccacaggattaagccctttgatcgggtgctcagtagtcaccggcgatccgagacttatatctgtgcttgtggagaggtggcatggggagatcaacagcttccaccttccagtgggagagctgatgatcacattggatgatgtgtcgtcactcctccatctgccgatcacaggcgccttgcacagcttcgagccttttcttttggaggaggcagtcgtgttgttgatggagttgcttgaggtctcggctcgtgcttatctccttcacttggttggttgcactcttttcgctaaaaagagtgcaacacatgtccatgtagtgcatctggaggcttttcgagacctgggtgagagtgggaggtatgcctggggagctgcggtgctggtgcatatgtatgaccagttaaatgaagcttctcagagcagtagacaacaacttgctggtgctggatatatgatcactttcctagttttcatgactgcatcattgacgatgtgtatgatgagacatccccatgtgtctgccggtggcttacgacgaagggttatatcaagggattacgagcactggcgtatcggacacggccaggttagatggggtcctattgtggtcacagttcaaccagatagggtggccattcctccaccgcctattagtgcctccttgtcatatgaggatatcgacgatagaaggatgcattacgaggaccatatagcagttgcgggtgatgagcccagacatccacctgccccacagcatgaggaatacgtcgagccaggtatcccggaggttctagtgggagcagacgttggaccatcacaggcacctgcagtg

SEQ ID NO: 38013 - DNA, 468 bp, Glycine max
  Peptide Sequence Number=SeqID_129698
atgaagaaagaaatatcgtcatctcttaagtgtctatgtgatttggggactagtataaatttgatgccttattctgtcattaagaaatcgggcatgacaaacttagagcttactaacatcactcttcaccttactgataatttagttgtcaatcctggaagtttcattaagtttattgatatatctgatgcattgatggagggggtgttctcaagtatggggatgcctaaccctctagagagagttctcattaatgaggaccttgactggaagttgaactcagaagtggaggaaatattgacatttttctattctcaacatggtcctagatcgtctagttttgagaggttagaatggggcaatggcctaaagccaaagccttctattgaggaacctcttgtattggacttgaagccccttccttacaaccttaagtgttcttttcttaaccctacatcttttatttag

SEQ ID NO: 38014 - DNA, 226 bp, Glycine max
  Peptide Sequence Number=SeqID_129699
atggccgtaatgatggaggccatgatgagagtgaagaagataatggaagccaatgcggttgcaattgccgctaccagcgttgttgctaaggtgaacccgacatccccatctggcatcaaccaaatgaatcatccaacctcagatatgacacatgaaattcctcgccacaatctagccgacttcgagccttgcctcggatatgccattgaagggcaagcagttggtg

SEQ ID NO: 38015 - DNA, 282 bp, Glycine max
  Peptide Sequence Number=SeqID_129700
atgttggacttacattttaaaatatcagacgatagccttattttgcttgcgctctcttcttctccatctaagcttcttcttctccatcgcgctcaagatcgtgatagcttgccaccttacccaggtctttttggggaactcgtgctcactgcaaggacctttgtttgtttctgctgcaaggatttggtttatggaactcgtgctcactgcaaggtctatttggggtgctcactttgcagtccgtttagggtgctcactcgtgctgacagggtctcattttga

SEQ ID NO: 38016 - DNA, 150 bp, Glycine max
  Peptide Sequence Number=SeqID_129701
atgacttggttcactcccgttaatccaaggaagagcaattaccgatccatccacatggttgcctctctagggtgtaagacgtcggcatcacccttctctagcctctttttccgcatggaaataggaaaacacaaggatgagcaaacatga

SEQ ID NO: 38017 - DNA, 189 bp, Glycine max
  Peptide Sequence Number=SeqID_129702
atgaccttggttcttctttcaaaccatactttttcagtctatagacatggagaagatgagtcaagaacaagctcaccgccatatgaagccatggataagatcttgaaggtaggagaagatgagtggagggagagggagagggagagaaggggcacgaaatttatgcctcaaatgatgtctgaactttga

SEQ ID NO: 38018 - DNA, 195 bp, Glycine max
  Peptide Sequence Number=SeqID_129703
atggttgaaaaaaggaagatacgagaagaacaagcagcatttactgaggacccttcattgtacctcccaccatccccaatttctagacatgagaagtggaagagtgcgcgcacaaaacaatatggccagatgacatctcaagccgccaaagaaatagctgacaaaattgactctttggaagagcaaagtagatag

SEQ ID NO: 38019 - DNA, 441 bp, Glycine max
  Peptide Sequence Number=SeqID_129704
atggattcccctggcacctctcttccacagcttggcacgtttaaagaaggagggacaaaagagagatgctttctatcagtcaaaagcagataccgccccccccctcatgctcccacggtccgcttaccgaggaatagaaagggaggaccgggggccagagcaagttgggttgggcgcgtttggatccgcgaaggcaatcgctcggatgttcccctaacccaacccgggaacggaccggagggaaccgcagcatggggaatgtccgcgtctcgtcgcaaggctcatttttcgtttttggtcatagggcgggcggatttatctgatcaagggccggggcacaagggtcctggtactatccaggtgcgaagaaccccggaggtgactgcaatgagcagaaatctcactcaccggcctaaacgacgagcaaacactcgaacgtga

SEQ ID NO: 38020 - DNA, 360 bp, Glycine max
  Peptide Sequence Number=SeqID_129705
atggcttctagaaaaagaaagagcattggtaagtatgacacaaggagattctcttcattagatgcttggaccagatacacagataatgttctggggagaaacattttacctgagaggaaggtagagctctatcacattgagctacatgactttaaggctgaattggagaggcataatttccataaacgcctcaccaatttagtcgatgggagcatagacctggctttggtgaaagagttctatgcaaatttatacagttctgaggactgtccaccaaagcaatccagagtcaaaggtcatttggtgaagattgatgctgacagtctgatcgaggccgtactcgaatcaaataaacattaa

SEQ ID NO: 38021 - DNA, 663 bp, Glycine max
  Peptide Sequence Number=SeqID_129706
aagtctacgtcaaaatcttatggctctcactcttatccaaagaaagaccaaggtcaaggcatcttaggggtgacagcttttaagcccaaagatgataagggggagacaatagaaaagcaagcccctaaggctagtatgcaagagaagactagctccttgaaatgctttaaatgtcttggaagaggacatattacttctcaatgccccaccacaaaaaccatgattatgaggggccaagacatttatagtagccaagataaggctactacttcaccttcctctagtgaaagtgaagaagcaaaaggggaagaatctagtgaagaaatctacccccaagaagaaggacaaccattagtggttaaagagaagtgtaaggagacacttgctagcattgccacacctctagggcttgagtttattcctcaagtaaataagttgttggatgagggggttcccatgaaccctaagagaataaaggtcattcctgagtggcccactccaccaacaccactcattgagttggtgagaaactgtgttccttcatgggaagatgcccaggaaatggggaaggacccagagtatgaagaacctcgggatttgaggtcaaatcctttccaaggtggagggaatgatgcaatcctatcccgcaagggcattgggtag

SEQ ID NO: 38022 - DNA, 1905 bp, Glycine max
  Peptide Sequence Number=SeqID_129707
atggcgactagtaagtatttgactgctcttgaggcctttggtagtggtcccaatatgtttattccctacatagcaaatggaaaaggggagctcggactgcattttaaaaagggtgttgtcaaccctcttttgaatagctcaccatcgaggatgactgtctatggtgagagcttggagcgtctcctggatgatagtcttgaggtgcctaacctttttggtgctggcttgcttggagatcaggtctactttggtgtttctctccctggtgacattatcagggccttcgaggatgattcatgtcccgcttccctttacattggacacaccgtccacttcgacggaccatgccaccattctccctatgagtttaggtttccgcaaaacctgtttgatggggtagttcgtcttgactaccacctggtgactctggaaatggggagcatgtacttcccctcctcttgtatgagggctgagctaacgacttcatcagctactgaaatatacaggagtaggggtactcctggcctgggtcagcttaaaactggtggtgtggctatggtcttcttgaaagtcaggaaggcttgttcaccggtctcatcccataggaagggctcacttttcttgagcaatttcttgaatgttggtcgggctgtgcatctccagtatggcaatgcatttgttgtggttggcttcaatcccccgatgaatgatcatgaaactaaggaatttgcctccgcctacctcgaatgtacatttttcaaggttgaggcgcatgtcatatttgcggagttccctaaagacttcttccaagtctgtcatgtgctgggctatgctttgagacttgatgaccatgtcatccacatatacttcaatatttcatccgatcagttgtttaaatactcggtcaatcagtcgttgcacctcggctataagccagtgctgatggctggtgaggcccttgtcagaagtgtcgttgcacggatctatatcgagttcatcgtccaaacttgcttggtagacggctccctagtggcaggctctttgcatagcattgtcgtgcttactttgatcttccttgacggttacaatcttctcggtcaggctggccttgaccgaaagtggtcattaggtccacgtagcctctggtttcaactctcacgcctgcaaatccaaggagtggaccagcttgatggtggacagtctgccttggtcgatgaggactttgaacaccttgaagtttgcaatgatgatggagataaccatggattcgtcctggttaatgggattgatacccttaaagtccctatccgtgaaagtggattggttagactgtccttcataggaaaattcatctgcaatggtgttgattacacctctgatttgttaggtgggttcctgttcttggggaggttgtcgcttgtgttgctactgtatttggtcgcttctaaccctggcctggaaggtttcgtcgagggtagcctgatgggtacctccaagttgaaagcttcctccaggattgtaatgcgattggtcgttagggtgagccttggtgcttccttctctcttgtcgcgcttatgcccagcttgtctgacttcgttcctgaatctggacatttcttccatctggatggcgaggagcatggaatgcaatgcgacctttgggttaagattttggatctggacgacgatgcgcccaaatttgttcatgaattttctaagagacttgtcatctgcgtgtcacagattggccaaggcagtagaggtcaagcaatgagacctgttggttgcgtattgtgcactaaagcattcaacgaaggtgtcgaagctatctatggatcttggtgggagtccaccgtaccagatcaatgtcgcccccttgagggacattgggaagacacgacatag

SEQ ID NO: 38023 - DNA, 267 bp, Glycine max
  Peptide Sequence Number=SeqID_129708
atggctactggtggagggttagagcctttgaaaggggtctcgcgtttgaggcctgaccgagtgcaaaccagcaaaagagagagatatgacgagagattgtggggatgtgttgagggttcaatggaacctggtatttataggagtagaatggagttgcaggcccttataattgaatacctgccaagagataaagaggtaacaacatattcaaatattaagaggttggagataacctgttggtttgggagcccagctgttaagggttga

SEQ ID NO: 38024 - DNA, 795 bp, Glycine max
  Peptide Sequence Number=SeqID_129709
atgacgtcatcttatggtcccaaaagtgaagaacgtggtcaagaaatgataagcgtcaagcggtccttcttcgaattggttggcattctgaaggacgatgcctactgcacaagtgactttaagctatggtggacaagggttcatgatgtttgtcttaaaaagtttgcccttgatagtgatgcttttgagttgataaatttttcattgagtaacaacactgaagtcttagtttatgttgagaaaatcaatgatggagggattgttgttagtaaggatgatgttgtagcacttgatgatgaggatgaaggtgttgggaatgaagttgttagggttgaagttgttgttagtaagtctgattctagtgatactgagtttaatgaaggtggttctgaaagtgggtctgagaatgataatgaaggtgttgtttttgaagatagtgaagaggagagagcaactgggggatatgaagttgaagagctttatagtgttggttctaaatccgacaaagaagacttacataagtttgtcagatacaggaaagaggagttgagtagagattttgagttcaagattggtatggatttttgcagcctacaggaattcaaagaagcaattattgaccattctataatgaatgggagagaggttgtgtttcgaccaaatgacaaagtcaatgcaaagagaaatataatggatgctgtgaggttgaaatatggtattgatataacttcggttgttgcttggaaagccaggatgattgctaaagcaatagtggatggggatgctatcagatag

SEQ ID NO: 38025 - DNA, 489 bp, Glycine max
  Peptide Sequence Number=SeqID_129710
atggagatatgtgtaaggtgtctctctggtgacccaactgaaaggccttctgtggaacatattctctggaatttgcagtttgcagcccaagttcagaattcatggagaagagactcaagccatcagtcatctccaagtagtcaagacagagcatcctatgagaggatgctggacaataaggtggagtttggttccccaaataagcagtctggcggattctttaactctgctctggtactaggtagatttactgttttggcttgcaaaaacaactctaagtttctaattactgctttttggatggtatgcaatcggattccagaggctgctttaatggctcgatcctatctcccaagcatgatatcagtgacaatttggagaaaagatcttagtaagaaaaagcaaggaggagctaggagggtagcagttagcgtcaaagatactggaagagtgaatgagacaaaggaatttcagtccccagaaggctga

SEQ ID NO: 38026 - DNA, 414 bp, Glycine max
  Peptide Sequence Number=SeqID_129711
atggccaaaccctcaacacaattggtagcttttcctttcagcaatgagtatcggttcgatacagaacaaggaacaacgtgcaaagaagtatacattagaagtaatcaaatggaagaaatgcaagagaacataccttcaagtaacactcacaaaaggaaaagcttaagtgcccttgagaccgcgaaaacggaggagagggtgcgcggggtaagaagtaaagtaagagttcttcctcagctagctaggaacaaagatcatctgcaaaagaaagattgtgtcaccctcacgtatggagaaaccagcttcagaagagaagaaaataagaacttatctaaagctcttaatgtgcggatggctgaatctgatgactcagacaacaacttggtggatccgcaaatgatgaagtggctctaa

SEQ ID NO: 38027 - DNA, 219 bp, Glycine max
  Peptide Sequence Number=SeqID_129712
atgtttagtttcattaatctctatggaaaataccctcccggcttctttgctagcatgtgtcacgaagggaagaaaggtattactattaactgtcttcctgctgctgctgcatcgccaccatcagtatcagcagatgacactgggatgaaaactcaccagatgcgtgtttgttcagtaactggacaagtactaaaccacttcagtttaaagacatgttaa

SEQ ID NO: 38028 - DNA, 654 bp, Glycine max
  Peptide Sequence Number=SeqID_129713
atgtcaaatgaagaattgaagttgcaggatccacgatgtcggatacaatgtcctgacatcctgcccgaaaatactggagttgctgcacaatgcataagtcaagataaaatattctcagaaagaatgatagatctcatccagcacaaggagttgcagcccagaaacgcacattgctatataatcatggaggctgcacgagttctgtaccaagtcgggattgaagagttacttttcaaagacaatctgcatgttctgaagcgtgatgtcgtgacatcctgtacgacatctgtccccagtatcagaatttcagacctagttccatataaatgcaccagatgtcgggcaacgggtcataattcgaggaggtgtccattgctacctctagtagtacctgaagaacaaaatccggaacctagtagagctcagggtgcaactcaaggtgttgctcagggcgcaaatcaaggtgcaagtgaggttgagggtgcaactcaaggtgtagctcaggatgcaaatcaaggtgcgagtgagggtgagggtgtaactcaaggtgtagctcagggtgcaaatcaaggtgcaggtgagggtgacggtccacctgttggaggtcagactcaagaagtcaatattgttgagggtacacttgctggagtttag

SEQ ID NO: 38029 - DNA, 789 bp, Glycine max
  Peptide Sequence Number=SeqID_129714
atggggtgcgaaaggcgaaaagaaaagatgcgtcttccaaaaagaaaacgtgtggaagtcgtcaccgatgtttattcaaggaaaacgttagaaaaactaaaagaagctcgcctaggcaagctgaagcttagccctgaagtaatgagctcgcccaggcgagctgattgcttagccatgaagctatttcatggcccaggcgagccagatgctagcctgggcgagctgggatcacgatcggggagctcagtctccaccaatgaagaaatcaagaaaatctgccatgtcttcatcctcctcagctctgccttcgtccccttggacaactccttgagcacctgtaggacgtgcctcctcctgaaaattgggcctatccccgagccatacggtagtggctctgaactgctcgggagtaggccatggataaggccaaatgttgcatttatgcgtgcatctggagctccattctctgcatgtgagctgagatggactctagagatggtggttgatgtggaggtggtggtggtgcgtctgcagtcggctgctactactggtcttgccccggctgttaattggcagagacctatgattaatgctggaaatcccagtgcctgttggacttctttgggtccactgggtgtctcagagatcaaagttatggtcactatgaaggatgttactgagcaggagtgtcatccagacctgagtcagagtggtcatgctagtgtgcatgatccgcacccgcctccctgctatgctatgtacaaaatcatgtcccggggagcaaagtag

SEQ ID NO: 38030 - DNA, 189 bp, Glycine max
  Peptide Sequence Number=SeqID_129715
atgcccttgcggggtaggattgcatcaccagcacaccagtgtgaaaggtgtgtgtgggaactagaaaggcttgtaatggagatgggtaagagtgcattgctgacaactgcttgtgggaataacaaagctactaagtctcaagctaatcagaaagggaatgatagaataccacctcaagctgatatttag

SEQ ID NO: 38031 - DNA, 303 bp, Glycine max
  Peptide Sequence Number=SeqID_129716
atgttcagaatttatttaattgttgctcctgttagtgtttgcatgcgtagatcttctgcaagtgaattggttccattggatttagaaattgaagccacctttagaagaaacaacgcagaaagaaaagaaaagctattgcacaacaaaacagtagcatcattccttgaagaggctcacttttctgagtcatcttcttctaattcacctacatccagggaatctcaaacagtagccgaagtcatggctgaagagcaacctcaacaactgaccttggaagattactcaagtacttcagtgccgtaa

SEQ ID NO: 38032 - DNA, 1020 bp, Glycine max
  Peptide Sequence Number=SeqID_129717
atggggacaaatcaaaacggcaaaaggttttatcaagtcaaggttaaaagtctagatgtaaccagcctcaaggaattgagacgattgatgggacctctccaaaggcaagccttccgcaaagtgtacgggaagattctagatttgaccatagcggaggtatttacggaagctgtcatatccctcgcccaatactatgaccagccgttgaggtgtttcacgtttggggacttccaaatggtaccgactattgaagagtttgaggaaatattaggatgccctcttggggggagaaaaccgtatcttttcttcgggtttcttccctccttgagcaagattgcagctgtggttggagattcggcaaaggagatggattgcatgaggcaaactcggaacggtgtagtgggcctgcctcggaaatacttggaaggcaaggcaagggatatggcgggccaagtgaagtggggcccgtttgcggatatattagctttgttgatttttggggttttcctctttccaaacgttgacggtttggtggacttagccgccattgatgctttcctcgcatatcaccatagcaaggagagtccagtggtggctatcttggcagatttgtttgacacctttgaccggaggtggggcaacgcaatcaattggtttcctcattggaaagaaggcaaggaaggagttcttttcttgtgtggggactaccctaatgttccattgatagggactaggggttgtattaattataatcccgcactcgccataagacaactagggtaccccatgaggggagcgccaacaaaagaaagtctctcgcctttccttgtgagggatctaggcgcgcaaagtctcaaggtgataaaaagagtccacaaggcgtggagaaagaactttgaagctccggaggaagatgaagaagtccgagctctaaaattagagctagggaaggcaagactcgccaaggagaagttcaaattagccgctacacacatccagaaagagtgcaccgagttataa

SEQ ID NO: 38033 - DNA, 579 bp, Glycine max
  Peptide Sequence Number=SeqID_129718
atggctatgatgactacaaacgatacaaaagtttcgcgagaatcttgcagtccatatgccctattgagggaagggacaaaaaatttgcacccttggattttcaaaccaaaaagatttgacaattactacttcataaatattcttgaagggaaaggcttgttagttttatacaatgttcttatcatccatgacttacatggaaagattacagagcaggtgcgggcttatgcctctaatgaaaaacttttgtttgcttcatttgctaaatctatgattaagatgggaaacatcaatgttcttacaagaaatgagggggaaattaggaggaattgtaggcctggttcccccagcatggaagatattgaagccttttctgcaacaaatagagcaaaattggatgaagcagaacttgccaaatctgttcctaacaatatatgtttggagataattagaacaattagcacatccactgctcatattagaagcatacgcaaaacgttgaccaaaattgatcaagaaggagaaattctgccaaatggaacactttctgtgtatgtaacctttatcttgaaaatctga

SEQ ID NO: 38034 - DNA, 624 bp, Glycine max
  Peptide Sequence Number=SeqID_129719
atgtattttgtcaaccagcaactatacgtgcttaaacaagagttgaagcaaggaataaaactagagttataccaaattgcatcacagtactcatcgccacttgagcctcctaatatacaagtggtagctgcacgtgtgagaaccaaggggagttgtgctgatgctgacacaattccatcagctaaagagccttctaatctgcacgttgacactatgggcttgtacgtagttcatgaccagtgtactaaactagttgcattgggaaaagtgtatgatagtatgttgaccatacacaatgtcccttatgcagatgatgtggttagggtgagtgttgtcaaagtttaccacggtgatgctcaggtcctttttttgacatcagagattcaatttgtgaggcaggtcgttgggacattcgttgggtggccgacacatcttgtgaaacctgtagctaatgaggacttacaaatgtgtatgccgaaaagggttacatctgcaggaatggacacttcagtgcctacagttgatccattgggagaattggttaaaaacctttttgatgtttaccaaaagtcatttgagtttccatgggatggggcgaaatttgggattcctaatgtcaaatag

SEQ ID NO: 38035 - DNA, 114 bp, Glycine max
  Peptide Sequence Number=SeqID_129720
atggagggtatccttgtcactagagatggagagagactacgaaaactgatccaacctagtgggaaaggcttggttgttgttatgccatgtagggtttacaagggtagtgtgtga

SEQ ID NO: 38036 - DNA, 243 bp, Glycine max
  Peptide Sequence Number=SeqID_129721
atgtggatgaagaagaaatgccttaaagagggatccattggtgaggaggccagatctggccattttcattgtcatattcaaactcgttcgaggcaaggtgacaaggttgaaggagaggtgctggaaggtgcggcgcagacagcagagggtgttgaggggatgagggcttttgatagcagggttaagttaaaggggtttttttcacctttcactcaaatcttaggcttaattgctaaaaattaa

SEQ ID NO: 38037 - DNA, 207 bp, Glycine max
  Peptide Sequence Number=SeqID_129722
atggttaatggatataccattccaacctatgtagttgataacaagactgtagagaaaccttacgaatcttggtcagaagaagagattaaaaaaggactgctttcaagacttccattagactataccatttcaaatggtctatgggaaaatctgccacttgccagtagagttggagcacaggacctattgggccctcaaatttcttaa

SEQ ID NO: 38038 - DNA, 777 bp, Glycine max
  Peptide Sequence Number=SeqID_129723
atgatgttgatgattgctttctcgcctgcgacacccaactacaaatctagtgtttatgggaagatagcaatgacttctatgaaccaatggaacacattcatgaaggtgttcacagtgagcgtaagagacgcgattcatgcacatttcgtaatttctgatgcattggtgttgatgtggcaatttgtttggacccgtgtttggggggggggtgtttgcttctggcaagtgtaccggatcgcacaacctaatcctgatcaagcatcgtcagcagattcctcttgttggactaaactcgaccaagactgcattaagacaaacatacaacaactagacctcacaatcactcacaaactcatttcaagctctcaggacggcttcctcttcaagctctggtctctgcagatcttcacacaacaaaatctctcaaactctctagaacttggacctttctctctagaactctctagacatgaagaagcgtcaagaaaaggccaaactcacctccaaaatctgatttcaggcttaaataggtgcgaatggattgaagcggtgcgcttagcgggacggccatttgctcagcaaaaatgcacagctcatccttcttccagattcttcctcgcgctcagccgaggagtgttgcgctcagtggatggctcgctaagccgacagaaaggtgaagaatctttgccatgtgctgcaaaggtcttagttgtggtgacaaaggcatgtgaattggtgcaaagaaagaattctgatgaggacggagaagaaacatga

SEQ ID NO: 38039 - DNA, 261 bp, Glycine max
  Peptide Sequence Number=SeqID_129724
acaagcctgctcctaggaggttctggaggtaatggaagtgggtcaagaggttctggaggtaagaaccaagacatgatatcacccattgagtgcaagcctcgcgctaagcgcatctttggtcatacgctaagccgcgagtctcaagcgcttagcactcaacccttgcatcttaggttgatttggtccgctaaactggccaaggctgagttaagccaatttcaatttgatctgaatttggctaagcgacagcctgaccgctaa

SEQ ID NO: 38040 - DNA, 291 bp, Glycine max
  Peptide Sequence Number=SeqID_129725
atgcactacttgattgcacacatcctactccctagatcttccaaccttgcacaggccgttgaagaccgctctccatcaccacattctcaaagagatgactcttcatctcttatgcacaacattcttgaaaggtttgatggacttgaaacctatgttggtgagaggtttgactccttagaacgtcaagtggacacacgattcaaggagatgaactcaaggattgcaaaggttgaagaaaatgtcaccatcattcgcgattgccttgatttacctccaccaccatcagtttag

SEQ ID NO: 38041 - DNA, 1587 bp, Glycine max
  Peptide Sequence Number=SeqID_129726
atggagtttggttattgtgcagtgtttctgatactgcttcttccaatctcatgtggagcttctacctcacttgagaagaaattcaagaaatgcttgttaacccaactcaatggcaattctgaatccattgaaaacataaccttcacctcatcctcctcactatatccccaagtctgggattcatcagcacaaaatcttagatttgttaattcctcaaggaagcctttcatcattctaacacctttacatgaatcagaaattcaagcagccattctatgcagcaaacaacttgggctgcagattagagtcagaagtggtggccatgattgtgaagggctatcataccttagtctacgtaaggccccatttgtgatggttgacctcatcaacatccgttccattgaaatcaaccttgatgatgaaacagcttgggttcaggctggggcaacattaggtgaactgtactacaaaatttcaaatgcaagtgaagtgcatggattccctgcaggacccgttccaggtattgggataggtgggcatatcagtggaggggggcagggtatgatgatgaggaaacatggcctagcagcagaccatgttgttgatgcttacctcatagatgtaaatgggacggttcatgatagaaaatcaatgggagaagatgttttctgggccataagaggaggaagtgctactagttttggagtcatccttgcatggaagatcaggttggtcagagttccagctattgttactgtgtctgagagaccactggaggaaggagccaccaatctcattcacaggtggcaatacatagcacatgaattgcatgaggatcttttcattagagtaattgctcaaaacagtggtgataaatcgaaaacattcaaagcaaccttcggttctatcttccttggagaaacagacaggtttatcacactgatgaatgagagtttcccagaattggaattgaatgtcaattactgcactgaaatcagctggattcaatcagttctggttgatgccggatacgacagagacgaccctccagaagtcttgctcgacagaactaacgaatttaaaagctatttcaaggtcaagtctgactttgtgaagaagcctataccaaaatctggtctagaaggagcttggaaaatgcttctagaagaagaaatgtttgcctggctgataatggaaccatatggtggtagaatgaatgaaatttcagaatctgaaatcccttttccccacagaaagggaaacttgtacagcatagaatacgtggtcaagtgggaacagaatagcaaggaaacttccaagaagtatctacagtgggctaaaagggtttatagatacatgactccttatgtctcaaaatctccaagagctgcctttttcaactttaaggatcttgatttaggcaaaaacaagcatcacaacacaagctactcaaaagctagtgtttggggcaataagtactttaagggaaactttagaagattggcacaaattaagacaaagtttgaccctcaaaatttttttaggaatgaacagagtattcctcttctacatacccatccttcttag

SEQ ID NO: 38042 - DNA, 1089 bp, Glycine max
  Peptide Sequence Number=SeqID_129727
atggatttgggaagcgaatccgtggaagagaacgaagtgaatcatgatgggaatggaaacggtggttcttatgatgacgagaagattgggttgggtttggagggaaattcggatgtcaacggttcggatcaaaagggaacggttggcgaagttgaagtgggtagtgcggaaggtgtgaattccaaagggacaccaacaaaggggtttgggttgaagaaatggaagagaattcggaggaatgttgttaaggatccaaattcgagtgttgattcgggtaaagtcttgaagaggggcttgtctggcaatgccaatttgagtgaaagccagccttttctgcgcgatgttaaggagaagaatgaaggatcttcaaacatgtttgggaatgtagtgttctctgatggcaatgtgatccatggttcaagttcggattctagatatgcacttggatctggttttgttgttgggactgattctgagaatagcgaggatcagagtagcaagtcttctacagcggctagtgagcccaagttgaggcaagagaaaagccgtagtaagaatgtgaattcaaagcatttagctaactcggctcaacgagttcaaccgggaaagggacgaactgaaggcagtaagaaaccaggaggaggtggaagagtgaaaattgagaaggaaaattctttttctagtttggaatctgattcaagaagctccaactttaagcaaggtgttttttcggttactagtaatggaaagcatactagtaggccaaatgtttacgatggagttaatagtggtgaagcacacactaatgaacatttcactgagggtgttgaggctggttatggtaacgaaaatgttgttgaggatgaatatcttttacaagagaatttgggtacaaatttgtcttgggatgttacagaagaaaaaagtgtgaacaaccaatcttcagccgttgaagatcctataattgaatcggttagttgccttcaggctgtccaggaggcccttcaagaagcaattgcaagtttttggcataatgttggacattctgataaatatttcaccgatgctttaaacgtgttacctaattga

SEQ ID NO: 38043 - DNA, 552 bp, Glycine max
  Peptide Sequence Number=SeqID_129728
atgccccttgctaatagagctactttttccaaaatttatcttggtgactatcaaaaataccctaaaatagtcattcttgaggaatgggtggattgtgaaatgatagcaccggatgagacttctcaaaagaggaaagcaacctcgtttagtactgaaagtaagggttataagaaaaacactactgataagagtgatggtaagatcaaacttcctccaaaacccccaaaaaccaaagatcatgtgaaggaaaatttaggaaaaaattattccaccttttctgagtctagaaaagtgattgagacacacctttcaaatggcatattgagagatacatcttggctatcttactcgcaggatgtgaatgtagtagacctttcttcctctcaggttcattcgaacccaaaagatggcaaggatgaaggaactcatgacactcctgctgttagttctaatgccaagagcattaataaagaatcaaatgttttagactctaaaatgcatgtttcgccattagaggtgaggaaggcagcagagaagaatgaggaaaaatag

SEQ ID NO: 38044 - DNA, 780 bp, Glycine max
  Peptide Sequence Number=SeqID_129729
atgtccactacgagtcatgccactcgtaccaaaaatattcatgatcttagtagccggcatgcaattcccaacacgcatgacgaatgcgtcttgccttccgctaggtccctacgcgttatacttccacggtactgccttgtcactcttataagggaaggacgttggcatctttgctacaaagggctggaaacctcaagctacacactgcttgaaggattgccccaggacgccaccgtgataggcgcatgtggcattaggattgtaccatcggggaaatggatcaaggatggtagcaggtcggcatacgacattaggattagggtgaacttcgcgggttttctttctgggaagttcctcctcaggtctttgtggttgattgggcgttcttggtcggaagggcgttgggtaggggggagagctgatattggccgagtaattggtgcaaaggatactggtacatggggttgtgaagggtttgttgggagcttggccatgtgggtgttgtggtcacgggcaatactgagggccccacaaagcatttggcaggggtacgccaccatatgtttgcccctcaatggcatatccgaggtgaggctcaaaatcggccaaagtgtggtctcggggtacttcatgtgtctcccccataggttgaaggacatgtgcatgaccggactagggttgttggctctcaatgggtatgggagcgaaattgtcgacattctcatcaggcgcgtgtgcaacattgggtggtgcaacgttgggaggcaagccatacggtag

SEQ ID NO: 38045 - DNA, 540 bp, Glycine max
  Peptide Sequence Number=SeqID_129730
atgtctcaaagttttgatatgattggagctattgatgataacaaagaaacattcaagcttatagttcgaattgtggaccggagggatacagtccatgccatttttaagaaagatgatatggaaagttgggaagttggacttaaggaagggaaagcgcaagtcgatcttgctgaaattcctcttcaatcatacgagtttatgagttttgaatacatcactcatggcaattatgatcctattatgttgattgatgtaattggggttgtagaggaggtcaaatttcagcttcctaatgggaatcctacaagattagttttaaaccttaaagatctgaggttgagttctgtatgtttgggagaaccatcaaatgtcagtcagtccctcagtatagggcaatattctcaggattctgacttttcggagcttgatcgctttttgtacaagtccaaggtccttagtatttcaaacattcgtgatgctgctggtggcactaatttcaatactattgggaatagctccaagttgatcatgaagatgtag

SEQ ID NO: 38046 - DNA, 243 bp, Glycine max
  Peptide Sequence Number=SeqID_129731
atggggtcagatcaagtgtcatcttttaagaaaaggttctatcatgtcaaagtcaagaatctagaagtagccagcttgcaaaaactaggatgcttcacttttggggactttcagctagcaccaaccatagaggagttcgaagggatcttaggatgcccgataggaggaaggaagccataccttttttctgggtactatccttctatggcgagaatagtaggagtgatcaagatctcagaatga

SEQ ID NO: 38047 - DNA, 744 bp, Glycine max
  Peptide Sequence Number=SeqID_129732
atggcggagttgcgtagcggatttctgaaaaaatgccaccgaatagcggtggcgtggcgggttgaagatggcggcgccatggcggatatggcggatatggcggcgaggcggaaaatggcggaatttgttttgtttttttggtccgcggtaggagttgggctgacccgacccaaccctacccgcatggcagcgacgacccacagcgcgaacggcggcgacgagcacggcgtgaacgacggcaacgagcacggaggcgatgacccaacccacacgcagaacatcgcgacttatactgccaaacaacacctgattaggaagtcgggtaacgttgcagcttgcaagaaaactccaccaaatgtagtcgaagagttgaaggaatatatgactataaaaaaaagtgggaccacttacagtacttttggcagtggtaatatgacaaatataagagattttgaatttggtgaaccaattggatgtgatggaagtgaagaagatgagtttgcagactcttgtaatgctgctgcaagtgcaaagacaaagtgtggaactaaaaaaggaccaatggacaaattttgtaagaatccagaaaatgcaatcaatcggagaaaaatgaagatgttgaggcaaatgaacattagagagtcaatggataagaatgaagtattgaagccattggtcaatatgggccacagttgcccattcctagctatcgtgacatcagagttccactcggggatcctctag

SEQ ID NO: 38048 - DNA, 1020 bp, Glycine max
  Peptide Sequence Number=SeqID_129733
atgcatgtagaattttctatcagcccagaacttgtggctttaactttgaacctcaaccttcttggagctgttggattggcaatatgggttccctcagtgacaaaccaggtgaaggagagtcagacacctgattcaagtaaatcagcaagaggatattctccaatttcacatgctggagatgataatgaggataactggagacaagccaatgatgggaatgatttagaactcagtattgttggagatggcacagatcttgaaccaattgatacggaactgcttctggacaatcttcaggtttcccgggccatgtcaaaacaatatctgaaggttttgtcatctttaactctgaaagatgcaatgaaatgcatgcatgacagccagcagaagtgtgtgctggtagttgataaagaagattttctagaaggaatattgacatgtggtgacgttaaaaggtgtctgtcccagaagtctaatgacactttgaagagcgattcagggattttggataatgtgggttttggcttaactcaacctcaaaagttagctcttaaggctttgtgcgtggataacatggtgggcgaccttttcaatggatctaggataggttctgatatcatcttagaatgtggatttgtgtctaactcaaccccaaaagctagctcttcggatgaggggatgacctatcgtggacaagagcgaggaattttaacctgctatccaaatactagtttggctatggccaaagagttgatggaggccaagggcattaagcaattaccagtggttaaacgtggtggagatcacagtagagaaatgaagaggagaattgttggtcttcttcattatgatgcactatggcaattcctcagacacgacgacggtcacaaacgaattgatgaagatgaatcacggattgatgaagatcaaacacggattgaagaaaagaggatgagagaatttcagagggtgaaactgaaagaagaaaatggtgtgagcgtgaatggtgtgagaggatag

SEQ ID NO: 38049 - DNA, 237 bp, Glycine max
  Peptide Sequence Number=SeqID_129734
atggcacgttctctagacaagataaagagcatcgatggcttaaaagaaactcttaaacttagtgtgaggatcagtgatctatggtttattggcacgcttaacaaatctgagcaagctaagatggtgtttgtggactccgatatttattacttattgttcaggccattgtgttgtaactttaatgcaatccagggtgatgagatccacgttgtttgtaaacaagaccaactgaagtaa

SEQ ID NO: 38050 - DNA, 462 bp, Glycine max
  Peptide Sequence Number=SeqID_129735
atggataaaggctttgagagggctagcagcagcaatatagcaaaggaaattaacattatgtatgtagaatgggaagtaggaagctgtagccaagtagaaaaggacattgattgcatggctgcagatttggaaggagaagaagacatgccaattaacttgaaagatgagtattggattgatgatggtgttgaatctaacaatgaggaatgttttgaggatgaatttgttgaaggagagcaaggaaatgatgtgtttcatgcaattgaaagtggtggcatagactgtatgcaagacattgcagatctcaaccttatcagtgtgcctactgaagaattaaccaagtgtcattttccaaatatcaaagtttcttatgagttttacaattggtatgcaagagggaagggctttgctcctcgtaaagtcaagatactaagaaatagcaaatgtgagcctacatattag

SEQ ID NO: 38051 - DNA, 936 bp, Glycine max
  Peptide Sequence Number=SeqID_129736
atggcttctccaccagcctcacctcctcttcctcctccttctccttctgacgcattagcttcgccgtctgccatgaagcggacacagaaagcctcacgtctacgatcgttgtctactagaccagctagtgctgagagaccagtggtccacgttgatcctgctactggaaagtccgacggtccccacaggaagaaattaagaacatatttgtggattgtggcgcgtgataaggtggacgtgatgtacgagaactggaaggaggtccctactgctcagaaggacttgatttgggaggatattcaggatgtgcgaaaaaaggcacaggcgatccagaaacagaacattgcctcccacgttttgtctcgtgggggttatgaatatttggagcagaagctcctggctgagaagaccaagaagaagctggaggaagctgcacagtcaggaagcattgatggcgtcatcgaccctccatcccccgtcagacgccacgtgaagtggacgatggcctgcacgaagaaaataggggagatgacgactgaggccgcaaaggaaatcgctgagaagatcgattattcctttgaggagcaggcgacacagggatccttcgtcccccatggacgtcaggatgttctcaccgctgctattggacgtccagagcaccctggacgtgtccgtgctgctggagccggtgtcaccatcaagcaatacttcggatcggctccacggatgtctcacagctcttcctccctgcctcctgaagaattgcagcagctgacccaacaaatcagggaccagctagaggagtcgatcaaagaaaaagtgactcgacaactcatggcatcgttcagccagatgcagtcccagtttcagtcccagatgcaatctcagggacttgcactacctccgaagcatctggttggtccctcaggtccttga

SEQ ID NO: 38052 - DNA, 195 bp, Glycine max
  Peptide Sequence Number=SeqID_129737
atgactaatgcaaactgtccgcaagaatcattgcattccgtctcaaacgggaatctaagaggtatgatagaggtggatggaatatgtgacaacctagaagaattaggttgtgagtacaccagccaacccactacttccgaaaccagtagacctgacctcttgagtggaggaggatgtggcagcaaaggtgactaa

SEQ ID NO: 38053 - DNA, 120 bp, Glycine max
  Peptide Sequence Number=SeqID_129738
atggttgcacctgacttcacttatgaaagcttgtgcattcaatatcctgatgaggatgttccatatgtgaagatcctcataagcatcttaaggagttccatattgtctgttccaccatga

SEQ ID NO: 38054 - DNA, 575 bp, Glycine max
  Peptide Sequence Number=SeqID_129739
ggtacatctacttgggtttgactgagaacaagagaggatacatctcttgtggatcagttctagtggagggtacatccactaggttcaaagagaacaagggaggggggagaagcatttcaactgaaaagtttctatcaaaagaggagagcaggatccaagcaccaacaaagccctctaaggaacaagataagattcaaacgcctacaaagaaggctaatgctaatggaactgtggaggaaccagaaaagtatagtaagctaagaacttccattggaaagaaatcagctgaagtttctaacagtggactccctggaaacttggtcaaagttactctaagtaatacaaaagtaacagatgcaagtgttcaatgggcttcactcccatcatctatttcaaagattggaagggaagtaatgaaacacagagatgcggcacagatagcagcaactgaggctatgcaagagcctattgctgctgagagtttactgcaatgtctaagtcgcaaagaagaagaagcgaagaagaagaagaagcaaagaacagagcgcgaggaaagtgtagggctcgggttctga

SEQ ID NO: 38055 - DNA, 387 bp, Glycine max
  Peptide Sequence Number=SeqID_129740
atgttgagtcctatgaaagataaaggcgaggactttgagtcctatgaaaacataaagataaaggcgaagactttatgtcctatgaaagataaaggcgaggactttgagtcctatgaaaacataaagataaaggcgaggactttgagtcctatgaaagataaaagcgatgactttgagtcctatgaaaacataaaggcgaggacgttaagtcctatgaaacataaagcaaaggacgttgagtcctatgaaagcataaagcaaaggacgttgagtcctgcgaaactaaaagcaaagaacgttgagtcctatgaaaacataaagcaaaagacattgagtcctgcgaaactaaaagcaaagaatgttgagtcctatgaagcatgccaataa

SEQ ID NO: 38056 - DNA, 381 bp, Glycine max
  Peptide Sequence Number=SeqID_129741
atgaatgtcacaactgagagagatagcaaaagggttagagaggagtggccacaggttcttatgggtcgtgaaaaggccaacacaagacgagggaacaaagcatattcacgacataacagcaggggaatgttccgacttgagttcaagggcaggggcctggtggtgaggtcgtgggccccacaagtggaggtggaactcggtgttggaaggggtggttgccggggtgccaatggttgcgtggccactgtacacggagcagcacgtgaacaggcacgtgatggtgtggagatgaatgtggctgttgcggtggagcaaagggaagaagatgagtttgtgagtgaggaggaggtggagaagaggctgagggaggtgatagtgtga

SEQ ID NO: 38057 - DNA, 195 bp, Glycine max
  Peptide Sequence Number=SeqID_129742
atggggcatctagcttgggccgatgcatttgttgtcacaacagattcagttaacatgataagtgaagcttgcagcactggattgatacataggttctacactgactgtggtgcagactcttgtctcaatcagcacaaaatgttcggtaccttatgcattaataataataaaataatcttggttcatacttcatga

SEQ ID NO: 38058 - DNA, 255 bp, Glycine max
  Peptide Sequence Number=SeqID_129743
atgaatttccgcgacaagttcagcagctatagaacaacaaaagcaaccaaaaaatcaaaagccaaatattccaaaaccaacaagaatagaacaacgctgagaaaattgagactccattggacgttctctgacgacggcggtaggcaacttgaccgttgcaagtcggcggtcgctgtggttatgagtggtgtatatggttgtggcgctgggagaattgctgacaatgaaggagaatataagttacgggaaggttag

SEQ ID NO: 38059 - DNA, 768 bp, Glycine max
  Peptide Sequence Number=SeqID_129744
atgacagcgactgcaggaggcaatgccaacaataatccgatgacgatcatgtaccctaagtctcgctctaccgtttacaaatccttggttcccctttacttcactcacggcgtaacgacattgcttcaaaagacaaatgcatttctctgttgccttctaggtttccatcaaagttttgcacagaagatgattagggttgacgatttggtccgttgttactattgtggagggaagattctggtattaaagtttgtggtcttaaaagtgaagattgtgctcaagaaaggggttcatgatattggtctaaaagagttgacccttgatagtgacgctcttgagttgacaaatcttgcattgagtaacaacactgaagtcttaatttatgttgagaaaatcaatgatggaagggttgttgttagtaagggtgatgttgtagcacttgatggtggggacgaaggtgttgggaatgaagttgttggggttcaagctgttgttaatgagtctgattctagtgatactgagtctagtgaaggtggttctaaaagtgggtctaagaatgataatgaatgtgttattttcgaagatagtgaagaggagagagcaaccggggtcaatgatggttttgatagtgaggatgagagtttagttaacctcatctcgaagaaaaaatgcagaaaagcttctcatgttggatctagtagtggtcattggaatgttgaagaaggaaatggtgaattaagtgagggatatgaaactgaagagctttag

SEQ ID NO: 38060 - DNA, 534 bp, Glycine max
  Peptide Sequence Number=SeqID_129745
atgagagcgattgtgaaaatcaccggagggagattgggcagcattttagggttcttcaataggttcattcattcgttgccccaatctcctcctttatctgtgaccattgattttagttctccaactttctcttcttcttttgtgggctctatggagctcatggctgtcccaaaacgcaaggtttctccccataaaagaggaataaggaatggaccaaaagctcttaaacctattcctgtcatagtcctatgcaagaaatctctccaagtttgggctcacattcgtgatttggctcctttctgtaggcgtttcacttctttacagcgcattactgactttttaattaggggcagatccacatcaggtgttcaaggaaaattatgttgtctggctattgcaattacagtttactgtatctgtctgtctaggaacaagcagctgatttttgaagattatcaattttctgtaatagaggttattaacaagattaagtttcttatgtatagacaagcgcacctgttgcaattgttttaa

SEQ ID NO: 38061 - DNA, 288 bp, Glycine max
  Peptide Sequence Number=SeqID_129746
atgtctcatgagtttagcctaatcctaactagactttgtcctcagatgtctcttgttgagcttagcctaaccggacaacattacggttacaacataccgaaaaaccaagttaccgcactccgtgtccagatatacgataaattagccttgtcctatcaagttctaagatcaaaccatttcccaatgaggatgattctaactacacataagttaccaactgaggatttagccttccattgcaaggaagctcctttttacaagtttaaagaagagaagaagagaaattga

SEQ ID NO: 38062 - DNA, 468 bp, Glycine max
  Peptide Sequence Number=SeqID_129747
atgggtcagctccagcgacaagcttttcgcaaaacttacggtaaaatctgggacctagccatgatagaagtctccacagaggccatttcctccctcgcccagtattatgatcgaccgttgagatgctttacctttggggacttccagctgtcacccatggtggaagaatttgaagagatcctaggatgtcctctagggggaaggagaccatacctcttctcaggaaaatgtttggaggcaaaagcaagaaccttggcaggtaaaggcgaatgggccccgctcatagacattctcgcactgttgatctttggaggagtcctctttccgaatatggatgggttggtggatctagcagcgatcgacgcttttcttgcctattgtgaccatagggaaagcccggttgtcgctatgctagccgacctatatgacaccttcgaccgaagatgtgagaagagcagtacaaggatt

SEQ ID NO: 38063 - DNA, 243 bp, Glycine max
  Peptide Sequence Number=SeqID_129748
atgccaatctcccccggcagatggatcgtgcccacaagacactcagtggacccgaagaagtccaacagggccctggggtttccagctctggttacgggcctctgtagtcctacagggtgcccgtttcacccaacgaggtcatgtcatcgtgacataggaatcgcacccacaaagacacccagtgggcccggagaagtccaacagggccctggggtttcctgctctggttacaggcctctgtag

SEQ ID NO: 38064 - DNA, 237 bp, Glycine max
  Peptide Sequence Number=SeqID_129749
atgcatggtacttctcgaccgtgtctccgaaagacagttgaacgagcgactcatgaatgctgccgggttggacgagccaataactcgaacgcgttcgaagcacgaccgaccggggtccaagataatcaaaccatccgtaacagtagtaacgtaagcatgagactttttggtagtaccggtgaaccagatggccgcggcgatggaatctgggacggaggactcgtagtatctctctag

SEQ ID NO: 38065 - DNA, 231 bp, Glycine max
  Peptide Sequence Number=SeqID_129750
gtgtcgagggaaggagcccagagtatgaagaacctcagggatttgaggtcaaatcctttccaagatggaggccggatgatgcaatcctaccccccaagggtattagatagaagattgcaaaaggattgggctaaagctgctaaagaaggccctggggttctcatgaacctaagggtagattttttgagcccatgggccaaggttgggtccactcttctttgtaaatattag

SEQ ID NO: 38066 - DNA, 219 bp, Glycine max
  Peptide Sequence Number=SeqID_129751
atggattcctttgcttcctggaagatgaatggaagcggaatggagaaggaagagagagagaggagatgccacttcaaggagaagatgagtctagaagaagctcaccaccataggagggcatggataagagctttgaggaagaagaagatgaatgaagggagaggaagagaagaacacgaaattttatgctctaaaagagctctgaaatctgatgtttaa

SEQ ID NO: 38067 - DNA, 303 bp, Glycine max
  Peptide Sequence Number=SeqID_129752
atggcgagtcaagaagagtgggtcccatttgcgaatatactagctttgctaatctttggggttgtcctctttccaaacgtggacagtttggtggacctagccacaattgatgctttccttgcatatcaccatagcaaggagagcccggtggtagctatcttggcggacttatttgatacatttgaccgaaggaggcagcacaatcaactggtttcctcgatggaaggaaggcaaggagggagttctcttctcatgtggggactacccaaacgttccgttgatagggacgaggggttgtattaa

SEQ ID NO: 38068 - DNA, 399 bp, Glycine max
  Peptide Sequence Number=SeqID_129753
atgaattgtgttttcgttcatgcatcctccacccacgagtttggagccatgcatagtgattgcttagtgcaattctccattctcaaccctttttcggagcaccatgaattgtggttttcgttcatgtgtcctccacccacgagtttggagccatgcgtagcctcctccacccacgagtttggagccatgcgtagtgattgcttagtgcaattctccattctcaacccttttcgcagccgcatgaattgcgttttccttgatgcgacctcgacccacgagtttgcagccatgcgtagtgattgcctagtgcaattctccattctcaaccctttttcggagccccatgaattgcgttttcattcatgtgtcctccacccacgagtttggagccatgcgtag

SEQ ID NO: 38069 - DNA, 258 bp, Glycine max
  Peptide Sequence Number=SeqID_129754
atgggtatgtttaactcatccaaacatggcgatttcaacaagctttcaacaagagtcttcacaaataactatcatgaaagcagaaaaactaacaaaactacccatcatatctcccaaaacccatacccacaaaaatcaaaggagaaagaagtccacccaaacctgaaatttcgaagtcccactcgtagacacgcacttcacgactccgaaaatgccctcctttcgcgatttggagcagaaatgggcaccaaaggttga

SEQ ID NO: 38070 - DNA, 396 bp, Glycine max
  Peptide Sequence Number=SeqID_129755
atggtcttaaaggaggagttagccgcttgctcaagatccaagaagagtttggcccaacacgtagaagccacggagcaaagcatgctagctataatagggcagtacaaagaagagttaaaccagtctttgacccatgagcaaaagctagtaaaggacttcgtgcaagcatacaccgagaaggaagcaagagggagggtgattgatgcattgcatcaagaagcgaccatgtggatggataggttcgccttgaccttaaatggaagtcaagacctcccgcgactactagccaaaggaaggggcatggccgaaggaagcggaaccggtgctacagcccgcaatgaacttgggctgggacagaagcgcgacgggtttcaatcggagggtgggatcctctag

SEQ ID NO: 38071 - DNA, 435 bp, Glycine max
  Peptide Sequence Number=SeqID_129756
atgaaaagattattaaccctattggccattgtacctattttgtttgctgcttgttccaagaaagaagaacctgtacctgaaaaagaaaacaaattatatgaagtaaagttttcagcaactggccttgagcaatctcttgaaccgattggaccaaaatcgtctactaaggcaagcacgcaagatccactgttaaaagatgaaattaatggaatacaattcttcgtgtttgacaacctatcaaatttagtaggatccaagtattcggatttatacgatacaaaaggaaattttataccaggaagcttgaatgtgaccatggaacttccaaaagattttccgtctacctactctacgaaagagattatccaattttcgcccatattcattcataaacagagccagctcactgttgggacatcagccgtgaatcatgcg

SEQ ID NO: 38072 - DNA, 102 bp, Glycine max
  Peptide Sequence Number=SeqID_129757
atggaggtgtcgcaacctaacctttcggcgggagggcgacgtgagactcactgggaaggtattagcaccccacacgttcgtcacaagagacgacaaccttaa

SEQ ID NO: 38073 - DNA, 210 bp, Glycine max
  Peptide Sequence Number=SeqID_129758
atgacgactctttgcaaatctagaagaaggtatcgatgggcaataattgccaattttggattctttacaattcaagtcataagcccaaatgagatgttcgtcttcatggggaatagagtgaaaactccagtggaagcattcgggacttatcgtttcaaactcgacattggacatcatttagatttactagaaactttttatcttatttaa

SEQ ID NO: 38074 - DNA, 831 bp, Glycine max
  Peptide Sequence Number=SeqID_129759
atgacaccttcgaccgaagatgtgaagaaagcaatgcaaggattgtttgctgtactccagctctctaggtggggctggtttcacacctttttctccaagaaggcaggcccgtctatccgctacaaggaaggaagaatcaagattccatcttcatgcgaaggatgtccaaatgttcccttgatgggaacaaggggttgtattaattataatcccgtcctcgccataagacagcttggctaccccatgagaggagcgccattagacgaaagcatcacgcctttcatcgcacgaggtttcagtgaccataacgcgagggacagagagcttaggggaagcagtaatgggatcatcggcggctatcataagtggctgagagtccgaaaacaaggattggattggctcccaaatctaaagactgtgagagacgatgaggttaaagcttcggaagaaagtgatgaggtacaagcccaaaaggcagagcttgaaagagcctgggtagtcgaagagaagttcaaggcagcaatagtgagctcaaactctgaagaggtgaaaggaatcatcatgggtcaaagtgagactgaagggaatatgtgggccatcatcgatgagtgcaaagagaagctaaatctagcggcgactcacgagcaaaggctagaagatgagtacgccaagatatcagcagaaagggaagcaagggagagggagtcaagaacttccccgattgctagccaaagccaaagcaatggcggacacctactccgcccccaagaagatccacagacttctcagctattgtcaacatatgatagacttaatggaccatatgattag

SEQ ID NO: 38075 - DNA, 360 bp, Glycine max
  Peptide Sequence Number=SeqID_129760
atgacccctcttacaaagatatggatgacgttgctacttagcaacattctgcccaacgaccacaataccgatcttctcctacggaaatatcagctgtcctaccgggtgcccgtccccccagcaaggtcacgccatcgtaacatagggatcacgcccgcaagacacccagtggacccggaggagtccaacagggtcctggggtttccagctctgattacgagcctctatcagttctacggagtgcccgtcgcccctagcatggtcatcaggccccctactaaccaagctttcatcaagaagtattgcgcccccaggcaagcgcagtgcgtgacaccacaacagcctggggatggctggtag

SEQ ID NO: 38076 - DNA, 240 bp, Glycine max
  Peptide Sequence Number=SeqID_129761
atggcgaaaatacaaggtccaaaagaaggaaaaacctattctaatatttacaaagaagaatggacccaaccttggtccatgggctcagaaatctaccctgaggttcatgagaaccccaaggccttctttagcagctttagccgaatcctcttggagtcttctatccaatacctttggggggtaggattgcatcaccgtcgttgtggaattcaaatcatcttaaaaagatacaatttctaa

SEQ ID NO: 38077 - DNA, 204 bp, Glycine max
  Peptide Sequence Number=SeqID_129762
atgtgggtcatcatcgaccagtacaaggaaaagctaagccttaaagtgactcataagcaaaggctagaggacgagtacgccaagatggacaagtttgcctttactttgaatgggagtcaagagcttccccgactgctagccaaggccaaggcaatggcagatgtgtactcaactctcgagaaggttcacaggctccttaattaa

SEQ ID NO: 38078 - DNA, 258 bp, Glycine max
  Peptide Sequence Number=SeqID_129763
atggaattaaaagtgcggcgaccttggtcatgtggctccgctccctcccaagaaaccgagcaggataatcatgtcttcatccatatgggattcatccgcctcatcgggggattctgtaacatcctggaaatttctatccggaatttttggaaacgatgtattttgaatgagtatatatataaaagtaggaatagcggggggcaagatatgcgggttaggctaattaagggagagaaatccataactgggaggttatga

SEQ ID NO: 38079 - DNA, 216 bp, Glycine max
  Peptide Sequence Number=SeqID_129764
atgagggagatgctactggttgagatccttgacactgttttcctgacctcaatgattcgaccatctaaggttgggatgattcctccatccgagattgtacctgttgctggagagcataagcttcatgctgttcaattacttcagattgttgcacaaaagggcaaaggtctacgtggtggtcagcagaggagcataaaccacagagtctggcgatag

SEQ ID NO: 38080 - DNA, 207 bp, Glycine max
  Peptide Sequence Number=SeqID_129765
atggatgtcaagagtgccttcttaaatggtctaatccaagaggagatatactttcttgagaacaaatctaaaaagagaaatgaagaaaacaaggatgttcaaggaactcatagcccaagaaaagatgcctccaggaatggaaaacctcaagaaacatggcctcttgacaatatcatcggagatatctcaaaagggttgctaccttga

SEQ ID NO: 38081 - DNA, 183 bp, Glycine max
  Peptide Sequence Number=SeqID_129766
gtgttctctgaaggactcggtaagtgcgcttactgcgctaagcgagttcatcctttgggtatgaagcaaagcgtcagtcatgggctgaattccttgcgacactactgtgagctaagcgatttgttatctgcattcgctgagctaagcgagcttcactccgacgctaagctcccaatactgtag

SEQ ID NO: 38082 - DNA, 231 bp, Glycine max
  Peptide Sequence Number=SeqID_129767
atgtggctatctagacgcttcatctaccagtcgctgcaagcggcatgcatggtctcccgtggcggagacgaaagggacgaatgtttgtttcacctcggggagtcgcacgacatggaaacctgtcccgcggtggaagaattgcttcagcggctcatggactgggggcagcttgaagtgtccaaaggagggagggaagaaccacagatttgcatgcagtcggaagaaaagaag

SEQ ID NO: 38083 - DNA, 178 bp, Glycine max
  Peptide Sequence Number=SeqID_129768
aatacaacttaggcctaaggccactgcctacaaccctcaaactcaacaaaaacaagcacaattcaaggataaatccctcacattttttagcaaatacatgcaacttagagcaccaaaatacatcaatggaaagctagagagcccaagaatgaggtacttacctgttggagatgaataa

SEQ ID NO: 38084 - DNA, 771 bp, Glycine max
  Peptide Sequence Number=SeqID_129769
gtcgactctagaggatccccgggtcacgtcctcatcttcagaggactacatgtcctcatcttcagaggactacacatcctcaccttcggagggctacacgccctcaccttcagaggactacaagtcctcacccttagaggactagacgtcctcgcctttagagggcgacacgccctcacctttagaggactacacgtcctcgccatcataggactacactccctcgccttcaaaaggtcctctgcccttaaatgcttaaccgagactcgtgctcccagttacggggccagtagtttccttttatcagtttctgggccaccccctgattctggaggagggccaactatgcaagtacaaccagaggaggaggctatcgtgcagctactatgcataccggggcaagatttcacccgtgtcgctgcaaagagacaagtgcggatcgtgcgcaccaacatgatcactcttacacagatatgtatgacattgctacttagcaacattctgcccagcgaccgtaatgccgatctccccctgcggaagggtcacacccgcaagacacccagtggacccggagaagtccaacagggccttggggtttccagctctagttacgggcctttgtcagtcctacagggtgctcgtcccccccagcaagggatcgtgcccgcaagacacccagtggacccgaagaagtccaatagggtcctagggttttcagctctgattacgagcctctgtcaattctacggagtgcctgtcgcccccagcaag

SEQ ID NO: 38085 - DNA, 457 bp, Glycine max
  Peptide Sequence Number=SeqID_129770
atggaggccacgaaagagcaaatggccacaatgatgggggccataataagcatgaaaaagataagggaagtcgatatggttgcagttgccgctaccaacgctgttgctaaggtgaacccgacgtccccatccggcctcaagcaaatgaatcatccaacctcaaatatggtaggcaaagatttaggaagtacggatgaccccatgacgtgcaaattcaaaacaagcacgccttcccgccatatggcttgcctcccaaactatacaccacccaatgtggcgtacattcccaatgaggatgtcaataactccactcccatacttattaagagccaacaacctcaatctgatcatgcacatgtctctcgacccatggaggagacacatggaatgccccaccacaatctagccgacttcgagccttgcctcggatatgccactgaagggaaagcagttggtg

SEQ ID NO: 38086 - DNA, 187 bp, Glycine max
  Peptide Sequence Number=SeqID_129771
atgggggtgtgtgacatgtcgcaacgtgcccttcgcgggcgagcgagggcgaggcacacgggtgcgctttccaaagaaggaaagatgcgcggagtcgccaccaacgaaggtattagcacctttcacgtcgacaaaagcggggcttttgctcctacgtaccctccatcgaagaggaaatcagacctac

SEQ ID NO: 38087 - DNA, 252 bp, Glycine max
  Peptide Sequence Number=SeqID_129772
atggctacagctaggtgggcactcaagcatccagtttatggcattgtgatactaaggcttgggatttacacaaataaaagaggaaacataaaaaaggaacatgaatctagggatcccctggtcatgtggctccgcatgccaccggactcttgggtcacggtaacaaaaggcggggtggtcgcccaaagcagggcttttactcctacgtatcctcaatttgtgatgaggaactcggacctacgtagttcttga

SEQ ID NO: 38088 - DNA, 498 bp, Glycine max
  Peptide Sequence Number=SeqID_129773
gccccttccacttctgcagcggcagaggcaccagcaccttcttcttcttcagtacccccctcttcatccactcagattctagttattcctcctacaccgatacagatgccacttctacctcctctatctgcaggaccatcagatttcatttttacaccacagatgcttcactccatgcttcagagtatccatagggggcagtccattatgatgcagagccttcaaggcttaggcttgccctccattatcagcatggaggagtttgatgctcaggaggcctggataggagaccagccttcttcttctagagggggtggggcctctacatcccaagagcctaatattgaggagccactagcactagcaccagcaccagcaaagggggaggatgagctcacccctcctgagcctttttactttgacactgatgtgcacatggctcaggaagagggtacctccacaaatcagatacctgagccatcctctgcacctccttag

SEQ ID NO: 38089 - DNA, 348 bp, Glycine max
  Peptide Sequence Number=SeqID_129774
atgctgcaggtagactctagaggatcccctcctcaagtaaatgagttgttggatgagggtttggttcgcaagagcttaaatccttgtgctttgttggtgcccaaaatagcaccactcattgagttggttaggaagcatgttccttcatgcgaagatgcccaagaaatgggttttcagaccttaccttacttcaacataccaaacatcactaatatatatgtttttgttctttttacaagtgttgaggaaaaaagcccagagtttcaagaacctcgggatttgaggtcaaatccttttcaagggggagggaatgaagtaatcctaccccgcaagggtattggattgtag

SEQ ID NO: 38090 - DNA, 267 bp, Glycine max
  Peptide Sequence Number=SeqID_129775
atggaggagaagagcaagcgtggacatgaggaacattcgtgtactgaaagcccaacactcaacgtcgacccaccatccccagttgcaagacacttgaagtggaagatcgcccgcacaaagcggcatggccaaatgacgattcattacaggaacaagcaacacaagggagttttgttccgcatgggcgacaggacatactcaacacggcccttggctgacctgagcatccaggccgtgttcgcgtcccagggacaggtgtcacaataa

SEQ ID NO: 38091 - DNA, 796 bp, Glycine max
  Peptide Sequence Number=SeqID_129776
aacacgaggtctacgtcgtgtgttaggcacaggtagaggcagagaccttagtcagcatgtggctgaggatgttcctcggcgtcgtaggcccactgcctcagcacgtaggcaacgggttacccagagagtcgaggatgttcctcagttagctgaggatgtgcctcttgcgtttgatggtagcccagagaggacaggaaccgccgatggtgctgagtctgatcgagtggctagtgatgggacagctgctgatgatgaggggaaagtagataaatttgggagaccgactgctgagatcaaaggtatgattgcggccaccggattggatccattgatcaggtgttctgtgatcaccactgatcctggactcatatccgcctttgttgagaggtggcatagggagacgagcagattccacctcctagtaggggaggtgacgatcactctagatgacgtttcgtcgctcttgcacattccaattactggcgcactgcattcattcgagccgctggctacatctgacgcagtggccctattgacggagctacttgaggtcaccccagatgaggctacagctgagacaccttggacttacctacttcatttagttggttgcacccttttcgctaacaagagtgcaacccatgtccatgttgtgcacctgcaggcattcagagacctaggacaggcaggggcattctcttggggagtggccgctttggtccacttgtacgatcagcttaacgaggcgtcgcaagcccctacacggcatatagctggttacatttcactacttcag

SEQ ID NO: 38092 - DNA, 234 bp, Glycine max
  Peptide Sequence Number=SeqID_129777
atgccccgtaggcctctctcgggtgacctaagcatttggtacttcgatcttttattaggttggcgccaggcttttcgccctccactttgtgccttgaggctggctttgattgaagaaaaagctgctgtcaactccaaaacctctgggtcggatcctgccccacgtggtcctcacttcaggtcccacatttctcttcctttgtttgatttccctcaaatctcttgccccttctag

SEQ ID NO: 38093 - DNA, 1663 bp, Glycine max
  Peptide Sequence Number=SeqID_129778
atgccgatggtcaacaacgaggccagcccgttgcgatcccccagcgcggcgcgcagcttgttttttaccgggttaaagatgacggtcagaatggcggcccacagaatggcggagaacgcatcagtcagtcctggtgcctatggcctggcgtccgattctctatgtgatccttaccacccaccccagactcagcgcgcggcgtgcccgtttacgtctgggttattcttcaataccggatacattatttcgacgaccggggcggccggtacgctgctggcgtacctgataggcgcgctggtggtctggctggtgatgcagtgtctgggcgagctctccgtggcgatgccggaaaccggcgctttccacgtctatgccgcgcgttatcttggcccggcgacgggttacaccgtggcgtggctctactggctcacctggacggtggcgctcgggtcgagctttaccgccgccgggttctgtatgcagtactggttcccgcaggtgcccgtctgggcgtggtgcgtggtcttctgcgtggtgatttttggccttaacgtcatctccacgcgcttctttgcggaaggtgagttctggttctcactggtcaaagtcatcaccattatcgcctttattatcctgggcggggcggcggtctttggctttatcccgatgcaggacggttcaccggcgccaggcttgagtaacattaccgcggagggctggttcccgcacggcggcctgccgatcctgatgaccatggtggcggtgaactttgccttctccgggaccgaactgatcggtatcgcggcgggtgaaacagaaaacccgcacaaggtgatcccggtggctatccgtaccaccattgcccggctgattatcttctttatcggtactgtttttgtgctggcggcgctgatcccgatgcagcaggcgggcgtggaaaagagtccgttcgtgctggtgtttgaaaaagtcggcatcccttacgcggcggacatctttaactttgtgattttgacggcgatcctctcggcggcgaactccgggctgtatgcctccgggcgcatgctatggtcgctctctaatgagaaaacgctgccgcgctgctttgcccgggtgaacaaaaacggcgtgccgctgacggcgctctccgtttccatgctcggtggcgtgctggcgctgttctcaagcgtggtggcgccggacacggtgttcgtggcgctctcggcaatttcgggctttgccgtggtggcggtctggatcagcatctgcgcgtcgcacttcgttttccgtcgtcgtcatctgcagtccggccagccgctctctgcgctgcagtaccgtgcgccgtggtatccgctggtgccggtgctcggttttatcctctgcgtggtggcctgtggcggcctgtggtttgacccgagtcagcgcattgccctttattgcgggattccgtttgtcgccctgagcctgaacatgtcgcagaataatccgcttaccgccatcctcgaaaaacagccgtttgtggtgctggatggcgcgatggcgacggagctggaagcgcggggatgtaatcttgcagacaacctctggtctgccaaagtattgatggaaaacccgggagcttatccgcgaagtccacctcgactactaccgggctggcgcgcag

SEQ ID NO: 38094 - DNA, 348 bp, Glycine max
  Peptide Sequence Number=SeqID_129779
atggcagcgcaattaatccatgatcgagtggagatggagtgcctagagggagtttgggagaccctcgaaggaaatgcgaggtgccgattccgtggcacgattcgactcacggctacttcattgctagtccaagtgatagaggtgtcgtcatctaaagaagaccctgaggaggacccagaagagttacctcctgagcctgctgtggatgctcttgactttccagagggtgatggggacccactccctgatgtggattctccagaggacgtcatgtcagcatctgaggcaaactctacggaggagagcggccctggagggatagtgactagtggagactcttcatcatag

SEQ ID NO: 38095 - DNA, 255 bp, Glycine max
  Peptide Sequence Number=SeqID_129780
atgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagcaaaataggggagatgcttgccgcccagctcgcccaggcgagctcagctcgcccaggcgagccaggttgcttcctccagaagcaacagccttctggaggaatcttctggagggcccaa

SEQ ID NO: 38096 - DNA, 336 bp, Glycine max
  Peptide Sequence Number=SeqID_129781
atggggatcgcacccacaaagacacacagtggacctgaagaagtccacagggccctggggtttccagctctggttacgggcctctgtcggccctacagggcgcccgttcccccagcaagttcatgtcatcgtggcataggtaaggattgtgcccgcaagacacctagtggacccgaagaaggccaacagggtcttggagttgccagctctaaatacgggtctctgtcagttctacggagtgtccttcaccccaacaaggtcattaggccccacattaaccgggctttcatcaagaagtactgcgcccccagacgggcgcagggcgagacaccatag

SEQ ID NO: 38097 - DNA, 310 bp, Glycine max
  Peptide Sequence Number=SeqID_129782
atgctgtctgccgctgttcgtttgcgttgcatcaataccggttttcagcacggcctgcgaagcagcatcaagcggtgtgatcgaaagctgtatggccaccagaggcaactggtccagcgacacaaaacgacggctttccagccggtaacggtttccgtcgggcgaacgccagacaacgcgacgatgcagctcgccgttggcaaaggccagctcgcgctgccactccagaatctcccctgcaaggagcgtgaaattgacgccatccagctcaacatcaatgcccgtgatatcgggcagattgacgagctcg

SEQ ID NO: 38098 - DNA, 114 bp, Glycine max
  Peptide Sequence Number=SeqID_129783
atgcttcaatctccaagtctagaggaactaaattgcccgtgggagatctatgcatataaaacactaatagaaacaacggttatccagttcaagagaaaaacaggggtgaattga

SEQ ID NO: 38099 - DNA, 300 bp, Glycine max
  Peptide Sequence Number=SeqID_129784
atggcgctattcctcgtcaccacgcttgccaccacgctcaccggcttcctgttcccaatcggaaatttcacgccggcactcggtgtcggcgtcatatcgaccctcgttctggcaatcgcacttgtcgcgctttacggatacggtctgaatggcagggcgcgcatcatttatacgatcaccgccacgatgagcctctatctcaacatgttcgtcctgatcgtgcaggcctttctcaaggtcgaaacgctcaacaacctggcgccgaacggcaatgaaccacccttcctgatcgcccagacg

SEQ ID NO: 38100 - DNA, 751 bp, Glycine max
  Peptide Sequence Number=SeqID_129785
atggaagagcgcgtattttccgatcgtggcagtatgcggaacgcatgctcgtccatcgaacaggatggatgccgacaagggcaaagcgggcctttgcttgaggagaaagaagtgaagaaaaaactgtttggcgcaattgcgctggtggccatgctcgccgcgccggcccttgccgaagccgcaacgcggggattcgccaccgcgaatgtgaatatgcgctccggtcccagcacagcctatccggctgttgtcgtgatccccgtcggcgcaccattgacggtacacggctgcctgtccgataccccgtggtgtgatgtgtctttcgtcaacggtcgaggctgggtagccggccgctatatccagacgacattccggcaaaaccgggtctacgtcgagccccgttattatcgcgatctcggcgttcccataatcaccttcgaagctggccggtattgggaccgttattatcgcgatcgcgacttttaccgcgaacgtgaccgttggcgtcgcccgccgccatcaggcggctactggaacgccccgcccccgagtgctggatgggatcgcccacgtccgcgtgacgactggcgcgatggccgccgcgatgagtggcgtgatggccgccgcgatgagtggcgtgatccccgccagggcggtggtccgaatgatggtcgttgggaacgtcgctacggcgactggaaccagggcgacagaaatcaggacaggccgcgtcgcgacgacgaccgccgcc

SEQ ID NO: 38101 - DNA, 429 bp, Glycine max
  Peptide Sequence Number=SeqID_129786
atgaatagctcaaagccctacactggggcaatgaaaggcgccatgcataaacctcaagcgaacctaggggcagatcagaaattctcacccaatagatttcctccatctaatgtccaatcttttgaattttggatgaccagccctctcaatgagtcaatctcttgctttctcataagggaggacccttgggaactagtacctatcgcctctagagggctgcacgtcctcgcctccagaggactacatgtcctcaccttcagagggctacatgccctcgccttcagagagctacaagtaatcaccttcagagagctacatgccctcgccttcagaggactacacgccctcgccttcagaggggtacacatcctcgcctgcagagggctacacgccctcaccttcagagggctacacaccctcgccttatga

SEQ ID NO: 38102 - DNA, 345 bp, Glycine max
  Peptide Sequence Number=SeqID_129787
atggggggtgaacttatcaaaatgagggtgcaaatagaaattttcaaattttcgaatctggcccattccagaatatttttgaagttgggcaagctaggcggcaacctcctccccttttttcctataaataggcgaaaggaggctgttccaaatatccctcaacccccttggctatgcattttagctattttgggtgtaaaaaattatttccgtgaggaaaattcaagccgaggtgcttttgtaaagcttctgagacgtttccgggagcaaatccgtgaaggttttccgtctttcttcactgttcttcatccgttctttgttcgttcttcgtttttcaatgggtag

SEQ ID NO: 38103 - DNA, 518 bp, Glycine max
  Peptide Sequence Number=SeqID_129788
atgactagaggcaatccatctgacttacaaccctttgatcctgagatagataggacatttcatagattagttaggcatcattttataccttttgatcattctgagcattgcataactggtgaatctgtgcattctgttattggtgattttgaacatcctgatcttgagcattataattctgagcattctgattttgcacattctgagatcatggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgcaggtgaagacccgcacaaaaatttgaaagaatttcacattgtctgctccaccatgaaacccccagatgtccaagaggatcacatatttctgaaggcttttcctcatttattagagggagtggcaaaggactggctgtattaccttgctccaag

SEQ ID NO: 38104 - DNA, 464 bp, Glycine max
  Peptide Sequence Number=SeqID_129789
gttgtgctatatgtggtggagctcacgaatctggctgctatatttccactaaagatacaacagatgaagtgaactatatggggaaccagccaagatcaaactttaatgcaggtgggccacaacaacaagggccgagtctctatgacagaacaacgaagctgaaagagactcttgctctgttcatgcaagtatccatgtccaatcaaaagagcaccgagccagccatcaagaatctagaagtccaggtgggacaattggcaaaacaactggcagaccgaccgtcaagcagctttggagccaacacagagaagaatcctaaggaggagtgcaaggctgttatgactagaagcaaaatggtgagcatgaatgaaggagaggagaggataggtgcagaaaaacaacagctggtgactgagccaacaattgacccagtggtggaacctttgagtgagactaaggaataa

SEQ ID NO: 38105 - DNA, 1016 bp, Glycine max
  Peptide Sequence Number=SeqID_129790
gaagacgaagaagtccgagctctaaaattagagctagggaaggcaagactcgccaaggagaagttcaaatcagccgctacacacatccggaaagagtgcaccgagttacaagaggaaaacgcggccactgcaaaagccttgaacaagaaactaaaagggcccgcaaggaagaatatggccgagagaaattccggggggcattgtggggtagcaacaatgagctcaagctccaaagagaggaaagagactggtcacgggagtttggctcaacacttggaagccacggagcaaagcatgctagctatcatagggcaatacaaggaagagttgagccaatatgtgacccatgaacaaaagctagcggaggattttgcacaagtgtacaccgaaaaagaagcaagagggagggtgattgatgcattgcatcaagaagtgactatgtggatggataggtttgccttaaccttgaatggaagtcaagacctcccgcgtctattagccaaagcaaaagccatggccgaagaacagatgaaggccgatctatcggccttaaaagatcaaatggcttccatctcggaggtcatgttaaaactccagaaaactatagaggataaagccacggcaaccgcctccagtacagttagggaagcggagtcggtgctgcagcccgccttaaatccgggccgagacagaaacacggcagtgtttggtcggaggtatagttcgcaagcttacccctatggcttgcctccagacttcactccccgtgccaccccggaagatttaagccaagcccctactttcgagggacaactcccaccttatgacgactatcccgggcaagacgatgaggaaggagatacccatctcggtcccctgctccacctcaaagatccgtccccccatgaactaccccaaccaaacatagtccaccatatcccggcttcacccacacccgcaaaagaatctattcccttcgtggaagataagggaaagattgaggcgcttgaagagag

SEQ ID NO: 38106 - DNA, 344 bp, Glycine max
  Peptide Sequence Number=SeqID_129791
atgggtgccaagtacctcgaagtggtcaaacgaaagttgcatgccaccaaacaatggtccccggacaaaattaggttgacgaaagtcgcgggtgaccataagatatctctgcatgcaactgactcgctgtccctggatgacaaaggcgcagaattcgtctatgcgcgtttaccacccaacttgctgctcttgaatgataaaggtaaaaatgcgggaccatctggttcccgcatgtcatcgggcccgctgcctctggatgacaaaagtatgacagaaattgtctgcgcggaagatgacgtaaatctccgcgtgtcaacgggcttgttggccgcgattgacaaagg

SEQ ID NO: 38107 - DNA, 369 bp, Glycine max
  Peptide Sequence Number=SeqID_129792
atgcggggttacattatcgttacccacaccgttcgtcaaccatgggcaaacgagcccattgacgcacagagactaacatcgtcttctgcaccttttgacgtcctaacccgtgaagtcagactaacatcgtcttttgcaccttttgtcgtcctgacccgtgaagtcaagcgacattcggggttaccttatggttaccgcacctttcgtcaacttggggcaaacgcgtccgttgacgcggagacaaaaatcgtcttctacaacttttgtcgtcatgacccgataagtcaggtgacatgcggggttactttatggttactcgcacctttcgtcaaccagggtcaaacgagcccgttgacgccaggagactaa

SEQ ID NO: 38108 - DNA, 267 bp, Glycine max
  Peptide Sequence Number=SeqID_129793
atgtggcggaaaccaaaaggaggtgttgttgtgcaatccgcccacttgggccttccagattcttcctccagaaggctgttgcttctggaggaagcaacccttgctcgcctgggcgagctgggttgcaagctcctcccctattttgctataaatagtggtaggagtgaagagggaaggggttcagccttcttggcacttcttattctctcgaaattgctgaggaaaattgtttccgtgaagaaaatccaagccgaggcgcttccgtaa

SEQ ID NO: 38109 - DNA, 260 bp, Glycine max
  Peptide Sequence Number=SeqID_129794
atggccaacatcgatcccgtaaatgagccatatgatgacaatttgtattttgatccctcggttttggatcaaaatgaatatgaagatttctctcactttttccaagttgatattgtgttcgatcaaagggagaatgcacagtacatgacgtgtgacaaatacggacatggccgacaaacgaatatcgatatggaagatcctagaaacacaggaacaaaaaaatgtggttgtccgttcaaattgattggcaaaaggtcaag

SEQ ID NO: 38110 - DNA, 384 bp, Glycine max
  Peptide Sequence Number=SeqID_129795
atggaagaggccaaaaagaggattcaatcttggagcaccaatgaacaattgcttgttggcaaagtctatgaatacattagaggtgtcaagcctactgttagttggtgttctgttatatggaacccagcaatcctccctaagatgtctttcattctatggcttgctaaaaggaaatctctccaagtttgggctcacattcgtgatttggctcctttccgcaggcatttcatttctttgcagcacattactgactctttaattaggggcagatccacattaggtgttcaaggaaaattttgttgtctggctataacaattacagtctattgcatttggctgtctaggaacaagctgatttttgaagattatcaattttctgtatag

SEQ ID NO: 38111 - DNA, 435 bp, Glycine max
  Peptide Sequence Number=SeqID_129796
atgaaatacgaatgcccccgactgtccctgttaatcattactccgatcccgaaggccaacgcttgctttgagcactctaatttcttcaaagtaacagcgccggaggcacgacccggccagttaagaccaggagcgcatcgccgggcagaagggacgagacaaccggtgcacaccagaggcggaccgggccgacccaacccaaagtccaactacgagctttttaactgcaacaacttaatatacgctattggagctggaaattaccgcggctgctggcaccagactttgccctccaatggatcctcgttaagggatttagattgtactcattccaattaccagactcaagagcccggtattgttatttattgtcactacctccccgtatcaggattgggtaatttgcgcgcctgctgccttccttggatgtggtag

SEQ ID NO: 38112 - DNA, 960 bp, Glycine max
  Peptide Sequence Number=SeqID_129797
atgaccgaatacgagctggttggtatggttgaacgactcgatcccacaaaagcgctatttgggcctgttggcgaggtggcaaagcatctgcccgtggctatgcaggagttcaataccttagagcatgctgcagtccatgtgacggagtatggctactgtgtgcatgattacaccatgagtccttgtgagaagttccgagattgtgtcaattgtaccgaacaggtttgcatcaaaggcgatgatactgaaaagttggatcgcattaagaaacgtctggagaagtcggagcgactgtttttgcttgctgacgcagctgtggaaagcggcgagataggaactgatcgctggtatcagtaccacaagaaaactgttacccggcttcgtgagctagtggctattttagagaatccagagattgaaaatggtgcccagattaagctccggggcaatgatttcagccagcttcgccgtgttgtcgcaaagaagtctattgaggccattgagcaaaaaggcaaagaaagtgaagaagctgggggggccttggctaagcatctggacaatagagatattaacgccatcgtgaatctaattcggggatggcaggaaccaaaactgtcctggtcagcaatctgtgaggcggcagaaccattggtcggaaagttgccgtcaagacagtccctcagtgcacatgaggcaatagtggctgcctatcaaacgaagaaagaggctcttaaaggcaggggccgcaaaaatccacgcccagctagtctgaatattgcagccgccaggattgtgaatcttggaagtgaaatcgaagagcttaaagaagaaaaccggaggtacaaacagcagtttgtgatctggcaatacaatgcctacaaacatggaatggcagaacatcaacttaatgcgccgttgacaaagattgaccgggagcgttctgatggagaaaaaagatag

SEQ ID NO: 38113 - DNA, 552 bp, Glycine max
  Peptide Sequence Number=SeqID_129798
gccttattacatggtagaggtagtatagacaattctccttggtggaaggatttaaaatcgatcttccagcagcaacatcagaatagtttggccaataacttgaggtggaaggtgagtcagcaacaggacctcactatcaatttaatgggtcagaatattgacaatgggtgggattggaagtttcaatggaggagaaatttcttcgatcatgaaattgatacggtggcagctttcatggatgagattgatggggctcagattcactcttctagaatggattatctcacttggagggctgaacctagtggatcctattccacaaagtcagcatacaatttcctcatggaagacggcggatcagattatgaagataatgcttccaggtttatgtggaatttgaaaattcctccaagagcagccgctttctcttggagaatctttaaagatagattgcctactaaggctaatttaagaaggaggcagaggaggaaactattggtcatgtcatgtttgattgcacaagaactagatgcctttggtgggagattttga

SEQ ID NO: 38114 - DNA, 228 bp, Glycine max
  Peptide Sequence Number=SeqID_129799
atgattgttaaagaatccattcatgttgcttttgatgaaactaatgcaagtttgccaagaaaggatatactagatgatatttcagaatcttcagaagatatgcatatttatggtgtaaatcacaaaggcaaaggagaaggaaacgatgaagatcttcacattgatgaaataaaaacaaatgttgatcttccaagagagtggagaatttctagataccatcctctttaa

SEQ ID NO: 38115 - DNA, 516 bp, Glycine max
  Peptide Sequence Number=SeqID_129800
atgactaggggcaatccaagtgatttacaaccctttgattctgaaatagatcgaacctttcatagattagttaggcatagtgtgcatcctggtcattctgtgcattttgaacattcagagcattctgttgagggtgattctgaatattctgattttgaacattccactactaatttttatactgagaacatggctcaacctccaccttgtgagaggactctaggggagatggctgcacctgatttcacttatgaaagcttgtgcattcaatatcctgatgagggtgttccatatgttctcaggactggactaatacatttgctgcccaagtttcatggtcttgcaggtgaagatcctcttaagcatcttaaggagttccatattgtttgttccaccatgaaacccccagatgtccaggaggatcacatatttctgaaggcttttcctcattctttagagggagtggcaaaggatggctatattaccttgctccaaggtccatcacgagctggatga

SEQ ID NO: 38116 - DNA, 546 bp, Glycine max
  Peptide Sequence Number=SeqID_129801
atgaccaccctaacccagatatggatgacgttgctgctcagcaacatcctgccctgcgatcataattccgacctccctctgccgaagtgtcagctggtgtacgccatcctgacacggatgagtgttcatgtggctcagttgatcgctgatgccatctatctatttgcaggtatggcgccgaccaggcaccctttggacccagataagtccaacagggccctgggttttcccgcactgatcacaggactctgccagtcgttcggagtccccgttgcacctaccaaggaggcggctaaccacagggcccatgtgcggaccaatgagaccctttaccagctgagcctcagcatgcagagccagggctttgcttctttttcatgccctactccagaccagttcagggcagaggtcgcatggcctggggattggcccgaggcccagacaggagaggcacccccagaggcccccgacgatggagaggaggcccacgaggacgaggagatgaccgatttgcttgacttcttaggagggagtggagctacataa

SEQ ID NO: 38117 - DNA, 574 bp, Glycine max
  Peptide Sequence Number=SeqID_129802
atgggggagacacatgaaattccccaccacgatctagttgacttcgagccttggctcggatatgccactgaaggggaagcagttgcccctcctgctatggctgaaaagggaaagttggatcatctaaaggaaaggctcagggccattgaaggagtgctggactttgacaagtacaaggggactacttgtctcaagaaccatctaaagatgtattgtcagaagatgggggaatacgcaaaagatgaggaattgctgatacattccatccaagaaagtcttactggggtagctgttacctgtatcaatacaattttgatatggttctggataggatacaactacagaacatttgcaaaaaagggggacggatcttccaaagaccatgcccaaaaggtggagggatctggcggcccaggtggtacccccaatgatggaaagggagacgatgatcgtgatggtagacacattatcgatttggtcttcgccagtgaaaggatcgatgtggatccgaaaaaagggggcaaatttgatcatcctactaggacgactgagaaaactggggcaaataaagagg

SEQ ID NO: 38118 - DNA, 359 bp, Glycine max
  Peptide Sequence Number=SeqID_129803
atgaaagataaaagggatgaggaggaaaaactagaaaaacaaaagaaaaagaaggatagtaaggccttgtcttcaaaggccaaagggaagggaaaggaggaaaaggatttctccaagaatattgttaacaaggaaaatcattttgcaacaaaaggtgatattaaaagggcactccttcttaaacatcttttaccttctcctatcagggaaaatcccttagcaccaccatacctcttgagcttgagtgatcaagggcttcccatggaccctaagagaatacaggtcattcctgagtggcttactccaccaagtataagagaaatttggggcttcaatatcttaacaaacttttacaaaag

SEQ ID NO: 38119 - DNA, 177 bp, Glycine max
  Peptide Sequence Number=SeqID_129804
atgacccttgacggcgagacgtgtagtcctctgaagttgaaggtgagggcgtgtagccctctcaaggcgaggacttatagtcctctgaaggtgagggcgtgcagccctctgttggcgaggatgtgtagtcctctaaaggcgaggacgtgtagtcctctcaacggtgagggtaactag

SEQ ID NO: 38120 - DNA, 663 bp, Glycine max
  Peptide Sequence Number=SeqID_129805
atgtatgaaatggtcccgaggaaacttgcctcaaagagatccaggaaggataaagtggccgaaggaaccagttccgctcccgactatgacagtcaccgctttaggagtgctgaacaccagcagggtttcgaggccatcaagggatggtcatttctccgggagcgacgcgtccagctcagggacgacgagtataccgatttccaagaagagatagttcgccagcggtgggcatcactggtcacccccatggccaagttcgatccagacatagtccttgaattttatgccaatgcttggcctacggaggagggcgtgcaagatatgaggtcctgggtgaggggtcagtggatcccgtttgatgcagatgctatcagccagctcctgggatatccttttgtgctggaagagggtcaggagtgcgagtatggccagaggaggaaccggtccgatgggttcgatgaggaggccatcgcccatttgctatgtataccggggcaggattttgcccagactactgccgggagacgggtgtcgatcatgcgcaccaacatgaccaccctgactcagatctggatgactttgctgctcagcaacatccaacccagcgaccataattccgacctccccctgccgaagtgtcagctggtgtacgggatcctctag

SEQ ID NO: 38121 - DNA, 300 bp, Glycine max
  Peptide Sequence Number=SeqID_129806
atgttgttggaattgtgggtcgaagaaaaccctacactactcttggaacagacgtgggtgctcaaagctcaaagctttctatgctgccagttaacaaggtatgagctctaccttagtttgttgctcttcttattgattgtgctttacgtggttttcaagcttgacgagagttacacgccgagcaaagtttccatccgtgccggtgatggttttcacaacttgaaggagattaagaccgtggaactcgtgaagccaactgggtgggtttatctatccttgtctggagctgatcctaggtaa

SEQ ID NO: 38122 - DNA, 519 bp, Glycine max
  Peptide Sequence Number=SeqID_129807
atgtccaaatcttgtggatttgggatgaccggccctctcgatgagtcgatctcttgctttctcataagggtggacccttgggtactagttcacgcttcacttcagaggaccacacgtcctcaccttgagaggactacacgtcctcaccattcagagggctgcacgccctcacctccagaggactacacgtcctcaccttcagagggctacacgccctcgcctcagaggactgcatggctacacgccctcacctttagaggactacacgtcctcgccaacagagggctgcacgccctcaccttgagaggactacacgtcctcgccttgagaggactacacgtcctcaccatcagagggctgcacgccttcacctccagaggactacacgtcctcgccttgggtactagttaccctcaccttcagaggactacacgtcctcaccttcagagggctacacgccctcgccatcagatgactgcatgtcctcaccttcgtagggctacacgccctcacctttag

SEQ ID NO: 38123 - DNA, 300 bp, Glycine max
  Peptide Sequence Number=SeqID_129808
atggatcaccaaaggctgatgcaatcctaccctgcaagggcattggatagaagactccaaatttcggggccatgggctaagtatgagcccacttatctttgtacatatttgtcataccctaatttcattcggggacaattgtttgtcgacatgtgtgttgaagcaaagcttcatgatgatgacaaaggtgatgacaaaaagcttaaagatcaatcaaagaacaactcaagtgaatcaagaacaattcaagagttcaagataagaatcaagaagaattcaagactcaagaagaaagtttag

SEQ ID NO: 38124 - DNA, 144 bp, Glycine max
  Peptide Sequence Number=SeqID_129809
atggatacctcagagccctacactagggcaataagaggcaccatgcataagcctcaagcaaacctaggggcaaatcaaaatttctcacccggttttgtcccaaagtccaagctacaaaaggatctaagtcaagatttgagatga

SEQ ID NO: 38125 - DNA, 264 bp, Glycine max
  Peptide Sequence Number=SeqID_129810
atggtcttggctgtcctttggtttattccccgatcagaatggacaactggtgacctcggaagaattacgggaatggaattcaggctgaaaagcgcgagacacagagtaagggacttacagaaagtggaatgtgcaatggataaagagaataagaggttgactagggcgccaactaagggccaaagagacaaagaaccaccagcggctccaccgagtttccccggtagcctaccagtgagaactactaggcgggaagggatctag

SEQ ID NO: 38126 - DNA, 735 bp, Glycine max
  Peptide Sequence Number=SeqID_129811
atgggtgaagcagaggaggtgcaagagaagatgaaggccgacatggaggccatgaaagagcaaatggccacaatgatggaggccatgatgagcatgaagaagataatggaagctaatgtggttatagttgccgctactagcgctgtcgctaaggtgaacccgatgctcccatctggcctcaagcaaatgaatcatccaacctcaaatatggtaggcaaagatttgggaagtgcggatgaccccatgatgtgcaaattcaaaacaagcacgccttcccgccatatagcttgcctcccaaactatacaccacccaatgtggcgtacattcccaatggggatgtcaataactccactcccatactcattaaaagccaacaacctcaatctgatcatgcacatgtctctcgacccatggaggagacacatgaaattccccaccacgatctagccaactttgagccttgcctcggatatgccgctgaagggcaagcaattggtggtatacccctgcaaaacactttggagggccctcagtatcacccacaaccacaaccctcacattccacagcggttaaaaaccctcatgctatggcagaaatgggaaagaggaaaggctcagggccattgaaggaggtgctggactttgacaagtacaaggggactacttgccccaagaaccatccaaagatgtattatcggaagataagggcatacgcaaagatgaggaactgctaa

SEQ ID NO: 38127 - DNA, 342 bp, Glycine max
  Peptide Sequence Number=SeqID_129812
atggcaattttgatcgccaatacttcgacaacatttcatagagatgaaagactcaggaatacaaatgggtttatgatcccaacatggttggctcatgaggaaaacgcaaggatcatgcataagcaaaacatgaaaacaaaaggtatgcagtttgtagaacaaaaatgccccatgtgtgcagttaagaaggtgatatggaccttccggcttcccatgacaaaagacaagaccaatatacaacgtgtgcgtgatgacatgatgctgatgcgcaaaagcgcaacagggggatgtacacaacatggcaatatccacaaaataatcatacagcaaaggcgtacatga

SEQ ID NO: 38128 - DNA, 285 bp, Glycine max
  Peptide Sequence Number=SeqID_129813
atggctgtcaaactcaggagcagcgctggttccttcggccgcggcgtccctcctagatctctttgcagagagtttcctcggtggcatttcctgcgaggacaaacatttggaaaccgctttgagatacttggcgtcctttgttgcacaataaatgaagtcccgagacgtgtcagaaatcaaaaggaagcaggcttgcgcgatccgtcaaattccgtgatgtggcggaaatcgaaaagatgtgtttttgcgcaatccgtgagtttccgtaacttcttcgaaagctaa

SEQ ID NO: 38129 - DNA, 534 bp, Glycine max
  Peptide Sequence Number=SeqID_129814
atgtcttggcagaggtcacattgcctctcaatgccccacaaagaaaatcatgataggaagatcatttacaatggcctaactaatgagattaccctcacccatcttggcactaaatttgtgttgcatcctcaaacaccttcacaggtggccaaagatcaactaactatgaaagataagagggatgaggaagaaaaactagaaaaacaaaagaaaaagaaggatagtaaggccttgtcttcaaaggccaaggggaagaaaaaagaggaaaaggattcctccaagaagattgttaagaaggaaaatcattttgcaacaaaaggtgatattaaaagatcactccttcttaaacaatctttctaccttctcctatcaagggaacatcccttagcactgccacaattcctacttgagaccttacccctcaatgatcaaggggttcccaagaaccctaagagaataaagatcattcctgagtggcccactccaccaagtataaggaaaatttggggcttccatgacttaagaaacttttaa

SEQ ID NO: 38130 - DNA, 726 bp, Glycine max
  Peptide Sequence Number=SeqID_129815
atgactacaattttgggtattcacttaatcttgttaggtataggtgcgtttcttctagtattcaaggctctttattttggagggtggattgttagtgtggacgatttggaagatataattggggggcatgtatggttgggttccatttgtatacttggtggaatctggcatatcttaaccaaaccttttgcatgggctcggcgtgcacttgtatggtctggagaagcttacttatcttatagtttaggtgctttatctgtttttggttttattgcttgttgctttgtctggtttaataataccgcttatcctagtgagttttacgggcccactgggccagaagcttctcaagctcaagcatttacttttctagttagagaccaacgtcttggggctaatgtaggatctgctcaaggacctacaggtttagaacctctaaggggtccgaatggtttagacttgagtagactgaaaaaagatatacagccttggcaagaacgccgttctgcggaatatatgactcatgctcctttaggttccttaaattccgtgggtggcgtagctacagagattaatgcagtcaattatgtttctcctagaagttggttagctacttctcattttgttctaggattcttcctatttgtaggccatttatggcacgcgggaagagctcgcgcagctgccgcaggatttgaaaaaggaattgatcgagattttgaacca

SEQ ID NO: 38131 - DNA, 759 bp, Glycine max
  Peptide Sequence Number=SeqID_129816
atgctcgcgggtctgtggcatcacgccgtcgtcggcggcgatcaccagcagggcgacggggatacccgtcgcaccggccaccatcgtatgcacgaagcgctcatggccgggcacgtcgacgaaacccagcgtcgtcgccgggccctcagcgtccctgctttctaccgggacataggcatagcccagttcgatggaaatgccgcgcgtacgctcttcctgcaggcgatcggtttcgatgccggtcagtgcccgcaccaggctggtcttgccatggtcgatatgcccggcgggtaccgacgatcatgcctgcagcatgctccattgggccaggaaggaccgcttcgtcggcgggttccaggcagcgcaggtccagccacaacgcgtcatcggcgatgcggcccagcaccggacgcggtagctgacgcaagcgcttggccaggcggtccagtccgccacggcgtgcgctggcaatgcgcagtccggcactggccagctgcgcctgcggctgcgcgccgctgccgatctggctgtgcatcgaagcaggctcgagggtgtagtccgccgccagcgaggcacgcatgggttgcagcaggcgctgggcctgcgcatcgatgtcgtcctgcgtgcgcgacagggtgcgcagggtcggcaggcgctgtgccagcagctccggttcgcgatacagggccagcaccgcttccagcgcggccagtcccatcttgtccatgcgcagtgcccgcttcagcgggttgcggttga

SEQ ID NO: 38132 - DNA, 318 bp, Glycine max
  Peptide Sequence Number=SeqID_129817
atgcaccacaggccccggacgcaccgccaccacctcatcagactgatcctgctcggtcatttggcatggagcggtatctacagcacttggttcgccagcaggcggccaaccacagggggcaggtgcagatacatgagtgtctctaccagctcagcctcagtcagcagagctagggtttcgttccttttccgtgccttactccagatcagtttagggctgaggttgcatggcccggagattggcccgaggcccaagcaagggaggcgcctgcagaggctcctggcgatgcagaggaagcccgcatggatgaggagatga

SEQ ID NO: 38133 - DNA, 294 bp, Glycine max
  Peptide Sequence Number=SeqID_129818
atgaatgacctgatgcgcccggctttgtatgatgccttccataacatcaccaccattgcgccttccgctgcaccagcgcagcgtgactttctaggccatgatcgtaccttggcgattgcagaaggcgattacctggcgattcattctgcaggcgcttatggcatgagcatggccagcaactacaacacgcgcgcccgtgcagcagagatactggtcgatggtgatcaggtgcatgtgatccgtgaacgtgaacagattgccgacttgtttaaactggaacgcacgctaccataa

SEQ ID NO: 38134 - DNA, 126 bp, Glycine max
  Peptide Sequence Number=SeqID_129819
atgactaaagcacgtcaaaagtgggtacggaaagaaaatgagggaggagcttgccacccagctctcacaggcgagctaggttgcggtgccttctggagaacttcgtggaaggcccaagtgggcctg

SEQ ID NO: 38135 - DNA, 447 bp, Glycine max
  Peptide Sequence Number=SeqID_129820
gattcatcttcatgcgaaggatttccaaatgttcccttaatgggaacaaggggttgtataaattataatcctgtcctcgccataagacagcttggctaccccatgagaggagcgccattagacgaaagcatcacgcctttcattacacggggtttcagtgaccccaatgcaaaggacagagagcttaggggaagcagtaatgggatcatcggcggctatcataagtggctgagagtccggacacaaggattggattggctcccaaatctaaagactgtgagagacgatgaggttaaagcttcggaagaaagtgatgaggagtcaagaacttccccgattgctagccaaggccaaagcaatggcggacacctactccgcccccgaggagatccacgaacttctcagctattgtcagcatatgatagacttaatggaccatatgattag

SEQ ID NO: 38136 - DNA, 606 bp, Glycine max
  Peptide Sequence Number=SeqID_129821
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccatccggagaatttcttgaatccagtgatcagggagaggagctacaatactttggaccacaagaaagtggtgattgtttcagaaaagttgagggatccttccgatcggctctttggaacctttggtagtcgtggggccaggcagaatccaaaaaggaaatcactggatacattgagtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 38137 - DNA, 324 bp, Glycine max
  Peptide Sequence Number=SeqID_129822
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttgcttcgtatgagtttaccaccttaacttgcatcccaggtgtcatcacatatcgtggagctaaaatccag

SEQ ID NO: 38138 - DNA, 891 bp, Glycine max
  Peptide Sequence Number=SeqID_129823
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggaggagataggtcgccggcagtgggcatcactagttacccccatggccaaatttgatccagacatagtcctcgaattttatgccaatgcttggccaacagaagagggcgtgcgtgacatgaggtcctgggtgaggggtcagtggatcccgtttgatgcagatgctatcggccagctcttggatatccgtttaggtgctggaagagggtcaggagtgcgagattttgcctggactgctgccgggagatgggtgcggatcatgcgcaccaacatgaccaccctgactcaggtctggatgactttgctgctcaacaacattcagcccagcgaccataattccgacctccccctgccaaagtgtcagctggtgtacgccatcctgacacagatgagcattcacgtggctcagctaatcgctgatgccatctatatatttgcaggtatggcgcctaccaggcaccctctggacccggataagtccaacagggccctgggatttcccgccttgatcacaggactctgcccgtcgttcggagtccctgtcgcacctagcaaggccgcagacgcgccgccacctcatcaagccggtccagccggattgtttgatatggagcagtatttacggcatttggttcgctag

SEQ ID NO: 38139 - DNA, 150 bp, Glycine max
  Peptide Sequence Number=SeqID_129824
atggagcatgatcatgtggtactccgtgatgcaatcctccctgggaagggactagtcacaagggccatgagcaagaggctccaagaggattgggctagagctgctgaagaaggccctaaggttctcatgaacctcagggtagatttttga

SEQ ID NO: 38140 - DNA, 1026 bp, Glycine max
  Peptide Sequence Number=SeqID_129825
atggccatatgtagccatgtgggcttcccaaatctatttattactttaacaggcaatccaaactggcctgaaatccatagattgctgaatccgttgaatttgaaagcaacagatagaccagacataatctccaaagtctttaaactaaagtatgaacaaatgcttatggacctgacaaagaatcagatgctagggaaagttattgcatatatgtatacaatagaatttcaaaaacgagggttgcctcatgtccatttgtttctttttttacatcctgataacaaatacccatcctcagatgaaattgatcaaattatatcagcagagataccttcacagcaagatgatccagaactgcattcattagtccaaaaccatatggttcatggcccatgtggcacttcgaaccctggatctccatgcatgaaagaaggcaagtgcagtcgtttctatcctaaaatgttccaaccgcatactgttttagatgctgatggttttccggtctaccgtagaagaaacaatggtcacacaattgagaaaaatggtgttataattgataacaggtatattgtaccttacaatccaagattgctcataaaataccaagcccatatcaatgttgaatggtgtaaccaaagcacttctatcaaatatttatttaagtacatcaacaatggatacgatagagtaactgctattttgattcatgatgataatgattcaactcacaatggtagcactcataatgatgagatcaaagaatatctagattgcagatacatatgtccctgtgaatctacttggagaatctttgggtttccaatacatggcagaaaacttgttgttgaaagattgcacttccatcttcttggccaacatagtattgtctatgaagaccatgatgatattgatgatgtattgtctaagccaataagaagaaaagatgttggcaccttaggaagaaaggctacaccattggcaaattactatgggtcccaccaattacaggcgaattattttacttga

SEQ ID NO: 38141 - DNA, 632 bp, Glycine max
  Peptide Sequence Number=SeqID_129826
atgggaacaaatcaaacttggaaaaggttttatcaagtcaagattaagggcctagatatcaccagcattaaggagttggggcagttgatgggacctctccaaatgcaagccttccgcaaggcgtacggaaagatcttagatttgaccatagcagagatatccacagaagccattgtatcactcacccaatactatgacctgcctttgagatgcttcacgtttggagacttccaattagtaccgactgttgaagaatttgaggagattctaggatgtcctcttgggggaaggaaaccgtatcttttctctggttttcttccctccttgagcaagattgcagttgtggtcagggattcggcgagaggattggatcgcgtaaagaaaactcgaaacgacatagtgggcctaccacagaagtacttagtagacaaggcgagggatatggtgaatcaagaggagtgggtcccgtttatggacgtattagcattgctaatctttggggttgtcctctttccaaacatggatggttcggtggaccttgccacaattgatgctttccttgcatatcaccatagcaaagagagcctggtggtagctatcttggcggacttatttgacacatttaaccgaag

SEQ ID NO: 38142 - DNA, 312 bp, Glycine max
  Peptide Sequence Number=SeqID_129827
atgaagcttggattgatttggtctgacgagggatcgaggtttagtaatttaggctacagcatagaacacaagagcatgattggtgatttgatccccattgatttggagattaacaccacttgtagaaggcgtaatcaagagagaattagaaattttttgcaggatttagaagcagcagcaattccagtggaagaacctcaatcttttgaggcatcttctagttttcctattacaggacattctcatttagatcgtatcaaagaccaaatcatggctgaagagccaagaagagtcaccctggaagattattga

SEQ ID NO: 38143 - DNA, 933 bp, Glycine max
  Peptide Sequence Number=SeqID_129828
atgaccaaaatttatacgctcacgctggccccatcactcgatagcgcaacgctgacaccgcaaatataccctgaaggcaagttacgctgtagcgcaccggtattcgaacccggaggcggcgggatcaacgtcgcccgggccattacctttctgggcggtaaagcgacggcgattttcccggttgggggcgccaccggcgagcatcttaccgccctgatggctgatgagcaggtcccggtcgaaacaatagaaacccgcgactggacgcggcagaacttacatgtgcatgtcgatgccagcggcgaacaatatcgctttgtcatgcccggcgcggcgctaaccgaagatgagttccgtcgcctggaagagaaagtactcgcgattgagcccggttctctgctggttatcagcggcagtctgccgcccggaatcagcgtcgaacatctgactcaactggtaaaaaacgcgcagcagcacgggctacgttgcatcatcgacagctccggcgatgcgctggccgccgcgctggatgtcggcaacatcgagctggtcaaaccgaaccagaaagagctcagcgcgctggtcaaccgagagttgacgcaaccggatgatgttcgcaccgccgcacaggaactggtacgcagcggcaaagcacgacgcgtcgtggtctctctgggtcctcagggggcactggccgtcgatgaaacgtcagccgttcaggttgtcccaccgcccatgaaaagccagagtacggttggcgccggggatagcatggttggcgcgatgacgctgaaactggcgcagggcgcgtctttgctggaaatggcgcgttacggtgtggcggcgggtagcgccgcaaccatcaaccagggcacgcgtctgtgttcgctggccgatacgcaaaaaatcgtcgattacctgtcccgagattaa

SEQ ID NO: 38144 - DNA, 408 bp, Glycine max
  Peptide Sequence Number=SeqID_129829
atgaagaactggatgcagaattcaaaacgggatgtctacctaggagcctacctaaatggtgcacactggcaaatggtcgtcattttgcctaaggaaaatcttgttgtctggttttgttccttgcatgataggccaagcaactaccttaaaggaataattaacatgtcagtgttgttttccaatacatttgcattagcattactcagcaacatcaatattttaatgttccttgtattcaacagtgctttgaaaggacttgacgatactccagaacctaaatccaaggttggtactaggtggattgttgttaaatattttaatgatgttagaccattggaagcagagaaattgaaggcgcttcacatccagtgggcacaatattatctcaaagttagaaatcaaacttag

SEQ ID NO: 38145 - DNA, 57 bp, Glycine max
  Peptide Sequence Number=SeqID_129830
atgaccgaccgaggctacggaggtttggatgacgccacttccggtgaaggaagataa

SEQ ID NO: 38146 - DNA, 261 bp, Glycine max
  Peptide Sequence Number=SeqID_129831
gaggatcgctatgactatagctcttggtaaatttaccaaagatgaaaatgatttatttgatattatggatgactggttgcggagggaccgtacgacctttgtaacttcatggtatactcatggattggcaagttcttatttggaaggctgcaacttcttaaccgctgcagtctccactcctgctaatagtttagcacactctttgttgtcactgtggggtcctgaagcacagggagatttacccgttggtgtcattaggtg

SEQ ID NO: 38147 - DNA, 297 bp, Glycine max
  Peptide Sequence Number=SeqID_129832
atgagggtgctgaacgggggagaggtcgccacgatggcgatgatcgaggcgatcggccggctcatccccggtgtggtcggcaacccccagagcctcgtcgaggagtcgcatgaggacgggctgctggagtatccgtcctatacgaagcccgcctcgtggcgtgatcgctcggtgccggacgtgctgctgagcggtaaccacgcggcgatcgcggcctggcgtcgcgagcagcagctcgaccggaccaggacgcgtcgtcccgatctcctgcccgaagagcagacgccgtcgtcctga

SEQ ID NO: 38148 - DNA, 591 bp, Glycine max
  Peptide Sequence Number=SeqID_129833
atgctagctatcatcgccaagtaccaagaagagttgggtctagccatggcccacgagcatagaatcacggatgagtatgcccaagtatatgcggaaaaagaggctagaggaagggtgatcgactctttacaccaagaggcaaccatgtggatggatcggtttgctcttaccttgaacgggagtcaagaacttccccgattgttagccaaggccaaggcaatggcagacacctactccgcccccgaagagattcatgggcttctcggctattggaaaaacaccataactaaacgcgccgcaagggatccctatcgcaccagatccaaatctagaacgatgggtgatcaagaggagacgcaggaacagatgaaagccgacatgtcggctctgaaagaacaaatggcctccatgatggaggccatgttaggtatgaaacagctcatggagaagaacgcggccactgccgccgctgtcagttcggctgccgaagcagacccgactcccttggcaactacgcaccatcctccctcgaacatagtaggacggggaagggacacactggggcacgatggcagccctcacctgggataa

SEQ ID NO: 38149 - DNA, 885 bp, Glycine max
  Peptide Sequence Number=SeqID_129834
atgacaaacgctcatgaacgcaagaagcagcctgaggtggtgcgccgcaatctactcgattgcgcggcgaaacttgctgctgaacaaggggttgcagcactttccgtgcaggcggtggcggatgcggcgggagtgaccaagggcgggctgtttcaccattttccttccaagcaggtgctgctcgaagccgtcatgactgaccttctggcggcgctggacaacgagatcgatgcgctcatctcacaggatcgtgaagcttttggaagcttcacgcgggcctatggattcgggtcggcaatgggcagcgatctccgtttcgatggtcggcgaaccgtcgcttcgacgtcatgtggaacagttggatcgagggtcgtcttgtccgtcataaagaaacggatgacggggtggtactggagatggtgcggctggctgccgacggcatctggtttgccgatctgctggcgacgacggcaaagcgggtggcgacagggcggctctgagggcccggatgatcgcccagacgaagaaggatacgtgacgatgaataccgcggtcttcacttatggcgcgcttgtcgcagccattgtctgcgaggtaatcgccacctccttcctgcagcaatcgcagcagttcaccaggctagtaccgacagtgctgatggcgttgttttacggtgcagccttttatcttctgtcgttcacgctgcgggcgctgccggtcggcgtggcctacgcgatctggagcgggcttggcatcgtgctgatttccggcatcggatatttcgtgttccgccagacgctggatattgccgccgtcatcggcctcggcttcatcatcaccggcgtggtgatcgtgaacgtgttttcgaagacggtcgggcattga

SEQ ID NO: 38150 - DNA, 770 bp, Glycine max
  Peptide Sequence Number=SeqID_129835
tgcgctgcgtcatccgtctggatcaggcatcttcgaagttctgtttatgtctccgaaatcggttgccgattgggagagatggtctgggtggctgaatgatttccgaaaactactcccgcaatctgagggcggcgaaagttgcattctcgacaatgacaaggcgtcggaatcgctgctgtcggaaatcgtcggcgcccagccctggcctggccagcgcaacctgaacatggaatcgatctatgaatatggctcgcgcgccggcttctggcggctgtggcgcatgttcaccgggcttggcgtcaccaccaccgtttacggcgtgaccgcagccatggcccgcaacccggaagcggttgcggcgaatgaaggaagcggccacggataccgctggctggaatacaaggatttttccgaggaggaagagcgtaagcacatcgtcgaagcggtccgtctgcacacggaggtcaccggcgaacgtccctatggcatgtatcagggcaagccctcggacaatacgctgcggcttgtcatggaagagggtggttttctctattcgtcggactcctatgccgacgatctgccctattgggtgaagggtgtgaaggatgagcctttcctgatcattccctacacgcttgagaccaacgacatgcggtttgccacgccgcagggcttcaattccggcgaccagttcttcacctatctgaaggacgctttcgacgtgctttatcaggaaggtatggaaggtgcgccgaagatgatgagtgtcg

SEQ ID NO: 38151 - DNA, 225 bp, Glycine max
  Peptide Sequence Number=SeqID_129836
atgaagaaacattcgtttgaagggaaaggagaggaaaggaaagggagcagcggaggcggaggcgaaggaggaagggagcttgggggagagggaggaagaaggagaggagtgacgaggggaagaaggggaaacgaaggtgaaggtgaggagaagaggcagattattgatatgcgagttggaagagagaagttgaggtgcggcatgaagctagggttagtattataa

SEQ ID NO: 38152 - DNA, 561 bp, Glycine max
  Peptide Sequence Number=SeqID_129837
atgttggtgcgcatgatctgcactcgtctctttccagcggcacaggtgaaatcttgccccggtatgcatagtagctgtgtgatagcctccctctctggttgtgctcgcacagttggccctcctccaatatcagggggtggcccaggaatcgttaaaggaaactactgcacactgaaaatgaggacacgtagccctctaaaggtgagggcgtgcaaccctctcaaggcgaggatgtatagtcctctggaggtgagggcgtgtagtcctctcaaggtgagggcgtgcagccctctgttggcgaggacgtgtagtcctctaaaggtgaaggcgtgtagccctctgttggcgaggacgtgtagtcctctaaaggtgagggcgtgtagccctacgaaggtgaggacatgcagtcctctgatggcgagggcgtgtagccctctgaaggtgaggacgtgtggtcctctaaaggtgagggcgtgtagccctacgaaggcaagggcgagtagccctctcaaggcgaggacgtgtagtcctctggaggtgagggcgtgcagccctctgatg

SEQ ID NO: 38153 - DNA, 1029 bp, Glycine max
  Peptide Sequence Number=SeqID_129838
atggcagaaccatcaaagaagcgaaagggcgttttgacttcatccgcagtcatcggaactcgaagtcacagatcatccaaggtgcatacaacccaaattcctccctccatatcatctcctacgttgttttccttggatgaacaacgtatctggtacaattctctcttttcttctcgttccattatcgaccctaagttcgtagacttagctttctttgatgatgaagtgtttgattgctttcaagcatttcaaaattctggtttaattcagtttatctccatgaaacttcctttttaccctgaattggttaaagccttgtattctaacttggaaattcaagaagattccttgatttccgaagtttatgggattaagatggtcatagaccagtcccttctctttgaactcactcaattatccagtgatggtgtaccatttgagggtacacttgatgatgagtggaagttcgatttttctgtttctgatgctcgccggatggtttgcaccaaccaagcggatatgaccgaaaggcttctttccggttcactggcattcgaatgccgcatcattcactacttgattgtgcgcatcctactccctagatcatccaaccttgcacaggttttcttaaccgatcgtcaaatcgactgggcccatcttgtgagatatcacatgcataaggcattgcgatcaaatactccactcccatatccccatctgatcaccatgtttctacaacattttaatgtccctcttgactctaagccctttgtcaaagtcaagagatcgttctctatcggtgcgaatgtagtctcctctttcggataccgcaaagagagggatggctcttgggtgaagaaggatgctccagtacaggccgctgaagactgctctccatcaccacatcctcagagagattattcttcatctcttatgcacaacattcttgacagattggatggactccacaccttcgttggtgagtattttgattccttggacagctgcattgatgccattgatgcatga

SEQ ID NO: 38154 - DNA, 726 bp, Glycine max
  Peptide Sequence Number=SeqID_129839
atgaacaccgtcgaagaggacgggccatcgcgggcaaagaggttaggagaggtggttacttctagacgcttcatctatcaatcactgcaagtggcgtgcatggtctcccgaggtagagacgaaagggatgaatgtttgtttcacctcggggagtcacatgacatggaaacctgtcccgcggtggaagaattgcttcagcggctcatggattacgggcagcttgaagtgtccacaggagggagggaagaaccacaaatttgcatgcagtcggaagagaagagggttcctctaacccccaaggccctactgatatcttttactagaaaagggaccggctccacacccatatacccctgggcagcgcccaagccaatgccatttgcatatcaaagtaataaggccgttccgtggaagtatacccctcccgcgtccagcgaaagagttgcaaccgaagttgactccctatcagctaaagtaaccaacatcaccggcctcagtggcgtaacccgcagtggtcgggtgttctcttcccctcacccggcagaattgccctctaaagggaaagcgcccatggtccaagagcccacagatatagccaccccctcaaaagaagtagatcctccagtggtaagaggggccgcaaagaaagaaagacttcaaggaaaaatagtgactttggaagaggcccatgagttcctctgcctcatccaacaaagcgagtttaag

SEQ ID NO: 38155 - DNA, 294 bp, Glycine max
  Peptide Sequence Number=SeqID_129840
atgcccaaatcttgtggatttgggatgaccggccctctcgatgagtcgatctcttgctttctcataagggtggacccttgggtacttgtacctatcacctttagaggactacacatcctcgccttgagaggactacatgtcctcgccatcagaggactgcatgtcctcgccatcagagggctgcacgccctcacctccagaggactacctgtcctcgccttgagagggctacacgccctcaccttgggtactagttaccctcaccgtcgagatgactacacgtcctcgccttga

SEQ ID NO: 38156 - DNA, 288 bp, Glycine max
  Peptide Sequence Number=SeqID_129841
atgggctttctaggtttgaaaagtgacaccgctagaatgagaaacctagcaagactacccatcatatctcccaaaaccccatacccacaaaatttaagagagaaagaagtccacccaaacctgaattttcaaagtccctctcgtagccacgcacttcacgactccaaaaatgccctcctttcgcgatttggagcagaaatgagcaccaaaggttggagctttgttggggtttcaatggagaatggaggagaaggaaaaagcaacgtgaggaagagggagagcttctga

SEQ ID NO: 38157 - DNA, 540 bp, Glycine max
  Peptide Sequence Number=SeqID_129842
atgaagatattgttttatgtgtaccagaatccagtggaagtgccgtgggaggcgaaccaatttggacttcctgagattggggcaaaattttacatcacagatgcagatctagcagaaataatatcaggtgacaagtgtttaaacatagcgatactacaattgtggaccatatttatgaatgagtgcggtagaagcaaagctgatcagtcactatatggtttgctggagcctcaatctatacaaaatgctaaggaaagacgtcaacaatgccaacaatacattgaaacatgggtcaaggaatcacaaaggcagttgtatttaggagcttacttgaatcaggcacattggcaactatttgttctccacccaagggaaaacacggtcgtttggttttgttctctgaggaagaagcctgatattaacatcaaaggcgcaattaacagactaatgtgcaaagtggagggttttgagtgcggatattatgtcatgcactggatgtggtgcatcgtgactgccggtttgaaagatgactggcacaag

SEQ ID NO: 38158 - DNA, 442 bp, Glycine max
  Peptide Sequence Number=SeqID_129843
atgacaagcagagaccaggtttggtcattctgcacccttgtatcatccagaggcggcgggcccgatgatacgcggagataccttatggttattcgcacccttttgtcatccagaggcggcgggcccgatgacaagcagagaccaaagaccaagtttggtcattctgcacccttgtatcatccagaggcggcgggcccgatgatacgtggagataccttatggttattcgcacccttttgtcatccagaggcggcggtcccgatgacaagcagagaccaagtttggtcattctgcacccttgtatcatccagaggcggcgggcccgatgatacgcggagataccttacggttatccgcacccttttgtcatccagaggcggcgggcccgatgatacgcggaaatacctgagtggttatccgtatgaacattcttttgctatct

SEQ ID NO: 38159 - DNA, 150 bp, Glycine max
  Peptide Sequence Number=SeqID_129844
atgcaaggctctggtaatcgattaccaggaagtgtaatcgattaccagaagacagggttccaagagaaggcggtgccttctggtggaagcaaccctactcgtctgggcgagctaggcggctaccacctccctattttctcctataaatag

SEQ ID NO: 38160 - DNA, 99 bp, Glycine max
  Peptide Sequence Number=SeqID_129845
atggagctggaacgcctgatcaaaagactctcagacagtggcattgatgatgctataggggcatgtccctttgaacaattgattgctattggtctgtaa

SEQ ID NO: 38161 - DNA, 168 bp, Glycine max
  Peptide Sequence Number=SeqID_129846
atggtaatcatctccctttcgaccatgggaggggccacttatgccgccagcaaaaggcaaaggagaagaggagaggggaggcaccatccactagggaataagccaaggaagaaggagcttcaccaccaagaattgccttggataagaagcttgaagaggatgctttaa

SEQ ID NO: 38162 - DNA, 213 bp, Glycine max
  Peptide Sequence Number=SeqID_129847
ggctgttcatgtgtcctccactttcgagtttggagctgagtttcatgattgcctaagtgcggaccctcaaggcaatcctccatactccacctttgtccggagcaccatgaataagaaaaaagaagaagtagagatgagagtcgtcatcacggaaagggcagggtggacgaaatcagtgtcctatctttgctttcctcttatctccgatgagag

SEQ ID NO: 38163 - DNA, 546 bp, Glycine max
  Peptide Sequence Number=SeqID_129848
atgcagttccagttgcaatcacagatccaatcacagggagttgcactgcctccggagcttgaggttggtccctcagctgctcgtatcagcacaaaggggagttgtgttgatccctcagcgactgatctagacacgggtgactcagacaaatgccggttatacatcgaagaaaatccttcctgcctggttgccctaggaagagtttatgagggttccacaatcattgataacatccatttgttgcatgatcaagtgaagggagctgtgtctccagcaaaacctacagataggccggatcctgaggttatgtgggatgcttccctattcaggctgcttaattcagacttccccttgtacataaagcatgaagatctgtctgaaatagcccacggtggtcaatgtctcagcatctctgttatacagttgtggattatgcatctgactgagacaagtatgcgattggggattccaatgtttatggattactcgagccacagtccatccagagatttgggcaatcgcagtttgaatcagaaagttacatga

SEQ ID NO: 38164 - DNA, 234 bp, Glycine max
  Peptide Sequence Number=SeqID_129849
atgaaggtcaaagtggagaaggatgaaggtaatccttgtggcgtctaccctgacttatcttccttcattggaagtggcgtctacccggacttatcttccttcatcggaagtgacgtctatcctgacttatcttccttcactggaagtggcgtcatccaaatatccgtagcctgtatcaagcgatccgcgccccataagattcacatcatctggtatcagagcttcggctcttga

SEQ ID NO: 38165 - DNA, 303 bp, Glycine max
  Peptide Sequence Number=SeqID_129850
aacctacgtaggtctgagttcctcattggaggatacgtaggagcaagagcctcgcttttgtcgaccgcaccgctttttgttaccatgactcaagagctgaaatttggtctatccacacccttttgccaatcagacacagtcgtgtccgatggcgcgcagagacaaagttggtcattctgcacccttgtgtcatccagaggcggtgggcccgatgacacgcaggagataccttacgattatccgcaccctttgtgtcatccagaggcgacgggcccgatgacaagcagcggagataccaatgtg

SEQ ID NO: 38166 - DNA, 48 bp, Glycine max
  Peptide Sequence Number=SeqID_129851
gtcaagaggttgatagtgaaatatcgaatcaactaattcactcttatg

SEQ ID NO: 38167 - DNA, 456 bp, Glycine max
  Peptide Sequence Number=SeqID_129852
atggctactccacctcgctcgcctcctcctcctcctcctccccctgcggacctatcaacgtctccgtctaccatgaagtggacacgcaaagcgacatggctacgatcgttggccattagacaacctggtgcagggagactagtggtcaacgttgatcctgataccggcaaggccgacgatccccataagaaattaagaacatatttggagggatattcaggatgtgctgaaaaaggcacaggccatccaaaagcaaaacactgcccccacgtgttgtctcgtgggggttatgaatatttagaacaaaagctcatggcagagaagacaaaaaagaaactggaggaagctgctcagtctggaagcactgatggcgtcattgacccttcatctcccatcagatgctacgtgaagtggaagatggcccgcacgaagaaaattgggcgtgggatcctctag

SEQ ID NO: 38168 - DNA, 805 bp, Glycine max
  Peptide Sequence Number=SeqID_129853
atggctaaatttgacccggagatagtcatagaattttatgccaatgcctggcccactaaggagggggtttgggacatgcgttcatgggtgaggggtcactgggtcccctttgatgcagatgccatcagccagttcttgggcgacccactgattttggaggaagaccagcagtgtgaattcagccagaggaggagccagacagacggtttcgatgaggaagccatcacccagctgttgtgcataccggggcaggatttcacccagaccgctgcagggaggcgggtgcggatcacatgcactagcatgactaccttgacccagatatggatgacactgctgctcagcaatgtcttgcctagcgaccacaactccgacctccctctgcctaagtgccagttggtgtatgccatcctgacacagatgagcgttcatgtggcccaggtgattgctgatgccatttatttgtttgcaggaacggcgcccactaggcaccctctggacccagagaagtccaacaaggccctggggttttcggctttgatcgcgggcctctaccagtcctacggagttcctgtcacccccagcaaggtaatccgaccatcgatcacccgagccttcatcgagaagtactgcacacctaggcaggcgcagggcgacgcacatcaggtgacgcacatcaaccgccgccacctcggtaggccgattcggatgggccactgggcgtggagcggtatctacagcatttggttcgccagtaggcggccaaccaccgtggacaggtgcagatacatgagtgtctctaccg

SEQ ID NO: 38169 - DNA, 534 bp, Glycine max
  Peptide Sequence Number=SeqID_129854
atgcaatctcagggacttgcagtgcctcctgagcctctggttggtcctggtccctccggtcctcgagtgcggcttgtacatagaagcagatcctgcccgcctggatgccatggggtgagagtttatgagggatccactcttgttcataacactcctttgttgcctggccaagtaaaggtgagtgtggacaaggttaaagatgcagatgctgcagttcctgtacccactgttgaggtttccttagtgggtcaggcacttcacacgttccttgcttggccgacacatcagatcaagtctttatcaaaccaggttagatgggatgccaccgtgttcggggtagttaatccagatttccccctgtacataaagaacgaagacctctctgaaatcgcacacgatggtcaatgtctcagcatatcagtgttacagttgtggattctgcatctcactgcaacatgtatgcgagcggggattctgatatctatgattcctcgagcctcagtccattcagaggtctgggcaatcgcagtttga

SEQ ID NO: 38170 - DNA, 360 bp, Glycine max
  Peptide Sequence Number=SeqID_129855
gttgtaggatgtacaatttgtggtggatctcatgaatctggatgttgtatccctaatgaagagcaagtcacacatgaagtcaattatatggggaaccagcccaggaacaattttaatgcaggtggattttctggattccaacatggacaacaatgcaaccaacaacacggacaatggaggaaccatcctgggaatcaattcaatagagaccatgggggatcatccataaggtcgcaacaacaagggcctagtctctatgatcacaccacgaagctggaagagactctagctcaatttatgcaggtttctatgtctaaccagaagagcacagagtctaccataaagaatctggaggtctaa

SEQ ID NO: 38171 - DNA, 201 bp, Glycine max
  Peptide Sequence Number=SeqID_129856
atgagtgtgaggtcgtggtattgtgttgtagaagcaaagcttcatgatgatgacaaaggagatgacaaaaagctcaatgatcaatcaaagaacaactcaagaagaaagtttagagtcaagaatcaagattcaaggttcaagatctcaagaatcaagatcaagattcaagactcaagattcaagaatcaagagaaggcttaa

SEQ ID NO: 38172 - DNA, 201 bp, Glycine max
  Peptide Sequence Number=SeqID_129857
tgtatgtagggttttcttcgagccacacttcgaagagcagtgtagggggttctgtgggttcaaccgaggggttttcggcagtattgagaatagtgtgggacaatgtgggtgtcaagggagtggtttctggcagatttcaggtgggaggagaaagagaagagcgatttcaggaaggaagacaaagagaagagggagggcaag

SEQ ID NO: 38173 - DNA, 476 bp, Glycine max
  Peptide Sequence Number=SeqID_129858
ttaatcaatcggcaaatatttctgatattaagtgtgatattcccgaattgaaaggggacaattataaggtttggagggagaaaattctccttcgtttaggctggatggatattgactatgctattaggaaagacgaaccaccaggcattactgaaactagcactccagacgttgccgatctttatgaaaagtgggagagatctaatcgtctgtccgtaatgttcataaagactaatatatctgctagtatctgtagttttatcgatcagtatgaaaaactccaagggataaggggtgtacgtgatcacatcatgcgcatgagggatatagtggctcaactaaaagccttggaggggatcaacccaaaaaacaagggcaagattcctgctcagccagtcataaaggaagagtccaagtgtttcttttgcaagaagaaagggcacatgaagaaagactgcttaaagtttaagagctag

SEQ ID NO: 38174 - DNA, 209 bp, Glycine max
  Peptide Sequence Number=SeqID_129859
gtgttcccacaaaccctaagagaataaagaccattcctgagtggtccactccaccaacaccactcattgagttggtgaggaaccatgttccctcatgggaagatgtgtcaggggggatcccagagtatcaagaacctcgggatttgaggtcaaatcctttccaaggtggaggggatgatgcaatcctaccccccaagggtattggatag

SEQ ID NO: 38175 - DNA, 545 bp, Glycine max
  Peptide Sequence Number=SeqID_129860
cgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggtctcgttgggagcgtgcgtgcacgcaaagggtcgtcgatgggtccagaactgaccggctcgcacgtgattggtctcgagcgtggctcatccaccattttatcacggcgaagtcgggccatgaacccagatttcaaccaaccacgaggcgggtgctcgcgggaggtcagcatacaccccgcgcagcaacattgttacatgtttgcgttggggaaacgatgtgtgacacccaggcaggcgtgccctcggcctaatggctttcgggcgcaactttgcgttcaaagactcgatggttcacgggattctgcaattcacaccaagtatcgcatttcgctacgttctttcatcgatgcaagagccgagatatccgttgccgagagtcttttgtat

SEQ ID NO: 38176 - DNA, 315 bp, Glycine max
  Peptide Sequence Number=SeqID_129861
atgacagctgtgtctccaacaaaaccacctccaaagcccgatccggaggtcgatgatccgctttatctgatgacattgaccatcccagagcttttcttgaggccttatcaggttacatgggatgccaccgtgttcggggtctttaatccagatttccagctctacataaagcacaaagacctctccgaaattgcacacggtggcatctcactgaaacatgtatgcgagcgaggaattctgatatctatggattcctcgagccacagtccattcagaggtctgagcaatcgcaatttgagtctgaaagttacataa

SEQ ID NO: 38177 - DNA, 267 bp, Glycine max
  Peptide Sequence Number=SeqID_129862
atggcttacactcacattccggattcaacaagcgattctcctcaaatttcagccagctcgtatcaattagaccttgcaccttacgcttcagagccctacaatgctcaatggaacgccccggggcttctccgtgacaagcacacgttgcgttcgagtcgtattctcggagaaatggaggttgatgaaccttggctagggttatggctaccattgaattatcaagtggtcttcgtcattggaagtgcggtagacagactttgtggttga

SEQ ID NO: 38178 - DNA, 357 bp, Glycine max
  Peptide Sequence Number=SeqID_129863
atgagtatcaaaaaaccaactgatggagtggtggatattgctgtttctgagcatcagattgccaaggaaatcactgccaaacgagtccagcattggccaaagaaagggaagctttcagcagggaagctaagtgtgaagtatgcaattctacacaggattggagctgcaaactgggtacccaccaattatacttccactgttgccacaggggacacatgtcccagacattgtctcgacatcatgaaagctgctgcttcaggtgctgtgtccaaggatgctctgatagctgaactcaaggacacatgcaagtgctggaagcaaccatcaaagccaccacagaaaagaagatggagctag

SEQ ID NO: 38179 - DNA, 687 bp, Glycine max
  Peptide Sequence Number=SeqID_129864
atgggttctttacaagaaagaatcacttctaccaaagaggggtccataacttctattcaagcagtttatgtacccgcagacgatttaaccgatcctgcgcctgctacgacatttgcacatttagatgctactactgtactatcaagaggattagcggccaaaggtatctatccagcagtagatcctttagattcaacctcaactatgctccaacctcgaatcgttggtgaagaacattatgagactgcgcaaagagttaaacaaactttacaacgttacaaagaacttcaagacattatagctatccttggcttggacgaattatccgaagaagatcgcttaaccgtagcaagagcacgaaaaattgagcgtttcttatcacaaccttttttcgtagcagaagtttttaccggttcgccggggaaatatgttagtctagcagaaacaattagagggtttaaattgattctttctggagaattagatggtcttcctgaacaagccttttatttggtagtaaatgatgcggaaaagggtagtgacattgatccacaagaagcacagcaaactcttgaaatagcagaagctaatttgaataaggcggaaggcaagagacaaacaattgaggcaaatctagctcttagacgagctaggacacgagtagaggctatcaatgtgatttcataa

SEQ ID NO: 38180 - DNA, 280 bp, Glycine max
  Peptide Sequence Number=SeqID_129865
atgaggaagcttgagaaggcagcttgtcagaattctgggactgttgttgattcaattgggaatgtatggtctgcttgggccaacagcattttggaaggaaggagcaggctgctgttgttgttgctgagggctggaccatctgaggttagggtgattcctccatccagggttatatctgttgctggagaggctgctcaattgctccaggttgctgcatggaagggcaaaggtctgtatggtggtcagcagagggagcacaaaccacaaacctttgcgacag

SEQ ID NO: 38181 - DNA, 390 bp, Glycine max
  Peptide Sequence Number=SeqID_129866
atgtgcaaattcaaaaacgagcacgccttcccgccatatggcttgcctctcaactatacgccacccaatgtggcgtacactcccaatgaaatctcaataactccactcccatactcattaagagccaacaacctcaatctgatcatgcacatatctctcatggaggagacacatgaaattccccaccacaatctagctgacttcgagccttggctcggatatgccactgaagggcaagcagttggtggtatacccctgcaaaacactttggagggccctcagtttcgcccacaaccacaaccctcacgttccacagtggttaaaaaccctcatgactatggcagaaatgggaaagttggatcatctagaggaaaggctcagggccattga

SEQ ID NO: 38182 - DNA, 189 bp, Glycine max
  Peptide Sequence Number=SeqID_129867
atgggacttgctgtttttgctcccccaagccacctttggttgcattttgctttcatttttgatactcctactcactccaacaaggatggccctaggcctatggtgcattctgaagcaatggggcatgccacattgcccccattcccttgctattcatgcctaaacatatgcccaccaagtgctcggtga

SEQ ID NO: 38183 - DNA, 246 bp, Glycine max
  Peptide Sequence Number=SeqID_129868
atgtacaggaaaagaggtctcctgtacaggtggcatgagcaccggggggttgcgagactctgtttgatcttctcgaaggcctcttggcagtcactgttccacaggaccgcctggttcttacgtaatagcttgaaaatgagctcacagggccgtgatatctttctgggaactctcatctctatcccttgggttgactggcacaataatcccaaggcacttccactttaccccttttgggtgacgtaa

SEQ ID NO: 38184 - DNA, 507 bp, Glycine max
  Peptide Sequence Number=SeqID_129869
cttggctaccccatgagaggagtgccatcagacgaaagcatcatgcctttcatcgcacggggtttcagtgaccacaatgcgagggacaaagagcttaggggaagcagtaatgggatcatcggcggctatcataagtggctgagagtccggacacaaggattggattggctcccaaatctaaagactgtgagagacaatgaggttaaagcttcggaagaatgtgatgaggtacaagccctaaaggcgaagcttgaaagagcccgggtagtcaaagagaagttcaaggcagcaatagtgagctcaagctccgaagatgtgaaaggaatcatcatgggtcaaaggcatgatcttgaaggacgagctaaagcttgccttagcgagactgaagggaatatgtgggccatcatcgatgagtgcaaagagaagctaaatctagcgacgactcacgagcaaaggctagaggatgagtacgccaagatatcagcagaaagggaagcaagggaaagg

SEQ ID NO: 38185 - DNA, 309 bp, Glycine max
  Peptide Sequence Number=SeqID_129870
atggagtgcctagagggagcttgggagaccctcgaaggcaacgcgaggtgccgatttcggggcacgattcgatttacggctacttcattggtgcatctagatgaacccgcgcgcacgcttcagcgtactgtggagtggatactacccacgcctacaccataccgtctagtggagctagtccaaggtgatgaggacccactccctgaggtggattctcccgaggacgtcatgtcggcatccgaggcagactctacagaggatagtgggcccttagaagagatggcgatcagcggaggctcttcatcctag

SEQ ID NO: 38186 - DNA, 173 bp, Glycine max
  Peptide Sequence Number=SeqID_129871
accgggaaaaatagaccggactataccctggtccctcgggtccaatgggtgcacctgactgtccccagttcagttggaacagaaatcaccaacattcatagctcccttggaagtgttggtgcactttcacatgggccatggggtaatctcattggtattggatgcatcgttag

SEQ ID NO: 38187 - DNA, 60 bp, Glycine max
  Peptide Sequence Number=SeqID_129872
atggggaccgaccgaggctacggaggtttggatgacgccacttccggtgaaggaagataa

SEQ ID NO: 38188 - DNA, 117 bp, Glycine max
  Peptide Sequence Number=SeqID_129873
tagctcatatggagcttgtttgccttggatcttcttcatcaatggattcctttgcttcttgaggtctaattgcagcgaaatggagaaggagaaagatgaatggagatgccacttcaa

SEQ ID NO: 38189 - DNA, 123 bp, Glycine max
  Peptide Sequence Number=SeqID_129874
atggcgagggcatgtagccctctgaaggtgaggacgtgtagtcctctgaaggcgagggcatgtagccctctgaaggtgaggacgtgtagtcctctaaaggcgtgggcgtgtaggcctctgaag

SEQ ID NO: 38190 - DNA, 675 bp, Glycine max
  Peptide Sequence Number=SeqID_129875
atggagacgtgtttggaagtagaggaattgttacagcggatgatagaccaaggtcgactagaagtcggcattacaggaaaagaagagcagcatatatgcatgcaatctacggaggggagcggtgttgcgaagcccaaacccttggtgatatacttcactaaaagtgcagcctcgcaaaagcccgggcaccccttaatggccaaacctgttcctttcccgtaccaaaatagtcacgcggtcccgtggagatatacacctccggggaagaaggaagaagaagtcactgacgtcagctcgctgtcagctaaagtaacaaatatcacggggctgagcggtgtgacccgtagtggtcgtgtgttcgcacctccggacctaccagtccaacccgccgacgtcaaaggaaaaggaaaagtggtggaggaacaagatggcgaagcaccccacgcttcgagtaaagatatgccagcaaaggggcccccggagaaaagggatggtagaaaggaggtgtcgctagaggaagccagcgagttccttcggataattcagcagagcgaattcaagggttatggggcaggaaattctgataccaatgccagatgtcgtacaggatgtcacgacatcacgcttcagaacatgcagattatctctgagtgtatgaacagattaaacaagtaa

SEQ ID NO: 38191 - DNA, 282 bp, Glycine max
  Peptide Sequence Number=SeqID_129876
atggctaagtttgaccctgaggtagtcctggagttttatgctaaatgcttggcccatagaggagggagtgcgagacatgcgttcatgggtatgcaacccaccaggcaccctctagacctggataagtctaacagggccctggggtttccggcgttgattacgggcctctgccagtcattcggggttcccgtcacccctagtaaggtgatccgaccgctgatcacccgggccttcatcgagaagtactgcacgcctaggcaggcacagggtgatgcacattag

SEQ ID NO: 38192 - DNA, 147 bp, Glycine max
  Peptide Sequence Number=SeqID_129877
atgcgaggggtagttatcttagctcagacaaaatatcaaaattcccaacggttagattgcttgcgggaaaaagagagggttttggaagaagaaagaaaaaacgaaattgtgaggcagaggaggctgaggagtcagtctcaaaactga

SEQ ID NO: 38193 - DNA, 207 bp, Glycine max
  Peptide Sequence Number=SeqID_129878
ttgagcctcagcctgcagagccagggttttacttcttttccatgccctactccggatcagttcagggcagaggtcgcttggcccagagattggccggaggcaccagcagaggcaccagtagaggctcccgacgaggcaaatgaggcccgcgaggacgaggagatgaccgatttacttgatttcttaggagggagcggagccacatga

SEQ ID NO: 38194 - DNA, 600 bp, Glycine max
  Peptide Sequence Number=SeqID_129879
atgctagctactggtaatcgattaccagagagtaaaactctttggttacgcacagaccacagagagattgaggctgctctttgcataccagggagggggttcattttgaatgttgagggccatccagggaggattctcaggaaggatttgactaccttggcccaggtgtcgagtgttctttcttactccaacctggcccctacatctcatacatcagatcttactgtggacagagccagcttgatctttggtctagtctctcatatggacatgaacttcgatgctctcatatcaagacaaatgacttccattgcccagtctaactcttgcaaacttgggtttcctgctttgatcatcgctttatgccgagcccgagtagttgtctcttacagcctcacatttgagtgcctgagcccggccattaacttggcctacatcaggaagaacttttggaacattgatgatctaacagttgctttccggggggctaggagggcgagggcgaggccagctgatattccatcttctttttcagcttcagcacctactccaacatctacttctacagctccttcagttccagctcatgttgactcatag

SEQ ID NO: 38195 - DNA, 303 bp, Glycine max
  Peptide Sequence Number=SeqID_129880
atggcggcacagctaatccatgatcgagtggagatggagtgcctagagggagcttgggggaccctcgaaggcaacacgaggtgccgatttcggggcaccattcgattcacggctacttctttggtgcatccagatgaacctgcacggacgcttcagcgcacggtggagtggatactacccacgcctacaccatatcgtctagtggcccgggggagatggcgatcagcgtcggcatctgaggcagactctacggaggatagtggcccgggggagatggtgatcagcggaggctcttcatcctag

SEQ ID NO: 38196 - DNA, 195 bp, Glycine max
  Peptide Sequence Number=SeqID_129881
atggggggtgcaaatagcacccaggcccatttgggccctccagaagccaaggcgcttccgaaacgtttccgtaacgttttccgtgaggaatctcgcaaaggtttcaaccgttcttcgacgttcttcatcgttcttcgatcttcaacgggtaagtacctcgagccaagcttttcgattcattctatgcacccatag

SEQ ID NO: 38197 - DNA, 324 bp, Glycine max
  Peptide Sequence Number=SeqID_129882
atgccaatctccccctacagatgtatccgttgggatcgcacccacaagatgcctagtggacccgaagaagtccaacagggtcctggggtttccagctctgggatcgcgcccgcaagacacctagtcaacccgaagaagtccaaaagggtcctgaggtttccagctctgattacgggcctctgtaattctacggagtgcccatcatccccagcaaggtcatcaggcctcctactaaccgagctttcatcaagaagtattgcacccccagacaggcagagggcgagacaccacaacagcattgggatggccggtagcgggcaatag

SEQ ID NO: 38198 - DNA, 234 bp, Glycine max
  Peptide Sequence Number=SeqID_129883
atgtcgcttgagcaaacaaaccaatggcttgcacccacattccagtggaagcaaagattgttaggattcacaagcgattctcctcaaatttcagccaggccgcatcaattagactttgcaccttacgctttgaggtcatatagtgctcaatggaatgtcccagaactcctccatgatatgcacatgttgtgttcgagtcgtatcctcggaaaaatggaggttgaggaaacctag

SEQ ID NO: 38199 - DNA, 250 bp, Glycine max
  Peptide Sequence Number=SeqID_129884
acacttgtcagcattgtcacacctcttaggcttgagtttattcctcaagtaaaggagttgttggatgagggggttcccatgaaccctaagagaataaaggtcattcctgagtggcccactccaccaacaccactcattgagttggtgagaaaccatgttctttcatgggaagatgcccaggaaatgggtgttgagggaaggagcccagagtatgaagaacctcgggatttgaggtcaaatcctttccaag

SEQ ID NO: 38200 - DNA, 420 bp, Glycine max
  Peptide Sequence Number=SeqID_129885
ggcaagtctggtgccagcagccgcgttaaaaaagctcgtagttggaccttgggttgggtcgatcggtccgcctccggtgtgcaccggtcggctcgtcccttctgccggcgatgcgctcctgtccttaactggccgggtcgtgcctccggtgctgattctgatcctattgtgttggccttcgggatcggagtaatgattaacagggacagtcgggggcattcgtatttcatagtcagagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 38201 - DNA, 443 bp, Glycine max
  Peptide Sequence Number=SeqID_129886
aaaacaccaagactcttttaagtctcacaagttatccagaactacgtaggtctgagttcctcattggaggatacgtaggagcaagagcctcgcttttgtcgaccacaccaccttttgttgtcatgacccaagagctggccaatgtggtcatttgcgccctttccggagatgtcagcatcttccggtggagactttttcaagtctcacaagttatccagaactactcgtgtccgatgcacgcagagacaaaatttggtcattctgcaccctttgtcatccaaggcggccgcaagcccgttgtcacgcaggagaaatttacggtcatttccgcacttgccatagacacagtctgtcatacgattgagtcacgcaagacgggcggaaatacccgagtggttatccgtataaacattcttttgctatctgtaagacagaacgcttga

SEQ ID NO: 38202 - DNA, 252 bp, Glycine max
  Peptide Sequence Number=SeqID_129887
atgaaattagggtatgacactaccctttggcgggagggcaacacggagctcacgggtgcgtcttccatgggaggaaaatgcgcggagtcgccaccaacgtttattcgaggaaaacgtaggaaaaaactgaaaaaggtgtggtctacgaactttaagtgtgaaaggttcgggagttgtttttacgcatggggaagggtgtttccctcgctcctacgtatcctcaattgcgatgatgaagtcagacctatgtag

SEQ ID NO: 38203 - DNA, 134 bp, Glycine max
  Peptide Sequence Number=SeqID_129888
gatgcacggggatcctccggtagagtattggaatgatcttaagagtgcccttaggaagaggcacattccctcctactatgaaagggagcttatgtacaagctccaaaggcttagacaagggctccataatgtag

SEQ ID NO: 38204 - DNA, 288 bp, Glycine max
  Peptide Sequence Number=SeqID_129889
atgcccttcattgcaacaagagttaattggacatcatcgtatccattggttacaagtggcagtggattaagctttactggtacaccacatggagatgtcttcggttgtagaatgagattagaccacatgacaactaaacagaatgacaccaagcagatagagttaaacttcaattccgcctccgataagacataccagatcccccaagaaacatggacaaatatcacaaaatcgtcatgcgaggtcgaactgacacaaattaggctgaaaaacatgcaaaatggataa

SEQ ID NO: 38205 - DNA, 537 bp, Glycine max
  Peptide Sequence Number=SeqID_129890
atgaaaagatggtgggctgcgcaccctcaaagctttgcagatttggtcttcgccaatgaaaggatcaatgtgggtccgaaaagaggcaaatttgatcatcctactaggacgactgagaaaactggggcaaataaagagggtgaggatgagggagaaacccatgctgtgactgccattcctgtacggccaagtttcccaccaacccaacaatatctttactcagccaataacaaactttctccttacccaccacccagttatccacaaaggccatccctaaatctaccacaaagtctgtctaccgcacttccaatgacgaacaccacctttagcacaaaccaaaagcaccaaccaagaaccataaccctagccaaggttcatcaacctccatttctccgagaatacgactcaaacgcaacgtgtgcttgtcacggagaagccccagggcgttccattgagcatggtagggctctgaagcgtaaggtgcaatgtctaattgatgcgggctggctgaaatttgaggagaattgcgtgtaa

SEQ ID NO: 38206 - DNA, 678 bp, Glycine max
  Peptide Sequence Number=SeqID_129891
atgctggatgaaaacaatgctcatgcaaaaagtttcaggatggcaaaggatagattgacagacactcaagtgcataatgtcagactcaaattgattgttggtcaagaaaaagatggtcgtacatataatgtaccaagtgttccagaagttgctgcacttattgcagacccaatgaaggtcaaactctgctgcattctagaaaactattccagcaatttgttgctgaaaggatacacaatgattgaatccgaaagactctcctatgttagaaacaaccaaaagaaactcagagttgataagttctatagcttgcagcagtcatctgaagctggaaatacagaaggtttaggccaaggcaagaggattatcttaccttcaacctttgttggcagcccacgttacatggatcaactttattttgatggcatagctatatgcagtcacgtaggcttcccaaatctttttattacttttacctgcaatccaaattggcttgaaattcataggctgctgacacctttgaatttgacaccaatagataggccagaaataatctcccgcattttcaagcttaaatatgagcagatgttattagaccttacaaagaatcacctgctaggcaaagtcgtcgcatgtaagttgatgctaattcctatttgtagtgctacaaatagataa

SEQ ID NO: 38207 - DNA, 186 bp, Glycine max
  Peptide Sequence Number=SeqID_129892
atgaaatatttcactcaatttggagtgcttcttagtccattagctcttaaggtggttttccccttgcttcttgactcaaattcttcaaacgatggcaccaatcctcctttccaattccctatatggaaactcacaagcaaggaaacaaagagacaagcaataaccaaagaccaaaaaatgaagtga

SEQ ID NO: 38208 - DNA, 911 bp, Glycine max
  Peptide Sequence Number=SeqID_129893
ttcgcgcgcggcgcaggcctcggcgcagtggtgttccaggccggcatggtggctggtccggcactgggtggcgtgctggtcggcttcggcggcaagggcctctcctacgcggtggctacggcctttgcgctggtggcgatggcctgcctggctacattgaaggtggaagaaccggtgcacaccggtcccgccgcgccgatcttcaagagcatcgccgaaggcgcgcgcttcgtggtcggcaaccggatcatggtcggggcgatggcgctggacatgttctcggtcctgctcggcggcgtggtggcgatgctgccggcgttcctgcacgaaatcctgcaccacggcccggaaggcctgggcatcctgcgcgcgatgccggcgctcggttcggtgtgcgtgggcctgtggctggcccgccacccgctgcaccgcaatgccggccgcgtactgctgttcgcggtggccggtttcggcctgtgcgtgatcggcttcggcctgtcgcagcacttctggctgtcggcgatgatcctgctgttctacggggccttcgatggcgtctcggtggtgatccgatcgaccatcctgcagttggccacgccggaagaaatgcgcggacgggtgtcgtcaatcaacggcatattcatcagttcgtccaacgagctgggcgcgttttacgccggcacgatggccaagctgctcggcctggtgccgaccgtggaaaagggtgggttcgcggtgctgagcgtggccgggatcaccgcgtggaagaacccgacattacggaaattgaatcttcgcgacctgcagtgacgctgctaacagcggattcggcggcgccgggtgtttggctggggccgttgctctccctcgatgattgggcttgtcactttcttttcgcgaaaagaaagtaa

SEQ ID NO: 38209 - DNA, 469 bp, Glycine max
  Peptide Sequence Number=SeqID_129894
atggttcacgagcagagaccaatgtggtcatctgcgccctttccggagatgtcagcattttccgatggagactttttaagtctcacaagttatccagaactacgtaggtctgagttcctcattggaggatacgcggcgggcccgatgacaagcagagaccaagtttggtcattctgcacccatgatacgcggagataccttatggttattcgcacccttttgtcatccagaggcggcgggcccgatgacaagcagagaccaaagaccaagtttggtcattctgcacccatgatacgcggagataccttatggttattcgcacccttttgtcatccagaggcggtgggcccgatgacaagcagagaccaagtttggtcattctgcacccatgatacgcggagataccttatggttattcgcacccttttgtcatccagaggcggcgggcccgatgacaagcagagaccaa

SEQ ID NO: 38210 - DNA, 177 bp, Glycine max
  Peptide Sequence Number=SeqID_129895
gatgactttgtagcaattgctgataggttggacatgctattgaacctgaggatattgactgaaggaacaaaagtctataccgttgttgaagaatgtgtgggcatcgcaagatgctacattggccaaccaattgtaggtcacaaatcaaagcaaaggtggcgtacgaacgatcattga

SEQ ID NO: 38211 - DNA, 174 bp, Glycine max
  Peptide Sequence Number=SeqID_129896
atgtcagtgaaaaacctcgtcgggcgcctaggagttcatgacaaagacgaaccacacaccagcaagtcaagcttaaaggagcactcaaaccgggtgacccccaaggactacacttcgaagagtccgtcagggcctctccctcctgattcaagttcaacccagaaaacattttag

SEQ ID NO: 38212 - DNA, 183 bp, Glycine max
  Peptide Sequence Number=SeqID_129897
atgccacacagggacaaccttttgaaggtgttcgttacaatgttaaatgaaatggaagaagttgacatctttgtccctcatcctctcacaaagatgatttgttattcaactttcacattggaatggatgcaagccattggtctgtttgctcaagtgacctccgctctgagtgttgacttctaa

SEQ ID NO: 38213 - DNA, 714 bp, Glycine max
  Peptide Sequence Number=SeqID_129898
atggtcattgaccaatccctattctatgagttaacccaattatccagtgaaggtgtaccatttgacggtacactgattgatgattggaaatatgaattctctgtgcatgatgcccgccggttggtttgcaccaaccaagtggatatgaccggaaggcttcttgccagttcattggcttttgagagccgcatccttcattaccttattgttcgtatcttgcttccaagatcttcaaaccttgcacaggtttctgaagaagatcttattgttatgtgggcttttcatgaaggccgacaaattgattgggcacacttagtcggatatcgcatgcataaggcattgcgattaaatgctccattgccatatccacatctagtcaccctcttccctcaacactttaacgtccctcttgattatgaactctatgttccaatcaagagatcctttctaataggtgttgttgtcattgcatcctttggctatcaaaaagagcatgatggctcttgggtgaaaaaggattcctctcttcttcaaaattttttggataggttcgatggtcttctaacctttgttggtgaaaggtttgatactttggagttacaagtggacatgtgcttcaatgagatggattcaagaatcaccaaggtcgaagaagatgtttcttatattcgtacaagctttgatctaccaccaccgccgccaccatcattttag

SEQ ID NO: 38214 - DNA, 240 bp, Glycine max
  Peptide Sequence Number=SeqID_129899
atggatgaattcattgaactgatgaaagaacataacttggaaacgttgggatgcttgagtgctcacctggctgtagccatgactaattttgcacgttgttttcaaatcatcattgtcacgcgtgccttatggaacaatatggaagctcgtcctaagatcgacaccttgacacccaaatttgtttcgcccagatatcaagattgggttcacacgataaagaccccattgaagacaccttag

SEQ ID NO: 38215 - DNA, 243 bp, Glycine max
  Peptide Sequence Number=SeqID_129900
atgaatcaccattcatctaatgttaatggcaagggtactagtcataaggaccctctatctagaatcttagatgagttgagttccctcaagttatggaaagaaaaactagaaagaaaagaaaaaggaaaagagagggaaggcataggtcacatattagacctcactctcataggagagaaaaggaaagaaagcctcaagaggctaacattaacctcccatacttctatgggaaggacaatgtag

SEQ ID NO: 38216 - DNA, 475 bp, Glycine max
  Peptide Sequence Number=SeqID_129901
aggactacacgtcctcgccatcagagggctgcacgtcctcacctttagaggactgcacgtcctcgccatcagaggactacatgtcctcaccttcaaagggcttcatgccctcaccttcagaggactgcacatccacaccttcagaggactgcgcgtcctcaccttcagaggactgcacatcctcgccatcagagggctgcacgtccttgccatcagagggctgcacgccctcaccctcagaggactacacgtcctcgccatcagagggttgcacgccctcacctttagagaactacgcgtccttactttcattcttgggccaccgcctgatattggagggcgaccaactgtgcgagcacaaccagagagggaggctatcacgcagctactttgcataccgaggcaagatttcacccgtgccgctgcaaagagacgagtgtggatcatgcgcaccaacatgaccactcttaaatag

SEQ ID NO: 38217 - DNA, 225 bp, Glycine max
  Peptide Sequence Number=SeqID_129902
tcctacagggtgcccgttccccccggcaaggtcacgtcatcatagggatcgcgcctgcaggacacccagtggacccgaagaagtccaacagggtcttggagttgtcaagctctaattacgggcaggcgcagggcgaaacaccacagcagcctggggatggccggcagcgggcaacagacgcgccgccatcacctctagagttcacctcagctcatccacaaaaag

SEQ ID NO: 38218 - DNA, 870 bp, Glycine max
  Peptide Sequence Number=SeqID_129903
atggccaagttcgatccagacatagtcctcgaattttatgccaatgcttggcctacggaggaaggcgtgcgagatatgaggtcttgggtaaggggtcagtggatcccgtttgatgtagatgctatcgaccagctcctgggatatcctttagtgctggaagagggccaggagtgcgagtattgccagaggaggaactggtccgatgggttcgacgaggaggccatcgcccagttgctatgtataccggggcaggattttgcccggactgctgccgggagacgggtgcggatcatgcgcatcaacatgaccaccctgactcagatctggatgactttgctgctcagcaacatcaagcccagcgatcataattccgatctccccctgccgaagtgtcagctggtgtacgccatcctgacacggatgagcattcacgtggctcagttaatcgctgatgccatctatatatttgcaggtatggcgcctaccaggcaccctctggacccggataagtccaacagggccctgggttttcccgccttgatcacaggactctgccagtcgttcggagtccctgtcgcacctagcaaggtgattcggccgtccatcacccgagcttttattgagaagtattgcacgcagagacaggcccagggggatgctccgcaggccgtagacgcgccgccacctcatcaggccggtccagctggatcgtttgatacggagcaggcagaggtcacatggcctggagattggcctgaggcccaggcaggagaggcaccaacagaggctcccgacgaggcagatgaggcccacgaggacgaggagatgaccgatttacttgatttcttaggaggaagcggggccacatga

SEQ ID NO: 38219 - DNA, 180 bp, Glycine max
  Peptide Sequence Number=SeqID_129904
atggggggtgcaatgaccttgttggatatccctggtgggggaaatagatttttcatgaggaaaaaatacttgtacatgggggcatgtcactcggtttggaactcccttgaaactcaggctgatcaccatgggggggagttgcttgtgcacgacagggtgacctcgacagttactgcctag

SEQ ID NO: 38220 - DNA, 465 bp, Glycine max
  Peptide Sequence Number=SeqID_129905
atggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgcaggcttttcctcattctctggagggagtggcaaaggactggttgtattagacaactcagtggagagagcctgtatgagactcagtaatatggagagaagtatgatagatgctgccagtggtggagcccttggagacatgactcctgctgaagccagaaatttaattgagaagatggcttccaactcccagcagtttagcgccagaaatgatgccatagtcattagaggagtgcatgaggtagctacaaacccatctgcatcatctgaaactaagaagcttgaaggcaaactggatgcattggttaacttg

SEQ ID NO: 38221 - DNA, 261 bp, Glycine max
  Peptide Sequence Number=SeqID_129906
atgaaaacaaaaggtatgcagtttgtagaacaaaatgtcatgctgaaatatgataacggacaaatgcaggaacgatatgttcattatgatgccatgaagagatgcttatgtgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaactttttaagtaa

SEQ ID NO: 38222 - DNA, 4602 bp, Glycine max
  Peptide Sequence Number=SeqID_129907
atgaggcattcccaagggtttgattttgttggaaagtgggacaatgtcaagagtatggttgaaaattgtcttgaatatactatgaacaattaccagatctgtacagaaccagtgtcaatattacaggcttttcaactatctctgtgttggactgctgcttctttgctaaatcacaaacttgactttgaagcttccctcatgcttgctaagcagaacttgaattttgactgcaagaaagaagtagtggatgaaatcaattcaaggctctggactctgaaggaaaattttttaaaactcacaggaaactctaatgttgtcagctatccaaaagcttctgaatcatcaaatggggttttttcttatatagaagagacaacagaggttgaattagtaaaaaatgataattctaaaaatattaaaaactttcagaagcgtaaaagccagtggaacaagctacttctgatgcaacaggaagagaagcagaagttgaaaaaagatattgaaaatgaaaacgatgagttttggagaaggtaccaaatacacagggctgctattcaattatgttctcccaatgatgtaacgaaagagcaaaagctcaaggttttcaacactgaatacatgaaaataattagagaattggaaaggcagcatgaaatacgtctcaaggatcttgaggccaagcaattaaaaacaaggctgacattcccagagactttggcactggatgaattgttaaaccctgttgcttcaaacgaacctgggactaaggttgaccagacctgtgatcaagctcagcattctaatgctcctaaagcccttgtgtctgatcatgttgctgaaggagagggtttcaatgatatggttgaagtcataacaaggattggaactgggattggattatctgaagctcctgatgccaatgcctctgtagttgtaccatgcagtagcgcacttgaactgcaaactcctctggtcaaacatgctgatgctaataataaatgcaataatattgctgaaaatgaatatgatagtcaaggaaatattttctctaagcattccaattccagagaacaatgttctgatggagctattagcccgccagaggaaggtgtgtgtgtaaattatagttgtgaatctcatgattttgggcaggatgctataacccgagttctgccttcatgtaatgaagagatatgtgatgggaaaacattagatgttcaatgttctgatggagctattagctcaccagaggagggggagtgtgtaaattattgttttgaatctcatgattttgggcaggatgctataacacgagttcttccttcatgtaatgaagagatatgtgatgggaaaacattagatgttcaatgttctgatggagctattagctcgccagaggagggggagtgtgtaaattatagttgtgaatctcatgattttgggcaagatgctataacacgagttctgccttcatctaatgaagacatatgtgatgggaaaacattagatgttcccagtggagaggtggctcctacagtgtgtaacaccaccagttcaaatggtgatcatgttgaaatttcttctaggcaaggggaacttgatgggactatactgagcaatcctgtttgtggttcatcaatagaagttgaggctaatggttccaatgatggtgcaaagaatatggcccccgtgaattctcaatcatctgaagaagatatcccaagtgtaaataccatgtccacatcaaattgtgagaatgctgcacaaatccatgaggctgatgacaataatggttcaaaaaatgctgaaactctgaactcatctttgtctgatgaaagaatttcctcattgaattcaaaatcacctcaaggccatgtccgtaatgaaaatgccatgtgcatgcaaaattgtgaaaattttgcacagagccttgaggatgatgacagcaatggttcaaatagtgtcattccaaatccacctttgattgatgagagaaatgctgataggaccataatattaaatagagatgcacatgtgggaatggttgagactgtcaatttcactccttcaacagagcaaatatctggaggtgcagtagatgaagatggcctccccaaccacatttccgagaaatcggttttagatagtgtgttgtccagaccacgtgaagcttatagtccccgtggtagctcagatgctgattgtattattctttcaaatcaaccttcttttgagaaacaaaatcatgatggagtctcatcaagcatacctgttggacaaattccacttgaagtgtcaaacactcgtcatgagagaatcagtgtaaatgtattagatggggaggaagctgtgggaaggcctgccacagtcaattgtactgattatcctgagaatgtaattgctctgaattcttcatccatggatcaaatatctaatggaggtccattattagatggagatttatcaccagggccttgtacttctagcccaagcaatggtcggaccctacctgatgaacaaattcctgtcttggagccagaaaatagcaataaagtggctgaatgtcaattaacagacagtgtggtggtgaataaaaatgccatatctgaccagctggaaggagtatgtagaactatgacagaaaacagtttatccctggagactccagtatcaagaccagttgatgatctcatggagcctctagaacaagtgcattcattatcatctgtagagtctccacctgacccggatactgctagagaaatgaagaacactttggtatctagtcctgttgatattgtaccagctaatcaatccattaatgattcactggtcatggagcctccagagcaggaggcgcaattaccttctgctggtttcctttcttccaaccaggacctatctaatttgcctttggtgactggaactgaagaccagccatccaatgaagatgatctccccaaccacattcctgagatgccaattgagattcaaaatcaagttgtgcaacatgcctcaaattcagaccggcaggaaggagtgtgtagaaccatgacagaaaacagtttgtccctagagactccagtatctagaccagttgatgatctcatggtgcctctagaacaagtgcagccattatcatctgtagagtctcctcctgatcgggatactgctagagaaatgcagaacattttggtatctagttctgttgatattgtaccagccaatcaatccatgaatgattcactggtcatggagcctccagagcaggaggggcaattaccttctgctggtatcctttcttccaaccaggacctagctaacttgcctttggtgactggaactgaagaccagccatcgaatgaagatggtctccccaaccacattcccgagacatcaattgagattcaaaaccaagctgttgtgcagtgtgcctcaaatgtggaacttgactcatgttctcgtcaagttgtacatccagcctcaaatatggaccttgattcacttcttcctggtggagtcagactacagtcttcagacacaagaaatttgtcaactctcacagagattaataaccatcctatacaacctgctagccaatcagcttccaggattattcgacatttgtgccttgatccacttaccaatgaattggaaagactacgaatactgacagatcaaaatatgaaagaatatgaaaacaagaaattgcagttgaaatatgattttgagaaggaactcgaggaactttacaggaagtatgacattaaacgtaaggaggttgaggttgaatttcagaatataaggaagaacctggatacacaacataatatagttcttgtaaataagatattggctgaggctttcagggctaaatccatggatcttaaagtatctggtgcttcaagaatgcagcaagatgcaagtgttccacagcaactatttcagcttgcaagtcagcaaaatgccactcggccctgtctggtcggtccatcatcttgtgggcctcctgcagacagcatgcagagttcctacgctacaactacctctcagactatggtatcaccaatacaggccacttacagtacaccaggaactttctccagtgtttctccaagggtacctcatatcaactccctttcttcacctttgggaaatgctcaaactgctggggagatacgtgcccctgcaccacatctccagccttatagacccccaacatccatcccagcctccagtccctgtacagttccgcatgggaggccaagtcagcctgcacctggtaatattcctgtaacttctcccccattttctcaccggacaccctggtcaatgccggcaaactttcagtctgttcctcatagggggcattggcttgtaagtacaggtgggctatccacacctaatttatcttccgtgaattcttgcgctgatgctaacagtcaacctggtataaatctgccaaatgttcggccacatatgccagatttgcctacattgatgaacttgaacctatccaaatttagtggtaatagcacaccagctaactcggcacatccagctacatcacctgatgtagtctgtttatcagatgatgaatga

SEQ ID NO: 38223 - DNA, 1098 bp, Glycine max
  Peptide Sequence Number=SeqID_129908
atggagatggcggggccggtgacgcagggggacacggcggcgctactatactcctcgggaacgaccggattgagcaagggagtggtgctgacgcaccggaacttcatcgcggcgtcggtgatgatcggcatggacgacgacatcgccggggagcaaaacgacgtgtacctgtgcgttctgccgatgtttcacgcattcgggctggcagtggtgacgtacgcggcgctgcagcgagggagcgcggtggtggttatggggagattcgagctgaaggcgcttctgagggcggttgagaagcactgggtgacgaagctgtggctcgtgcctccgatcctgctagctctggcgaaacagagcgtgggttatggtatgacagaaacttgtggcattgtttctttggagaatccaagagtaggggttcgtcatactggctcaacgggaacgctaggttcaggagtcgaagctcaaatagtgagtgtggatacacagaagcctctccctcctagacagttgggagagatatgggtgcggggacctaacatgatgcaagtggatcaatggattttgtctcagaattcgtgcataacaagttggaccggaaattgcagttgtaaaattatgtttgaggcaaaagacttacattggaatgcgtgctataatactgtaaatcaagcatgcactaaaaccattagccatggagatcttggatattttgatgaagatggacaactttatgtggttgaccgtatcaaagaactgatcaagtacaaaggttttcaggttgcaccagcagaacttgaagggcttctcgtttctcaccctgaaatactagaggctgttgttgtcccgaattcacacttgagttacttcctttgcaatagatatcctgatgatgaggctggtgaggttccaattgcctatgttgttcgctcacccaatagttcgctgactgaagaagaaattcagaagtttattgctaagcaggttgcacctttcaaaaaattgcaaagggtaacattcatcaacagtgttcctaagacagcttcaggaaaaattctcagaagagagcttactgcaaaagcacgatccaaaatataa

SEQ ID NO: 38224 - DNA, 1290 bp, Glycine max
  Peptide Sequence Number=SeqID_129909
cactcctcttgccacaaacgcaaaacatgggcatcatcaccatccatctccaaagtctctttgtctcttgttttgcttgtcttcgtgtcagtttcttcttcttatgcaactcctcgtttcacccatggccgtacctacacaccacaatcacaagcagaaaagctcatacgaagccttaacctattcccaaaggactcggttaacattataaaaggtgaccttgatagttttgtcccaggaaagatcgtggagtcgaagttctcattttttggtgattctgggaattctattcaagaccttcgtcaccatgctggctactattcacttcctcattccaaagctgcaagaatgttctactttttctttgaatcacggaagagcaaggatgatcctgttgtaatatggttgactggaggaccagggtgtggaagtgaattagctttgttttatgagaatggttttagttactcttctgatgatactgacattcggcatgatgaagcaggcgttagcaacgacttatatgacttcttgcagggttttgctattggtaatgggttaacaaatcctgcaattcaatacccagcatacccagattttgcgttagacaacggaataattacaaaggctgcgtacgacaatatcagcaagttaatcccagggtgtgaacaagccgcaaaaacttgcgtccagtttacttattgcattgtgctgatctatgaagtacggacacttcagctctttgccgtgtccggtgtccgacacgcgtccgtgtcagtgtccgacaccgacacgacacccgtgctgatacacaaagtgcaatactatgacataaagaagtgtgagggagaattgtgctatgactttagtaacgtggagacgttgttaaaccagcagaaagtgaagagtgctttaggtgtgagggatgacttgcagtatgttttatgcagtacaacaatgcacaatgctctgctgcaagattggatgacaaaccttgaagtggggattcctgctcttcttgaggatggaatcaagttgcttgtgtatgtaggggatcgaagaagatctcatggaattggcttgtggtcaggccaaaaggcatttggaaaatctcctacagcgaaatttgtggttgatggtgtagaagcaggatctcttaatagctatggacctctctcttttcccaaggtgcatggggctggggcacttggtccctacggatcaaccaaaagttgcacttcagatgttgaaaagctggatgggagggaaattggatatgcatgttgttaa

SEQ ID NO: 38225 - DNA, 165 bp, Glycine max
  Peptide Sequence Number=SeqID_129910
atgtgtgtgagacagagattgcttgtaaggtcacatggtaaaagactcaaaggtagaaatggatcagaaatgagctggtttaatacaatctccgataatggcaaattctaccgcgataatatactcgcatttgatgtgcgcactgtttggattgagctggtgtga

SEQ ID NO: 38226 - DNA, 1104 bp, Glycine max
  Peptide Sequence Number=SeqID_129911
atggatacgaacgaccctttggatttcgaggtagaagacgaccttctgaaatgccctccaattaacaataaaaggaagaaaattattgggttggatgatcttcttaaagatcattacatagaacaggacaagcttttagagaagaggaataagcagaaaaagaaggctaagactaaggcaaagaagattgaaagttcctatgatgatgaagatagcaaggaagctaggttgactaggattgttgagaaatcttttggtgaagaacaagaaattccaccctggggagtaaaagtttttggagataagaaagcctttccccctctggagtctcctgatctgggaagttgtaaccttttacagtcctttttgaacaacaagctaaattccatggtggaattgactgcggacaaaggagacatttttcttgaagggttactagtcaatggttggctttcaaaattagcttatctgtgtggtcatgtagaaaaaacagtagccatttgggccttcaacacaatgttatattcatcaaaagaagagctctgtaactcttccagtgacttttggtgtgcaattctttcttctgaaaaggaggttgatcaagcaccggtcaaggttgattggtttcctgaatatatggatataagaagagctcttgacatttatgggtttctctttaaattttcatctagtgccaagcctaataatttagattctgacattgaaggaccacctcaaaacattagagcttggatcagatgtgtcactgcttgttgtctgataaggagtaaaaaggctatcttctccactgtagaagctgaagagatagttgaaattattatttgtctattcctagatcgccaatttcagggtttgttggtgcttttgaatgactgcatggaagcgattgtcaattactttacagaccaggaatggtgctcaagttgtgagaacatagcaaaattcattgcttgcagcgtcagttgtgacttgtcagtcatgagaaggaaattgggtctctcaaatacctgggtgaaagagcaaaggcttgtgttcttgatctctgttctctataacatggatactggtgcagagattgattga

SEQ ID NO: 38227 - DNA, 2328 bp, Glycine max
  Peptide Sequence Number=SeqID_129912
atgtcgaagcccccctccgccttcgatgccctcatgtccggcgcacgcgccgccgccgccgccaagaaaaaatcccaatccctttcccaatcatcaccctcatcccccaagaaacgcaaaaccccaccctcctcttcctcacaaaaccctagcgacctcaaacctccttccccacccaaaaccgttacacctcaagaaggcgccgttaagcccgaaccgctgaaggtccgccacgtgtcatcttcttctttttcgcaggagaagaccgcggagcttaagaagcaagctccgcagctgaagaagaaaccctccgatttcgatcccgcttctataagtgcatgggagaagggccaacccgtgccgtttctatttctctgcttggccttcgacatgatttctcaagaatccggaagaattgtcatcactgatattgtttgcaatcttctgaggactgtgatgtactccacgccggaggatcttgttaaggtcgtttacctctccgcgaaccggattgcgcccgctcacgaagggatggaattgggtattggcgacgcttccatcgtcaaggcgcttgctgaggcgtacggaaggaccgaggtgtggattaagactcagtatcagaaaaaaggggatttgggcttggttgctaaagagagccgttcctcgcagcctatgatgtttaagcccgaagcattgactattacgaaggttttcaacacttttcgtcttattgctaaggaatctgggaaagaaagtcaagagaagaaaaagaatcatatcaaggcacttcttgttgctgcaactgactgtgaacctcaatatctaatccgtttgctacagacaaagttgcgaattggctatgctgagaaaactctcttagctgcattgggccaagctgcagtatacactgaagaacactctaaaccgcctcctgatattcagtctcctttagaagaggcttcagagattgttaaacaagtctattctgtacttcctgactatgacaaaataatatctgcactgcttacagagggtctatggatgcttccaaagaaatgtaattttactcctggtgttccaattggacctatgctatcaaaggcaacaaagggtgtatctgaaattctaaataaattccaggatgtggagtttacctgtgaatacaaatatgacggagagcgtgcccagaatggatcagttgagatttacagtagaaatgcagaacggaatactgggaagtttcctgatgttgttgccgctgtttcaaggttaaagaaaccaactgtatcatcatttattcttgattgtgaaattgttgcatatgatcgttcaacacagaagatccgttctttccagatgcttagtactcgggctcgcaagaatgtagaaattgaagatataacggttggtgtttgcatatttgcttttgatttgttgtatcttaatggccaagcacttcttcaggaaaacctgagagtccgtagagaggctgagtttaggagttatatttctgaaatggtgaactgtatgaggctgaactggaaaggggattgtaagattgttggctttgggccaacatattgtgttgtgcgagcaacacctaggtggcatctctatgcctcttttgaggaagaacccggatttcttcagtttgcaacaacaataacatcaaatgatgttgaggaaatacagaattttcttgaccaagctgttggtgctagttgtgagggattaattattaaaacattaaatgaggatgctacatatgaaccttccaagcgatcactcaactggctaaaactgaagaaagattatatggacagtataggggactcactagatttggtacctattgctgctttccacggtcgtgggaaacgtacaggagtttatggtgccttcctccttgcttgctatgacaatgataatgaagaatttcaaagtatttgcaagataggaacgggattctctgaagctgtgcttgaagaacgttcttctagtcttcgttctaaagtgattcccaaaccaaaggcatactatagatttggagaaacaataaatcctgatgtctggtttgaagccagtgaggtgtgggaggtgaaagctgccgacctgaccattagccctgttcaccgtgctgcagtgggcatagtagatccgaacaagggcatatctctacgatttccacgactacttcgagtcaggcctgacaaagctcctgaacaggcctcatcatctgagcaggtcagagagcataactgctttttctacatgattgaaggttcggtgtacaacgtggaagaagctcatggagggtccaaaaagtag

SEQ ID NO: 38228 - DNA, 777 bp, Glycine max
  Peptide Sequence Number=SeqID_129913
atggataaatcgcttatgttcttctccaagaatgtcgggattaatcatagaactcagctgagttatgacatagggttgcagtggatagaggacctcagcaaatatcttggtgtgcctattttccaccaaaaggtgtctagtgggaccttccaattcattatggataaggttcatcaaagactgagtgcatggaaagctaaaatcttatcctttgcagaccctgttgaaggttggctagttaataattttaaagactgttttcctgatactattgtccatataattctgaacctaagtcatccaaagcaagaagatgctggattcgataagattgcttggaactatgctcctaatggcaacaataaaggagagtcctcagtgatttatgcagaagtgtctgctatccttttgggtttgaaactggcttgggcgaaaggatttaatagtgccaatcttgttgcggacattatagccaagcaggctttaaacactaacatgggctaccatatttttgttgtggctccagattgtatttctaatgctttaagagctgagttagctcataataaatcagccattggaattgggtttaagctttccccgaccccttctcatcaatggactcctaacgaagacgaagaggtgcacaacggaagacgaagaggaacaagcaccaacggtgatagaggaagaggaacaaccaacaagcaccaacagaggaacgagaacaagcaacaagcaccaacaaaggaagaggaagacgaagaagcggcgtag

SEQ ID NO: 38229 - DNA, 750 bp, Glycine max
  Peptide Sequence Number=SeqID_129914
atgcagctagctgtggcggccaacgctgtcgtttcaccgtcgccgttccgacctcatccccttctccggtcatccttctccggcgtctccgttaagctcactccccaatccataacgttttcacgcttgaagcccctcaccgtcttcgccgccaccaagaaggccgtcgctgtcctcaaggggacctccgccgtcgaaggcgtcgccactctcatccaagaagacgatgggggtgcatttgcccaccctcactcccaaataggtccgccgccggatggaaatgagatggaagggaaagtgagtaaccaagtgtgtgtttatagcccgacgacagtttctgttagcatcactggccttactccggggcttcatggttttcacctacatgagtatggtgataccacaaatgggtgtatatcaacaggagcacattttaatcctaataacttgacacatggtgctcctgaggatgaagtccgtcatgcgggtgacctgggaaacatagttgctaatgcagagggggttgcagaggctacaattgtggataatcagataccactctctggccctaattcagtagttggaagagccttggtggtccatgagcttgaggatgaccttggaaagggtgggcatgaactcagtttgacaactggaaatgctggtggaagattagcgtgtgggattaaacctgcgatgtgcagggtgggtattgctggtcagggtgaacttgtcaagcttattcagtag

SEQ ID NO: 38230 - DNA, 2565 bp, Glycine max
  Peptide Sequence Number=SeqID_129915
atggctattgctggtctacacagtgtgtctgtgctcgactcttctttcctgagggactcccgttcccagtcatctgggagaggtggagatggaaggcggggaaccacccggtcatcttcgctcttgcaaatgtggcgagagattgaggaagaacatgtggtgaatcaagttcaaggaagacctgatgaagtacctattgaacaaaggagggatgggttggttgcggacccttcacaagacatccaagaaagaaggcagcagcatgttttagaagatgcagttttgggtgagaatgaatctgaaacatggtcacagtcgcaaagtcagaatgaatcccatgatggtaacgaggatttaaacaattctagctgtgataactcttctgacttgggagaagttgaaagggaaagagtgaggcaaattttcagagaatggatgaatagtggcgctagggatcatgcatcaaacatttctggaagaaataacggttcaaggggagaatggcttggggaaaccgagcaggaaagggtgagagttattagggagtgggtacaaatgagtagccagcagagaagtgtttcctctggggaaaacagggaagaaccatctgctgaaattgatatgcaaattgaacgtgtgcgtgatggactcgttgttaaccagattgggggccaaactgagcatacacggaggggcatacgtaaattatgtggccgacaagctatgcttgatatgcttaagaaggctgagagagaaaggcaaagagaaattcaggagttgttgaaccatcaggccgtgtcacaattcccctatcgaaatcgcattcaggcattgcttagaggcagattcttgagaaatgatagacctgttgataataacaagcccctttctgttgcagaaagtgaattgggcttcttgaggcgaagacaaactgtatcaggtctaagggaaggatttttctgtagaaaggagaacagtggttgcagtcaagcaaccagcaatgcagatacctcatctaatgttgaaattgattttaatacaaatgaacaaatgggatcaagcagttcacatatagtcccaattgtacatcctgaacagtctgaccctaatcacagaggaagcaatagacttggggtatcaggcagccagaactgcgtacgaggtaccgcgtgtgagaatttggattggcaagaatctactgctcaagcagatcagttgcagcatttgccaattgaatcactagattgtcaatcatcattcagcgcttgtgttgaaagaggggacaaccctgagcaaaatgttgatgtgatgccaactgaagatgctgctaatgaaattacccaacaaagcttgcgaattgaagattcagagcatagtaataatcaagaattcagtgaggtgcataatgagccgtctgagctgggtggtataaataatagtcaaaacaattcttcaaattacaacattcatatggaggataatgttgttgatgatgtaaattggaatgaatctggtgctctagaaggagaacagccagaagaagtttttgaaaatgaaggaagtgagtggtatcagaataataccgaatggagaaatagcactgaggaaaatgtcgatgataatcagctcagcaatacagcaaatgagtggcctgacaacagtttggcaaacgaggatggagaaaactctcgtctgcaagaatctcatgaagtgtggcaagaagatggtggcttccaagaggctgtggaaaattggttgggaggaccttctgatcatgaaagtgctccagttggtagaattcgtggattttattttcctgaagatgacaacgtgtacagtgttgaactcagggaacttcttaataggagaagtgtctctaacctccttcgcagcagttttcgtgagagtcttgatcagttgatacagtcatatgttgaaaggcaaggtcatgctaacattgactgggaatttcaagaaacaactccttcttctgcctcagtagagcaggaccttgagcagcatagtagggatcaaattgttggccaggaggaggttactgttagtccacttaacctgccctctttacctataccacctcctctgcctatttgggaccagcaccaccatcgtgacaactggtcacagaatgacataaataatcagcgtctagtaatcgattgggagattattaatgacttgagaattgacatggctcgattacagcaaaggatgaataacatgcagagaatgctggaggcttgtatggatatgcagcttgagttgcagcgatctataaggcaagaagtttctgcagccctaaatcgctctgctggttcatcaggaatacatgattgcgagtcaccagaagataaatctaaatgggaatgtgtgagaaaaggactttgctgtatatgctgtgaaagcaatatcgattctttgttgtacagatgtggtcatttgtgtacatgttcaaaatgtgccaatgagttgcttcaaagcagaaggaattgcccaatgtgtcaagctcctgtggtggaggtgatacgtgcttattctatacaataa

SEQ ID NO: 38231 - DNA, 81 bp, Glycine max
  Peptide Sequence Number=SeqID_129916
atggatgaagtaaaggacaaagcaagtgtatggtattataaaaggtgccagcaacggttcaagtcaaaggatggtatatag

SEQ ID NO: 38232 - DNA, 1836 bp, Glycine max
  Peptide Sequence Number=SeqID_129917
atgcagcatagacggatcgaggagacagtgatagaatcggaaatacgaagaaataaaaagggcaaaaggaagaagctgtggaaagaagaaggagagaagaagggaccacaaatgttggagtttcaccccactcacgagtcactcactagtcacgggaccagcctcccgataatcgcttttgcaatcattgtagcactgcttagcttcattcacccttcttctcacttcccattccaaaccaacaccaccttctcaaccggaatcttcacactccccaccaaatctcatcaaaacctcttttcgatcgcacctaaggaagttgtgagtggttggaacttggaagcctctactagatccgctggagttggaggggtggagcaaaatctagggtttcacttgctgttgtgcttttacgtatcccgtgagagctttaaattgttttttgggtacttgcgtaggttttacgggttgggatattcattcacttgtgaaagggcttcttgggtgatcgttaaggctttgtttgggagtggtggcattaagagttcccaacaacacttgcaagagttctccaacaacaaccttgaacacttgtcgttacacccagggttcaacttggatctccttcaagtaagaaacgttcgaaatggcaacatgcttgacgaagctgcagcagcactttattcatcagaaatgatcactttttcgaaccctttatctgctcctagaaaccctttggagtgtcaagagcttatgatggctcagtatggttcaacttcgtttcctcattcatcatccacaaaggagcaacaatgtgaaccacgcaacttaggtgctagtgggatggtgaattataacggaagcaaccccaacaacaacaacagcaccttttactcttctgaactcaataacaatgtttctagtgaaatgggcaatagcgaaatccaaattcagaagcagtttggtgaaatacattaccctccttcgtcatcttcttcgccaccactttaccataatgctttgcaggacatggcttatggcgtttggggagggaataataataatcatggtgaatctgtgcttcattatggaaacaacgagttacgctttggtggtgctagtttatggacacataataatagtgcattgggtttcaagaagatcaataatgaacagttacatgacacgaatcatcctcatcagggtctatcattgtcactctcatcaaactcacaacaacaatcatccaagccgtgttttgaagaaaggtctgttgtgaaaccaccgtcctcccccatgaagctgaatgtgctttcaaacaacaacaacaacactgtttatcgaaatgttggtcctctcggtcctttcactggttatgccacgattttgaagagttcaaggttcttgaggccgtgccaacaactgttagatgagtggtgctgtcaatcgggttcaaaatttgcaaagagaggggtttgtgatgttccagagtgggtctctcgagatgtcagtgctgcttctacttctgctactgctcttaatgttgatgaaagtgctgctgcaaaaggtggtggcaattcgggtgcttcatcctctatgttgtatagttcaatcgaaaacaataataataataatagtaataataataataatagcgctgatggcggagccgcgagtagcttttgtctttcttctcggccagagtgccaaaagaacaaggcaaaactactgtacatgcaagaggagcataaggaaaaaaggccaaatgctttaaaacttctgcgggcaacaagaagtcatttttggtgtcggttaatgtggatgcaaagctcttga

SEQ ID NO: 38233 - DNA, 114 bp, Glycine max
  Peptide Sequence Number=SeqID_129918
atggatggcttcaagaagattgagggtgaggtttccaatgttggggccaattttgaggactgtgttggtaggggagcggtggttgcgtgggaacgattttttgtttggggatga

SEQ ID NO: 38234 - DNA, 3874 bp, Glycine max
  Peptide Sequence Number=SeqID_129919
tgccgccgctcgatctcggggtcttaagtttgcgatgcagccaaatttgtttccctttggaagcgtgctggggaatcctttcattttcaatggcgacggcgatttgagcgagggaggaggagggatcgagagctctagggttttcttcttgctcccgttcttcttgctctcccagggcggagcaatggatttgtccaaggtcggcgaaaaaatcttgagctccgttaggtccgccagatctctcggattgctccctcccgtttctgatcgccccgagataactccgtacgattggattgttgaaatgtattgtgtgtttgttgttaagttaggaagaagcagtaactgtgctgcttttaatgcgtttgatgcgagttttgggtttgatgatgtatgtaccgttgctatgcgcctgccacctcgttgcgatttagttgctatccttgacattgcgggtgatgcggtcgcaattgtggtcatggtgagtgaaaaaacccttgactttgcagttgcaattgcggttgctgacatttttttacaaccatggggactactgaataatttgttcaatccaccagtgaacctattagtgaatgttccctgtggttatcctgctgttcatgttccagctcgagctgctgctgcagctgctgtagctcgtgctcttgcagggttacctcctcatcagagatacagtctttcttcaagttcagaagaactaagttcaatatatggaagcatacctcaaggccaagtagtggaggagctggaggatgaattctatgaagaggtgctacttgctgtatcactccagtttcaatttcgcactgatttatcttgcagcctcctttgtgtattagacagaaactattttcatatggaggactttgatccaattaggcatgttttagagcacgttccagttgaagaaaatgagctgacatattttgaaaaacagccagctgcaggaactgcttatttaagcaatggttgcaaaccattaaatgagctcatgttggcgagccctggtgcagcggtaaagttgtgccttggtgacttgttggtcatgggttcgaatccggaaacagcctctttgcatatgcaaggcgaagagcctctgggcaatggggctgcccttagattggcacaactggatagagtagctgagcgtttatctcgccatgttatggagcatcatgaagtaatggtagctgatacttacttttgcccagtgaaggggatgaatttggtcagagaattggaaaaagacttaagaattgcaaatgtcatctgtatgaatggaagaagacacttgacatcatctatgaatgaggtttcaagggatctgattgtgaattcttattctaaaaagaaacaagctcttctggacatgcttccaaccttgactgaacttcgacgtgctttggacatgcaatcaacacttgaatcccttgtagaagaagggaattactggaaggcatttcaagtcctatctgagtatttgcaactcttggatagtttgtcagagctttcagcaatacaagaaatgagtcgtggtgtggaggtaattgatgcatatgcattaataggggatactgccggtcttgctgaaaagatacagagtttcttcatgcaagaagttatatcagaaacacactctgtattaaaggctattgtgcatgagtggggacaaccctcactctatgagctagcttttggaattgagttaggtccaaatcattcaaagatgtgtattgagaaaaattcaagttccacatcaactagagatagtgtcaagatagagtatacaagtgagggtcaaccctcaccctatgagctagcttttggggttgagttaggtccaaaccaacattctaagactcaacaagactcagcagcacaaacttcaaataagtgcaatgaagaaatttcttgtagtccaggtgagcctcaggaagttgattcagatgtaagagcctgcaacaattctatgtccagttccggagatgtaatacatggctcatcttctagggaggaatctgcaacagtgagctcactgactgaaactagtggttcaccatatagtgattctcatgatacaattaaggaggctggaaaggaggacagtgcaacatcaagcattgagtccccttggtaccatcttcgcaaagaagctacaacatttgtttcacagacccttcaaagaggacgcaggaatctgtggcatctcactgcaagtcgtgtgtcagtattgctttcttctgctacagcctatactgctagcattcatcaattcttgaaaaattatgaagatctcagcatctttattttgactggggaagccttttgtggaattgaagcagttgaatttaggcagaagttaaagtcatataatgttgatcgtgatttcttatgtagttcttttgagtctggtacgtgcaaaatgcaatgtcatttctatcctcctatgtctgcacggtgtctccaagatgatgatggtgctctaaaaatggttttggagaaagagacttggctaaaattacctccagatacagtacaaatgatcagttttgcaggtcttattggtgatggagcaccgttgatttctttatccagtggtaaatcaactaatgtcagtgcagtccattccactaaatcggtcaatgtggttcacactggtgcaaggaagaatgggttttctcactggattaaaagtggaaaccctttccagcaaaaattaccaacctccaatgaaggtcgtggttactcacaacctaatggatcagtttgtggtgaatttgacggaagttcaaccaataattttcatgatgataaaacacccagaaagaatgatttcaatcaaatgaatggtgccaattctgtttcagaagatgaaaatgaggatcttcttgctgactttattgatgaagacagtcaactaccaagtcgaagttctcaaccccatcattcaagaactctctcttcacatggaaatgacgaagagaatacaactcaaactggatcttctctttgtcttttaaagtctatggataaatatgcaaggcttatgcagaaattggaagtggtaaatgttgagttcttcaaggtatgggacttgtgtctcacattggaaggatgggattttagtgttcactcaggactagtcttaggagttaggactactgcacagccagtccatgtgggtgctggggcaccggatgagcatggtgggatgttaggatccaattgcaaggaatgggacttgagtttcaaattggaagtatgggaatctagtgtgggatttgaggaaagatgtgtggctgttgacactatatctcttgttgctcgaatactgaatagatctaaagctcatctccaatcaatgctcttgcaaagtaattcaactatactcgaggatttctatgttcatctggttcaagacctattattggattatgggcttgaaattgtggctgaaactcttgttgaaggactttcacgggtgaagagatgtagtgatgaaggacgagcccttatgtcattagatctgcaggttttgatcaatgggttacagcattttgtggcgctgaatgtgaagcccaagctacaaatggttgaaactttcatcaaggcttactaccttcccgagacagaatatgtgcactgggcacgagcacacccggaatacagtaaaagccagattgttggactggtcaaccttgttgccactatgaaaggttggaagaggaaaaccagggctccgtgtaaaggtagtgtatattgcttggcgtttgatcctctattaattatggagtattttccaaatctgtgtgcgttggttactgatcgctaccccctcttcttgacttcttga

SEQ ID NO: 38235 - DNA, 1320 bp, Glycine max
  Peptide Sequence Number=SeqID_129920
atggttccgttcccgtcagagaacggcgttgaaggagacgacgagagagaagaggaagacgaagaggaagaagaagaagaggaagacgaagaagtggtggaagatgaagaagacgaagaggaaccgaggctcaagtaccagagaatgggaggtagcatcccttcgctgcttgcgagtgacgcggcgtcgtgtatcgccgtcgcggagcgcatgatcgctctcggcactcacggcggcaccgttcacatcctcgattttctcgggaatcagatgtatgctagggattgtggatatcttttggtttatgttgacactgttaaggaattctctgcacatgcttctgttgtcaatgaccttagctttgacacagaaggtgaatatattggaagctgttctgatgatggatcagttgtgataaacagtcttttcactgatgagaaattgaagtttgagtaccatcggccgatgaaggcagttgcgttggatccagattatgcaaggaaaatgtctaggagatttgttgctggtggtttggctggtcatttatatttaaattcaaagaaatggttaggataccgtgatcagtatcttttgtttgttaacgataaaattaccccgccctaccctccccaaaaggttttgcactctggtgaaggttcaatacatgctgtgaaatggagagcaagtcttgttgcttgggttaatgatgcaggagtgaaggtttatgatactgccaatgaccagcgtattacatttattgaaaaaccacgggggagcccacgccctgagcttttgcttcctcacctggtttggcaggatgacagcctcttagttattggctggggaaaatctgtcaaaattgcttcaattaggacaaatcaccaaaaagcagccaatgggtcattcaggcaagttcctttgactggtatgacccaggtggatattgtggcatctttccaaaccagctatttcatttcaggacttgctccctttggtgatgctttggttgttctagcatatattcctggagaagaagatggagataaggattttagtagcaccgctcctttacggcagggcaatgcacaaagaccagaagtaagaatagtaacatggaataatgatgagctttctacagatgctcttccagtacatgggtttgagcattacagggcgaaggactattctcttgctcatgctcccttctcagtatttaggagattgagggcgagccctggtgcagcggtaaagttgtgccttggtgacttgttggtcatgggttcgaatccggaaacagcctctttgcatatgcaagggtaa

SEQ ID NO: 38236 - DNA, 1683 bp, Glycine max
  Peptide Sequence Number=SeqID_129921
atggaagaatgtactaatgcagactgcagtgacgtgatttgggtgatcattgttgtccaggatactgaagatcatattgcatggcttcttcagcacgggtggcatgaaaaagctttggctgtggttgaatctggccagggacggagtgaactacttgatgaggtgggatctaggtaccttgatcatttgattgtggaaagaaaatacagggaagcagcatctttgtgtcccaagttgcttcgaggatcagcttcagcatgggagagatgggttttccactttgcacatcttcgtcagctccctgttttagttccttacatgcctacagaaaaccccagactacgtgatactgcttacgaggttgctcttgttgcattggctacaaatccttcttttcataaggatctcttgtccactgtaaaatcctggccatctgtaatttattctgctttacctgtaatttcagccattgaacctcagctaaatacttcatccatgactgattcacttaaggaggcattagcagagttgtatgtaatcgatgggcaatttgagaaagccttcttgttgtatgctgatcttttgaagccagaagtatttgattttattgataaacataacctacacgatgctattcgtggaaaggttgtccaactaatgaggctagattgcaagcgcgctgttcctttgttaatccagaatagggacttaataagtccacctgaagttgtgaatcaacttctaaatgcagatgataagagtgattgtagatattttttacatttatatctccactcattatttgaagtaaatcctcatgctgggaaagacttccatgatatgcaggtagaactctatgcggactatgatccaaagatgctgctaccttttctccgtagcagtcaacactacacccttgagaaggcttacgaaatttgcattaaaagagacctattgagggagcaagtcttcatcctaggaaggatgggaaactcgaaacaagccctagctgttattataaacaaattgggggatatagaggaggccgtagagtttgtcaccatgcagcatgatgatgaactttgggaagaattaatcaagcaatgccttcacaaacctgaaatgcacacagttggaaatcttgatcccctttacattgtaaataaggttcctaatgggttggaaatccctcggctccgggatcggctggttaagattatcaccgactacaggactgaaacatcgctcagacatggatgcaatgatatcattaagtattacaaagaggcaaggcatgggatttctttaggtaatgaagatgagccgcgggttaaaatgagtgatactcgtgcttctcaggtatttgacaaatctccaagtctgagaactgtggagttgaagtcaaagactaggggaggtggaagatgttgtatatgtttcgatccattttctatacagaatgtatcggtcattgttttcttttgctgtcatggttatcacacaacttgtctcatggattcgtcttacactagtagtaaccagaaagaggtccaagccacgtccctagaggcggaaacgtatgatggttacaatggttatgaggaagatgctagtgaggatgatgaagaagccaagtctggtggtcctcgtatgcgttgtatattgtgtactactgctggctag

SEQ ID NO: 38237 - DNA, 1875 bp, Glycine max
  Peptide Sequence Number=SeqID_129922
atggtttcaatttcgaagttgaagaagttctacttggtggagccattgaagtcatcttcccttggttttcattcttttgaagaaaccaagaagtgtgagagcattgttataaatgaagtggaaggaaagaggcaaaagaagcatagaaagaagcagtgtaaggattggaggtgcattgattattgcttttggatgatagggtacatgtgcaccacttggtggcttctctctttgttgtatggttgcttgcctgccatgttgcttggctttgaggcaccagtgtcacctggggtgaggctaagtcgtgagggagtcactgcacttcacccagttgttcttgtaccgggcattgtgactggtgggttggagctatgggaagggaggtcttgtgcagagggccttttcagaaagcggttgtggggtgatagttttgctcaaatcctcaaaaggcctttgtgctggttagagcatctctctttgcatgatgagactggtctggaccctccaggcattagagtcagggcagtgcctgggcttgttgctgcagataattttgcttctggttatcttctttgggcagatttgattgaaaatttggcaagaattggttatgaagggaagaatttgtttatggctgcctatgactggagactgtctttccagaatactgagattcgagaccaagcacttagtagattgaagagtcatattgagcttatgtttgtaaccaatggctataagaaagtggtggtggtaccacaatctatgggggctatttattttctccatttcctaaaatgggttgagacacctcctcccatgggaggcggcagcggtccgggttggtgtgacaagtacatcaaagcaatcatgaatgttagccctgcatttcttggtgatcctagggctgttagcaatatattttcaaccgaaagcagtgttggatttgtcagaactgtggcttctggcattttaaattttgattacgttggtcgtcaaactcttgagcacgccatgcgagtgtgtagaacgtgggattcaatcatctcattgatgccaaaaggtggtgaaaccatctggggtggcttggattggtgtcttgaagactggaataactatgatcaggaaatttcatggggaagtaattctgctacttttaacttatcatatgaggctgtgtggattgattgtgatgagatgagcagagaaagcattcaaaaaatttctaaaaaaagagcttatactgcaagaacagtttttgatatacttaactttgtggctccaaaaatgatgaagcgtgctgaggctcacttctctcacgggatagcagagaacttagaagatcctaaatatgctcattacagatactggtctaatccacttgaaaccaaactaccagatgctccggatatggaaatatactgtctttatggagttggaattccgactgaaagatcacatgtacacaagttctacccttctgaaaaggacaagagtattcctttccaaattgatagttcagcagatggagaagatggaagttggctacacaatggtgtttattttgtggatggtgatgagagtgtacctattgtaagctcagggttcatgtgcgccaaaggatggcacggaagaacacggttcaatccatctggcacggctacatatacaatagagtatcagctaaaacaaccaggtggtcttattgatcggagaggcctagagaatggagcaagttccaacattatgggaaatgctgccttaattgaagatgttttactagtagctgctggagccactggagtagatattggaggtgataggatattttcagatataatgaggatgtctgagaggataaatctcagactatga

SEQ ID NO: 38238 - DNA, 1164 bp, Glycine max
  Peptide Sequence Number=SeqID_129923
atgaaaaccccacttcccggcgctagagaagcaattgagtcagccagagaaagatgcgtggcagaagaaggttgtgatcgaagtggtgctgccactttagtaaagaaggcacgcaatacaaaacctaagtggtcaccaaccacattaatacgtccaaatacaagttactactacgtccctttcagtattctttctaatttcttctttcttttccttttgttttctctatacatgttcttagttgagttcatttgtgtcctgttgtatacatttggtagtatggttgaaaagtaccttgccaaaccaactatactgtatgcatcagattcaaagcaaaaaacttatgtcagattattagttccccaaacttcttcagagtctactttctctattgtgtctttttgcatgaacaacaagaagctcattgctgaagaggaattgaaaagaatggggtattcaaggtctttcttggcttctttgcttcttgctgtgtttctcaatgtgactaatgggcagcctctagtccctgcaatgttcacatttggggactcaattgttgatgtgggcaataataaccaccaattgactattgttaaagcaaacttccctccttatggaagagactttgagaatcagtatcgcacaggaaggttctgcaatggaaagcttgcaacagacttcattgctgaaatcattggatttacctcttatcaaccagcctacctcaacttaaagaccaaaggaaagaaccttttgaatggtgccaacttgcctcagcttctgctgagtttatatgcattgggagcaaggaggattggtgtgacaacattacctccaataggctacctgcctggagccatcactctctttggagctcataccaacgaatgtgtgacaagtttaaacagtgatgcaattaacttcaatgaaaagatcaacaccacatctcagaacttgaaaaatatgcttccaggcctcaatttggttgtctttgatatctaccaacccctctatgacttggtcaccaagccttctgaaaatggattttttgaagcaaggaaggcttgttgtggaactgggttgatagagacattgtgcaataagaagtccataggaacatgtgatcatacttaccttaaaatcgtaatagtaaaatatggataa

SEQ ID NO: 38239 - DNA, 364 bp, Glycine max
  Peptide Sequence Number=SeqID_129924
atggagaaacagaaccatacgacagacactgatgagttttcgactctgggccccacatcgaacgagccacacactccaatggtgcatgtcaacgccgacaacaacaacaacaacgttgttagcgccgccgttaacgttggagttggttctgtttcggagcttgttgtggctgtagcaaagtccgaggctgtaggttcgggacagatggtgaagagagggagggggaggcctcggaagtacgacgctgtcgggagtgctgtgttgccggcgacgacgggaccgccgggattttctgatcagactgtcaagagaggtcggggacgcccccgtggttctgggaaactgcagattctagcttccattg

SEQ ID NO: 38240 - DNA, 465 bp, Glycine max
  Peptide Sequence Number=SeqID_129925
atgtcccactcccaccagcatccgcagccacaacaaagactcttattatctcaatgcctgaaccaacttcatgaacaccctgctgaaagctccttctcatcttctcaaacacattacaaaaccaaaatccccttatgtcttattcactccgaaacaacgtcaacccccacacactctttctttggccccaagattgtgtcatcatcccctcaccaacactactacttccatgaacctcacagcccctcttcattcccttgttgttttaatgtctcttcaaggcgttggagtgccttcaagcttggttgcacctccatggaccctcaagtagaactctcagcatcacttcactctccctctgagatcattaggaaaaggaaaattactgggcggcaaaagagagaggaacttgaaaaagaggtatatatattgatacgcactgcacaatttgatggcaaattctaa

SEQ ID NO: 38241 - DNA, 1851 bp, Glycine max
  Peptide Sequence Number=SeqID_129926
atgccaaattcgaagaacaaccgtaacggacagggcgagcctcaccgccgggggaagttaacgaaaaaatcatcgtccttctacggtcactcatcaccggctgccatgtccggcgatccaatcctgcgaccgaagacggtgccggatcttttgtcggagaggcatcgtgcggcagcgacgccgctggtggaagttgtgccaaaacagccgccgaagttgttgttgaaggttacttccatgggaagcttgggaccggtgcaggttgtgatgacgccggaatcgacggtcggagatttagtggcggcggcggtgcggcaatacgtgaaggaaggtcgccgaccaattttgccgtccaacgacccttcccacttcgaccttcattattctcagttcagcttagaaagtttggatagggaggagaagctgagggatattggatctagaaacttctttatgtgtccgaggaagtgtggcggcggcggcggcgacggtagaggaacgacgccgtttgcttcatgttcaagagaggccgacaaaacgaccaagggtggcgcgtttggttggttaagggtaggaaagggttcattacttggaatatattcaatttggaaggagttggagtaccttcacaacggttttgaagtgaaattggggaattggatgctggatttctggaatgatatctgggtgaatcgaacacctatagcattggaggtagcttggatcgacattcatgatgtagggattcaagtgaaggatatgtggtgtcagcatcaattttcatatgagttgaagggagtggatagagattttttgcttgctttagatgatcaaattgtgaactatgtgtattctcaaggtgttgaggttaaggttgggcagactgtgacggttgacccaatggatcctgtggattcatacatacacatttctcaggttgcgctcggagaggcgaaaaaggacaaacctaatgaacctgtggttctgtacttgaaagttggtgaacagaagattgttttgggaaccctttctagggatggcatccctcacctatcattggatttggttctggactccgattctgagctttcccacacttcaaaaagtgccaatagtagtgaagaggacgaggaacttgcattggagggacaagataatggaaaacctgaattaaaagctgaaggtgcgaaggttaccaaaccttctaaatctattcccaagattggtgcaccagcaaaagctgctgatcctaagaaagacgaggatgatgattccgatgatgaatcggatgatgatcttgctggtgaagatgaatctggaagttccgatgagatggatgatgatagcaatagtgaagaggagagtgatggagatgatgaagagacccctgctaagaaggtggatcagggcaagaagagacccaatgaatctgcagcaaaaactcctatttctgccaagaaagctaaaactgctactcctgaaaagactggttttgggttaaagtgtggtgctcattggtgtaaatcttcccgatgtttactcccctcgaataccccaacaactggtattagagtcgatggttcgactgtcttcctggcggcattactcccgctcgagggagagactatcatgtggaagagactcacacttgagggggagatggttggattacaaaaaagtgtacatgtagctactcctcatccttcgaaaaagggtgggaaaactcccaacagtacaaaaggccagactcccaattctgctggacaactatcttgtgcaagttgtaaaaagtctttcaccaacgaagctggtctgcaacaacataagaaggctaagcatggtggtcagtga

SEQ ID NO: 38242 - DNA, 129 bp, Glycine max
  Peptide Sequence Number=SeqID_129927
atggtgcaaactgcaaagactcgaatgaagaaagcgacggctacttttggaggtgtagtctatctctctaacaacaacgtagcccaacccagaaccaaaggtaagggatcctccactcgatctacatag

SEQ ID NO: 38243 - DNA, 456 bp, Glycine max
  Peptide Sequence Number=SeqID_129928
atggtagcgacaacgatttctgctctggcagcaattccaacgacaacattgaacgatgcacaattcgagaatgcctatccgtacattggtgatcttgaaggtaatgttaacgaggcacaattgcttgaactgtttggccaagtggtttcaattagggtttgcaaggatcaactagacgatcctctcttggattttggaacaataacatgttgcaaggtggtgcttgaatcaaatgggcatagcaagggctatggttttgttgccttttctcctgttgaggatgcaaccccaggtacaattacacctttgcctgttggaatccctggatatcatccagggacaccaagacttgcccctccttggttgtattttggtcaaggggcacctggtctcgtaccacctcagccagcaggatatggttttccagcagcacctcttccaagacatgcgtcctag

SEQ ID NO: 38244 - DNA, 1782 bp, Glycine max
  Peptide Sequence Number=SeqID_129929
atgtctcaccaagtcgaatcttccgactcgaaatcttggaagaaagactcttccacttcgattcttgaacggaagaaatcgccgaaccggttagtcgttgacgaagcagttaacgatgacaattcggtggtcgccatgcaccctcaaaccttgaaaaaactccaacttttccgcggagacactatcctcgtcaaggggaagaaacggaaggacacggtttgcattgctcttcgggacgagaattgtgaagaatcgaagataagattgaacaaagttttgaggtcgaatttgagggttcgtctcggagatgctgtgtctgtgcattcgtgccctgatgttaagtatgggaaacgcgttcacattcttcccattgatgataccattgaaggtgtcactggcaatctctttgatgcttacttgaaacttgttgttatgagaagctattattgtctactatgggtgtggttgggtaaaaagcgtgatttagtgcttgtcatcatatttcttgtccaaggagggatgagaagtgtagagttcaaggtcattgaaattgatcctggggagtattgtgtggttgctcgagacactgaaatattctgtgagagggaacctgtgaaaagagaggatgaagaaaggctggatgaggttggctatgatgatgtgggctgtgtcaggaagcaaatggcacagattcgtgagttggtagagcttccactaagacacccacaactttttaaatcaattggtgtgaaaccacccaaaggaattttgctgtatggacccccaggctctggtaagacattgaaagctagagctgtttctaatgaaactggagcgttcttcttttgtattaatggcccagagattatgtccaaactggctggagagagtaaagtaatctcaggaaagcatttgaagaagctgaaacgggagaagacacatggtgaagtcgaaaggagaattgttttacaacttttgactcttatggacggatttaaatctcgtgctcatgttattgttattggagctacaaataggccaaatagtagccccgctttgagaaggtttggtagatttgatagggaaattgatattggtgttcctgatgaagttggaagacttgaagtccttcgtatacataccaaaaacatgaagttttcagatgatgttgatatagagagaattgcaaaagatactcatggatatgttggtgctgaccttgctgccatttgcactgaagctgctctgcaatgcatcagggagaaaatggatgttattgatttggaagatgagaacattgatgctgaagtgctgaattctatgacagtttcaaatgagcatttccataccgctctaggaacaagcaatccatctgctttacgagaaactgttgttgaggtgcctaatgtcagctgggaggatattggaggcctcgagaatgtcaagcgcgagctgcaagagactgttcaatatcctgtggagcacccagaaaaatttgggaagtttggtatgtcaccatcaaaaggagttctcttctatggtcctccaggatgtgggaaaacgttgttagcaaaagcaatcgctaatgaatgtcaagctaacttcatcagtgtgaagggcccagaattgctcactatgtggtttggtgaaagtgaagccaatgttcgagaaatttttgacaaggccagacaatcagctccatgtgtcctcttctttgatgagcttgattccattgctactcagagaggaagtagtgttggagatgctgggggttgctgctga

SEQ ID NO: 38245 - DNA, 891 bp, Glycine max
  Peptide Sequence Number=SeqID_129930
atgggcgcgaagaagaagaatggcaacaacaaggagaacgaagacaacaccaccaccaccgtcgtcttgaaggtccaaatgcattgcgacggttgcgcttccaaaatcatcaagcacctccgcgctttccaaggtgtggagacggtgaaggcggagagcgacgccgggaaggtgaccgtgaccgggaaagtggaccccacgaaagtgagggacaacctggcggagaagataaggaagaaggtggaactggtgtctccacagcccaagaaggagaaagagaacgagaaagaccccaaacccaacaacaaatccgagaacaaaacccaggacaaaaaaaccaaggacaaagaggtggtgactacagcggttctgaaagtggcactgcattgccagggttgcctagacaggattggcaaaactgtgttgaaaaccaaaggagtgcaagaaatggccattgacaaggagaaggaaatggtgactgtgaaggggacaatggatgtgaaggctctggcagagaatctcatggagaagcttaagaggaaggttgaggtggttcctccccagaaagataaggaaggtgacaacaaggaaggtggtggtggtgagaaaggatcaggcaagaagaagaacaagggtggtggaggagataagaatgagaatattgaagatggaatagagaaaatagagcataacagaatggagtatttggcaccacctgcttttggctttggttatggaccttatggtggttatgggcatggacatgggcatggcaacatcggtgggtatagctgtgtgccagtgtacccggagcagatgcactttcacttgcatgcaccggcaccacaaatgttcagtgatgagaacccgaatgcttgttctgtcatgtga

SEQ ID NO: 38246 - DNA, 1233 bp, Glycine max
  Peptide Sequence Number=SeqID_129931
ggtacatctacttgggttgttgtaactaagaacaagaaagggtacatctcttgtggatcagttcaagtggagggtacatccacttggttattcaaagagaacaagggagggtacatcccttgtggatctttgcttgtaaaggtttttacaaggttgaaaagaaatctcaaggactgcaggccacttgatccaacacactatgatgatggagacaaccatagggttgtcttggttgacgggattcatgcccttgaagtccttatccgtaaacaccttaagtctctagaaggttttctagtacaagatgtcagcggaattgttctggaaggtctcaactctcttcgacgccatgaagttcactacgacgatggagacaaccataggattgtcttggttgacgggactcatgcccttgaattccttatccataaacgtcataggcggaagacttcgttgaaggggtgcatcgaaaaaattaatgtcgatgtcccggatggaaaagccgccagtgatggtgttgattacacctctaatgtgttgggcgggttcttgttgcggtggagtctcgctcctgcttgggggttgcctggtctcttaacaaattgggctaagtacccagcttatgggtaccttcatgttgaatgcttcctcgagaatcatggtgcgattggttgttatgggtgtgtaacgctcgtacctggaccctttggagagaagctggcacttgtctggcttgtgcctcttgttcgacttgtgtgtctcaagcttggtgtgtactttgcgcttgttgtgcttctatccggcttgattgtctacaaacttgcagggtgtaaggcgaggagcatggaatgcaacgctacctcgaaattgagattttggatttggatggttgtccacccaaatctttccatgaactttctaagggacttgtcatttgcttgtcatagactggctaaggcggccaagtcagtgacggaggtctcacgtctgaggccacatcgagtgctaaccacggacgaatgtgagaggattgacatgaggccgtggggtatgttttaccgtagtcccacggtgggcgccaaatgttcttaccaaaatccgaaactgtcacatgttagggtggacgtggttgagtggggtcctgaacttcacacgtcgactaggataggtgcctttgacaggagggaggaccctcaaaacaaaggacttcaacgctcaaataagaatatgtga

SEQ ID NO: 38247 - DNA, 535 bp, Glycine max
  Peptide Sequence Number=SeqID_129932
atgagtcatcattcatctagtgttaatggtgagggtactagtcataaagaccctttatctagaatcttggatgagttgagttccctcaagttatggaaagaaaaacaagagagaaaagaaaaaggaaaaaaaagagtggaagaaataagtcaagatgaaagaaagaaaataagagatgaagacagaagaaaaataatgaaagaaatgaaaagagaaaaacatgcctcctatagtagtcataactcttgcaagagcctaagtgaagaacttcgtgactattacgaaggaatgcataggtcacatcttagacctcactcccatagaagagaaaaggaaagaaagcctcaagaggccaacattaacctctcatacttccatgggaaggacaatgtagaggctaacttagttttggaaataagggtagagcaacaacttaagaagaagtctacgtcaaaatcttatggctctcactcttatccaaagacataccaaggttacggcatcttacgggtgacaccttctaagcccaaagatg

SEQ ID NO: 38248 - DNA, 345 bp, Glycine max
  Peptide Sequence Number=SeqID_129933
atgaaaagagaaaaacatgtctcctatagtagtcatgactcttgcaagagtttaagtgaagaactcagcgactattatagagggcgccatagttcacattctaaacatcattcccaaagaaaagaagaggatagaaggcctcaagaggttaacattagcctcctatattttcatggaaaagataatgtcaaggcctacttagattgggaaacaaaggttgaacaaatctttgctttccatcatattagcgaagagagaaaagttccattggctacccagggtatgccctctattggtggacttcccttgttagggaacaaaggattcatggggatcctccagtag

SEQ ID NO: 38249 - DNA, 306 bp, Glycine max
  Peptide Sequence Number=SeqID_129934
atggccacaatgatgaaggccatgatgagcatgaagaagataatggaagccaatgcggttgcagttaccgctaccagcgttgttgctaagctgaacccgacgcccccatctggcctcaaccaaatgaatcatccaacctcagatatggtaggcaaagatttaggaagtacgagcggcctccattatgtgcaatttcaaaacaagcacgccttcccgccaaatggcttgccttccaactatacaccacccaatgtggcgtacactcttggtgaggatgtcaataactccatctcccatactcattga

SEQ ID NO: 38250 - DNA, 210 bp, Glycine max
  Peptide Sequence Number=SeqID_129935
atgttcagcccctttggcacttctctctctttcgaatttgcttggaaaaatcgtttccgtgaagaaaatctaagccgaggcgcttccgaaacgctttccgtaagcgattctgtggaaattcttcatcgctcttcaccgttcttcatccgttcttcgttcgttcttcgttcttcaacggttttcttttcttccgtttttaacgtgctttaa

SEQ ID NO: 38251 - DNA, 210 bp, Glycine max
  Peptide Sequence Number=SeqID_129936
atggcaatagggactatcagcaataatgcatcaccaaaagaggaaaactctatacgaggcttcactattgtcaaacctgggtatagggcccaatatctcaaaatgtgttcaaaaagtgtgggtgtcatgtgtgaacgaagcaacctaagaattacccaaccccacctgcaaaacaaccagaaaattcccaggcagatacaagaactataa

SEQ ID NO: 38252 - DNA, 316 bp, Glycine max
  Peptide Sequence Number=SeqID_129937
atggccccgaggaagcttgcctcaaagaggtccaggaaggataaggcggccgaaggaactagttccgctcctgagtatgacagtcaccgctttaggagcgctgtacaccagcagcgcttcgaggccatcaagggagagcgacgcatccagctcagggatgacgagtatactaatttccaggaggagacagggcgccggcggtggacatcactggttacccccatggccaagttcgatccagaaatagtcctcgaattttatgccaatgcttggccaacagaggagggcgtgcgtgacatgaggtcctgggtgaggg

SEQ ID NO: 38253 - DNA, 264 bp, Glycine max
  Peptide Sequence Number=SeqID_129938
atgttgacatctccggaaagggtgcagatgcccacgttggtctctacttgtcaatcggacttggggtctccgaatgatgaggtgcagataaccggaaggtgtctccgcatgctaccagactcttgggtcatgatagcaaaaggtggggtggtcgacaaaagcggagcttttgctcctacgtatcctcaacttgtgatgagcaactcagacctacgtagttctttcaaaagtgaaactaaaatagtctcggtgttccttcactaa

SEQ ID NO: 38254 - DNA, 231 bp, Glycine max
  Peptide Sequence Number=SeqID_129939
atgcaagcacaagtacttgcactacctccggagcctaaggttggtccttcagctgctcctgtcagcacaaaggagagttgtgttgatccctcagggaatgatccaaacacgggtgactcagacaaatgcgggttgtacatcgaagaaaatcctccccacctggttgccctaggaaaagtttatgagggaccgacaaccgttcacaacatccctttgtgcaagatcaagtga

SEQ ID NO: 38255 - DNA, 573 bp, Glycine max
  Peptide Sequence Number=SeqID_129940
atggaggttgatgaaccttggctagggttatggctaccattgaattatcaagtagatatgggatcaagtttagcatatgacaacggaatttgggggatggcctttgtggataactgggtggtgggtaaggaggaggtttgttattggctgagtaatgacattgttgggttggtgggaaacttggccacccacatcgatcctttcactggcgaagaccaaatctgcaaagctttgaggcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 38256 - DNA, 708 bp, Glycine max
  Peptide Sequence Number=SeqID_129941
atgtcctcgccttcagaggactacacgtcctcaccttcagagggctacacgcctttgccttcagaggactacacctcctcccctttagaggactacacgtcctcgccattagagggctacacgtcctcgccttcagagggctacataggacaacacgtcctcccctatagaggactacacgtcctccccttcagagagctacacgccctcgcctttagaggactacatgtcgtcgccatcagaggacaacacctcctcgccttcagagagctacacatcctcaccttcagaggactacacgtcctccccttaagagggctacacgccctcgcctccgttgggctacccgccgtcaccatcaaaggactacacgtcccacattccaagggctacacgccctcgcctttagaggactacacgtcctcgccttcagagggctacacgtcctcgtcttcagagggctacacaccctcaccatcagaggactacacgtcctcgccttcagaggattacacatcctccccttcagaggactacaagtcctcaagttcagagggctacacacgctcgccttcacaagactacacgtcctcgccttcagaggactacatgtcctcaccttcaaagggctacactgttagacaagtggccaaagatatcttaagaaggggggttgaattaagatattccaaactacttccccaataa

SEQ ID NO: 38257 - DNA, 246 bp, Glycine max
  Peptide Sequence Number=SeqID_129942
atgggggtgcaaatagcaaccaggccacttgggccttccagattgttcctccataaggcggttgcttctggaggaagcaacctggctcgcatgggcgagcagagctcgcctgggcgagctggaaaatccaagccgaggcgctaccgtaacgtttccgtgggttatttcgctaagattttcaaccgttcttcgccgttcgtcgttcgttcttcgtcgttctttgatcttcaacctgtaagttcctga

SEQ ID NO: 38258 - DNA, 354 bp, Glycine max
  Peptide Sequence Number=SeqID_129943
atggtagccataatcccaaccaaggttcatcaacctccatttctccgagaatacgactcgaacgcaacgtgtgcttgtcatggagaagccccggggcattccattgagcattgtaggggcttgaagcgtaaggtgcaaggtctaattgatgcgggctggctgaaatttgaggagaatcgcgtgattttcaactttcaccggaattgggtgcaagccattggtctatttgctcaagcgatctgtgctcctgagtttggacttccaagatcgttcaatcagagattactcgtcttgcacgttggtggggctgccataaaacaacaagtaaagttcaaaacaaataagtttcaataa

SEQ ID NO: 38259 - DNA, 234 bp, Glycine max
  Peptide Sequence Number=SeqID_129944
atggccggacgtggtagggatcagaaccgtgatgtcctagaccgcatcacagctgtactggaaactctagtgcaggaacgtgatgtggagccggcagagtatcggggactcatggctttccgtaagaaccaccagccgaagttcaatggggactatgatccggaaggtgctaggttgtggttagctgagactgagaagattttcgaggcgatgggttgtctcgaggagcataag

SEQ ID NO: 38260 - DNA, 471 bp, Glycine max
  Peptide Sequence Number=SeqID_129945
atgaggtcctgggtgaggggtcagtggatcccgtttgatgcagatgctatcggccagctcctgggatatccgttagtgctggaagagggccaggagtgcgagtatggccagaggaggaaccggtctgatgggttcgatgaggaggccatcgctcagttgctatgtataccggggcaagattttgcccggactgctgccgggagacgggtgcggatcatgcgcaccaacatgaccaccctgactcagatatggatgactttgctgctcagcaacatcctgcccaccgatcataattccgacctccccctgccgaagtgtcagctggtgtcgcaacctacccttcggcgggagggcgacgcgagactcacgggatgcgtgttccacgaaaggaatacgcgcggagttgccaccaacgtttatttgaggaaaacgtcggaaaaaccggaaaagacgcgatctacgaacttttaa

SEQ ID NO: 38261 - DNA, 297 bp, Glycine max
  Peptide Sequence Number=SeqID_129946
atgagttctggatgttttctagtagagacttccagtaaaattttcgagtcgatccaacggctcacgaattggaacgaaggaaatgttactagggtctttaaagttttctgcctttgccctgttttcttggctgtgcttgggaggattgatggggacccggtgttgggagaaacgaggatatgggctacgtgggagtacgtgagctcagttggaggtgggcaacaggggatggtggatttatgcgcgatttgtggatgtggaaaacttgttgtgcaccatcgcccgaccgccacctag

SEQ ID NO: 38262 - DNA, 423 bp, Glycine max
  Peptide Sequence Number=SeqID_129947
gcattgcgattaaatgctccattaccatatccacacttagtcactctcttccttcaacactttaacatccctcttgattctgaaccttatgttccaatcaagagatccttcttaattggtgtcgctgtgattgcatcctttggttaccgaaaagagcatgatggctcttgggtgaaaaagggtgctcaacccaatgatggagaaggacatttacaaggtggagaagattcctctcttcttcaaaagattttggacaggttcgatggtcttcaaacctttgttggtgaaaggtttgatgctttggagttacaagtggacatgagatttgatgagatggattcaaggattaccaaggtcgaagaagatgtctcttacattcgcacaagctttgatctaccaccaccgccgccaccatcatcttag

SEQ ID NO: 38263 - DNA, 291 bp, Glycine max
  Peptide Sequence Number=SeqID_129948
atgggtagcctggctagaactcagcctcctcctcactgcgacgacgaggatcccgccgctcaggaagccgcatccactcttgaaaagtctcctgaggccactctagagcctccggcaccaatggcagataccacttctccagaacaggcagcatatccttcaatgcctaaagatcaaactacaccagcccagtctccgaacgcctctcttgtatctactcatgtactgcatttgactgacgaagaggagtttcagacacaagacacccaggaccaatcacaggacttttaa

SEQ ID NO: 38264 - DNA, 1085 bp, Glycine max
  Peptide Sequence Number=SeqID_129949
atggctgagaagacaaagaaaaagctagaggaagttgctcagtccagaagcactgagggtgtcattgaccctccatctctcatcagacgacatgtgaagtggaagatggcccgcaccaagaaaactgggcagatgacgtctgaggccgcaaaggaaatcactaagaagattgtgtcacaggattcgtttgtcccccatggacgtcaggatgtcctgactattggcattgggcgaccagaacactctggtcgtgtgcatgctgttggagacggtgtcaccatcaagcaatacttcggatcaactccacaaagctctcgcagttcctcctgcatccctcccgaagaactcgagcaactcactcaacaaatcaaggaccagctggagaagtcgatcacagaaaaaggacttgcattacctccggagcttgaggtcggtccttcaactgctcgagttagcacaaagaggagttgtgttgatccctcaccgaccgatccagagatgggtgactcagacaaatacgggctatacatcgaagcaaatccttctcgcctggttgccctagaaagagtttttgagggatccacagttgtttacaacgtccctttgttgcatggtcaagtgaagacacttaacacctttgttgcttggccaacacatctcgtgaagcgtgcagctatgtctccaataaagcctccagataggttggatcctgaggtcgatgatcccctgtatctgatgacattgaccatcccacgacttttcttgaagcctttccaggttatgtgggatgctaccatgcatgtgactgagacaagtatgcaagcggggaattccgatgtgtatggattcctcgagccacagtccattccgagatctgggcaatcgcagtttgaatcggaaagttacatgaagatagagttggatgcagaacactggcagatggttgtcattctgcctaaggaaaaccttgttgtctggttatgttccttgcataacaagtcagacaactaccttaagggaataattaatagtgctttgaaaggacttgatgatactccacaacctaaatccaaggctggtgctag

SEQ ID NO: 38265 - DNA, 804 bp, Glycine max
  Peptide Sequence Number=SeqID_129950
atggggctccgaaaaaggggtagagattggagaattgcactaagcaatcactacgcatggctccaaacccgtgggtggaggatgaacgaaaacgcaattcatggggcaccgaaacagggtagagaatggagaattgcactaagcaatcactacgcatggctccaaaaaatgggtggaggatgcaagaacaaaaacgtaattcatggggctccaaaaaagggtagagaatggagaattgcactaagcaatcactacgcatggctccaactcgtgggtggaggattcatgaatgaaaatgcatttcatggggctacgaaaaagggtagagaatggagaattgcactaagcaatcactacgcatggctccaaactcgtgggtgcaggatgcatgaacgaaaacgcaactcatggggctccgaaaaaaggggtagagaatggagaattgcaataaggaatcactgcgtatggctccaaactcgtgggtggaggatgcatgaacgaaaacgcaattcagtgggatcctctagagtcgacctgcaggcatgcaagcttggcactggccgtcgtttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 38266 - DNA, 535 bp, Glycine max
  Peptide Sequence Number=SeqID_129951
aggttcaacattcaatttcgagggtctcgatatattatgggactcaatcagacatccgagtaaaaagttattgtcgtttgaattggctcagaggttcaacattcaatttcgagcgtctcgatattacgggactcaatcagacatccgagtaaaaagttattgtcgtttgaattggctcagaggttcaacattcaatttcgagcgtctcgatatattacaggactcaatcagacatccgagtgaaaagctattgtcgtttgaatttgctcagagattcaacattcaatttcgagcgtctcgatatattatcgggactcaatcagacatccgagtaaaaagttattgtcgtttgaattggctcagaggttcaacattcaatttcgaggttctcgatatattacgggactcaatcagacatccgagtaaaaagttattgtcgtttgaattggctcagaggttcaacattcaatttcgagcgtctcgatatattacgggactcaataagacatctgagaaaaaagttattgtcgtttga

SEQ ID NO: 38267 - DNA, 198 bp, Glycine max
  Peptide Sequence Number=SeqID_129952
atgacattaggtgctgaattcaatgtggaaagcttaacatatagagattggaacacatcatcgaaagtatcccaaaaggaatgtgttcggttctgtgcaagaaagaaaaggactacctatataagcatgaagtttagccgcttcaagaagctgggacttggctttgatatgcttatgaaggatagggacacaggctag

SEQ ID NO: 38268 - DNA, 270 bp, Glycine max
  Peptide Sequence Number=SeqID_129953
atgtcgcctccacaagccttttacagagatcatcttggtgcatcatacttcatttggattacaaagctaccatggcccgtcatgataaaaacgtcaccctcacaagggacgaaggtcagtgggcgcaaacacgcaaccgctgcgggtcacaccactcaatcccgtgatattggttaccttggtcgacaacgagctgatgtcggtggctttttctttcctttcgtccggaggtgtgtacctccacgggactgcgtggctgttttggtatag

SEQ ID NO: 38269 - DNA, 540 bp, Glycine max
  Peptide Sequence Number=SeqID_129954
atgaggggcatcgtgcatgagcctcaagtgaacataggggcagatcaaaagttctcacctgtcgatgtttttaaaagaaaaggggggacaaaccctaggattttcaatggattgatcaaacatcaaacgactccattgccgtcactccaaaatggtcaagtgactaaatcaaacagaacacacactctgagggagttcccggagagagggctacatgtcctcgccatcagaggacttcatgtcctcgccatcagagggctgcacgccctcacctccagaggactacacgtcctcaccttgagaggactacacgtcctcaccatcagagggctgcacgccctcacctccagaggactacatgtcctcgccttgagagggctacacgccctcaccttggttaccctcaccgttgagaggactacacgtcctcgccttgagaggactacacgtcctcaccaccagagggctgcacgccctcacctccagaggactacatgtcctcgccttgagagggctacacgccctcaccttgggtactag

SEQ ID NO: 38270 - DNA, 216 bp, Glycine max
  Peptide Sequence Number=SeqID_129955
acttatcaaggtaatccttgtggcgtctaccttgacttatcttccttcaccggaagtggcgtctacccagacttatcttccttcatcggaagttgcgtctaccctgacttatcttccttcaccggaagtggcgtcatccaaaccttcgtagcctgtatcaaacaatccgctcctactcaggttcgcatcatctggtatcatagcttcggctcttga

SEQ ID NO: 38271 - DNA, 342 bp, Glycine max
  Peptide Sequence Number=SeqID_129956
atgtccaaatcttttgaatttgggatgaccggctctctcgatgagtcgatctcttgctttctcataagggtggacccttgggtacttgtacctatcacttttagaggactacacgtcctcgccaacagagggctgcacgccctcaccttcagaggactacatgtcctcgccttgagagggctacacgccctcaccttggttaccctcaccgttgagaggactacacgtcctcgccttgagaggactacacgtcctcaccatcagagggctgcacgcccttacctccagaggactacatgtcctcgccttgagagggctacacgccctcaccttgggtactag

SEQ ID NO: 38272 - DNA, 381 bp, Glycine max
  Peptide Sequence Number=SeqID_129957
atggcaggaaggtgtgctcgttttgaatttgcacatcatgggggccgcccgtacttcccaaatctttgcctaccatatctgaggttggatgatcatttggttgaggccagatgggggcgtcgggttcaccttaacaacagcgctggtagcggcaactgcaatcacattggcttccattatcttcttgatgctcatcatggcctctatcattgtggccatttgctctttcatggcctctgtcacaacctacccttcggcgggagggcgacgcatcactcgcgggtgcgtcttccaagaaaggaatacgtgcggagtcgccaccaacgtttatttgaggaaaacatcagaaaaaccggaaaagacgtggtcaacgaattttaa

SEQ ID NO: 38273 - DNA, 321 bp, Glycine max
  Peptide Sequence Number=SeqID_129958
atgatcttggaagacgagttgaaggcttgccaaaggtcgaaaaggagcttgtccgagcagttgagcaagactgaagaaaacatatgggccatcatcaatcagtacaaggaaaagctaagcctagtagcgactcatgaacaaaggctagaggacgagttctcctttactttgaatgggagtcaagagcttccacgactgctagccaaggccaaggccaaggcaatggcagatttatacttggcccccgaggaagttcaggggctcctcgattattgccaacacatgattgatctgatggcccacataattaggagtcgctaa

SEQ ID NO: 38274 - DNA, 273 bp, Glycine max
  Peptide Sequence Number=SeqID_129959
atgaagatgctcctgatatcacatgatgtaagttccattggagcttgtaggctgtcacaacctacccttttgcgggcgagtgaggcgaggctcatgggtgcgtcttccaaaggaggaaaatgcgcggagtctccaccaacgtttatttgtggaaaacgtcggaaaaaccgaaggaaaccggtcatgaagaatattccagattcaggagttgtatttacgtttgaggaaggtattagcacctctcacgtttgtcccaaaggacaacaggattaa

SEQ ID NO: 38275 - DNA, 759 bp, Glycine max
  Peptide Sequence Number=SeqID_129960
atgcggcataacgccggcaggaaccgcatgcgcataccccgtatttatcaccccgaagctctaaccgttaacagtgaagttctgcttgatgaggatgccgccaaccacgtcggccgcgtgctgcgcatgagcgccggacagcagatcgagctgtttgatggcagtaatctgacttttagcgccgaaatcacccaggccgacaaaaagcgtgtaaaagtaaaggtccttgccagccagcctgacgatcgcgaatctccgctgcacttacacctcggtcaggtgatgtcgcgcggtgaaaaaatggaattcactatccagaaatcgatcgaactgggcgtgaatgtgattacgcccttgttttctgaacgctgtggcgtaaagctggatgccgaacgcctggcgaaaaagattcagcagtggcaaaaaattgccatcgccgcctgcgagcagtgcggtcgtaatcgcgtgccggaaatccgcgctgcgatgacgctcgaagcctggtgcgccgaagcggatgacggcctaaagctcaacctgcatccgcgcgccagccacagtatcaatacgctgccgcagccggttgaacgcgtacggctgctgattggcccggaaggcggcctgtcggcagaggaaattgccatgacggcgcagcacggctttaccgatatcctgctcggtccgcgcgttttgcgcaccgaaaccacggcgctcaccgccatcacggcacttcaggtgaggtttggtgacctcggttaa

SEQ ID NO: 38276 - DNA, 457 bp, Glycine max
  Peptide Sequence Number=SeqID_129961
atgaagccgctacccccggtaaatccaagtggtagtggcatcaccagtgggctctgtgctggccgtgcccggcgaacagcaagctgccgtgcacgggttgccgttcaaagcgtggctggtagtatttggggtacagacagggaaggtcatgactgggcggtagcgtgggcagggcaaaattacgcgtccagtcctccctatgaccagataggactggcgggtgggctgaacctgtaccattatgcgccgaatgcgctggggtggatggatccgtgggggttgagtaaatactctcttggaaaagagacaggcagtaacggaaatcctttaaaaaaggaaaatgcacgctgccagcctgagccagcaacgccaacgcctgctgccgggccagctcaatcttccgccgctgctgctaaagccgcacctgctcctggcgcagccggctctcttcgcaact

SEQ ID NO: 38277 - DNA, 903 bp, Glycine max
  Peptide Sequence Number=SeqID_129962
atgcagcagttgatggatggcgtgcgtgcgcgcctgccgctggcggcggacgccgaaatcactatggaagccaatccgggcacggtggaagccgatcgcttcagcggctatcagcgggcgggcattaatcggatttcgattggcgtgcagagtttcagtccgcaaaagctgacgcgcctggggcgcatccacggtccggacgaggcggtccgcgcggcacagctggcggccggtctcggcctgcgcagctttaacctcgacctgatgcacggcctgccggatcagtcgctggaagaagcgctggacgatttgcgccaggcgattgccctcaatccgccgcatctgtcgtggtatcaactgaccattgagcccaacacgctgtttggttcacgcccgccggttttgccggatgacgatgcgctgtgggatatctttgagcagggtcatcagttgctgagcgccgcaggctatcagcagtatgaaacctcggcctacgccaaaccgggctatcgctgcgagcataacctgaactactggcgcttcggtgattacctcggcatcggctgtggcgcgcacggcaagctgacgcagccggacgggcgcatcgtgcgtacggtgaaaacccgtcatccgcgcggttttatgaagggcaactatctggataagcagcatgacgtgccggacgaggacaagccgttcgagttctttatgaaccgtttccgcctgctggaagccgcgccgcgcgccgactttcagcgctacaccgggctggaagaggcagtgattcgcccgcagatcgacgcagccattgccgccgtttatgtgcaggagcagccagagcactggcagatcaccgaaaaaggcaaactgttcctcaattcgctgctggagctgttcatgtaa

SEQ ID NO: 38278 - DNA, 1033 bp, Glycine max
  Peptide Sequence Number=SeqID_129963
atgggtaagattattggtattgacctgggtacaaccaactcatgtgtggcgattatggacggtggcaaagcacgcgtgcttgaaaacgccgaaggcgatcgcaccacaccgtcaatcattgcatataccggggatggcgaaactctggtcggtcaaccggctaaacgtcaggcggtgaccaacccgcagaataccctgtttgcaattaagcgcctgatcggccgtcgtttccaggacgaagaagtgcagcgtgatatcaaaatcatgccgtacaaaatcatcggttctgacaacggtgacgcctggctggacgtgaaaggccagaaaatggcaccgccgcagatctctgcagaagtgctgaaaaaaatgaagaaaaccgcggaagatttcctcggtgagccggtgaccgaagcagttatcaccgtaccagcctacttcaacgatgcgcagcgtcaggcgaccaaagacgccggccgtatcgcgggtctggacgtaaaacgtatcatcaacgaaccgaccgcagcggcactggcttacggcctggataaaggtcagggcaaccgcaccatcgcggtatacgacctgggtggcggtaccttcgacatctctatcattgagatcgacgaagtcgacggcgagaaaacctttgaagtactggcgaccaacggtgatacccacctgggtggtgaagactttgacagccgtctgatcaactatctggttgccgaattcaagaaacatcagggcatcgatctgcacaacgatccgctggcgatgcagcgcctgaaagaagcggcagagaaagcgaaaattgagctctcttctgcgcagcagaccgacgttaacctgccgtacatcacggcggatgcgactggtcctaagcacctgaacattaaagtgacccgcgcgaagctggaatcactggtggccgatctggttacccgttcgattgagccgctgaaagtggcgcttaacgacgctggcctgtcggtttctgacatcaacgacgtgatcctggtcggtggtcagacgc

SEQ ID NO: 38279 - DNA, 3441 bp, Glycine max
  Peptide Sequence Number=SeqID_129964
ctgaccgacattgatgcgatgctggagatggatttcgtcagccgcagcagcaagattctctctgcttacatcggcgatgaaattgccgcgcaccagctggccgagcgcgtgaagaacgcctttgctttcccggccccggtgagccaggtgagcgacgatgtggcctgcctggaactgttccacggtccgacgctggcgtttaaagatttcggcgggcgcttcatggcgcagatgctgtcgtacgtgtctggcgcggatgagcagatcaccattctgaccgcgacctccggcgataccggcgcagcggtggcgcacgcgttctacggcatggaaaacgtgcgcgtggtcatcctgtatccgcagggcaaaatcagtccgctgcaggagaagctgttctgtacgctgggcggcaacattgaaactatcgcgatcgatggcgacttcgatgcctgccaggcgctggttaagcaggcgtttgatgatgaagagctgaagaaagccatcggcctgaactcggctaactccatcaatatcagccgtctgctggcacagatttgctattacttcgaggcggtggcacagctgccgcaggagaaacgtaatcagctggtggtgtcagtgccaagcggtaactttggcgatctcacggccggcctgctggcgaaatcgctcggtctgccgatcaagcgctttatcgccgcgaccaacgccaacgataccgtgccgcgcttccttgccgacggtcagtggcagccgaacgcgaccgtggcaacgctgtcgaacgcgatggatgtcagccagcctaacaactggccgcgtgtggaagagctgttccgccgcaaaacctggcgcctgaccgatctggcctacggcgcggtgtcggatgagaccaccaaagccaccatgcgcgagctggcagagctgggggagtttggcctgttcctcggcaccgcgcatccggcgaagtttaaggagagcgtggaagagattctcggccagccgctgccgctgccggaagcgctggccgcgcgcgccgatttgccgctgctgtcgcatgccatgaaggcggatttcgccgcgctgcgggtgtttttgctgaaacgcgcaatgattcaggtgaagctggcgttattgctcgcggcgcttaaataccagctcgttacccttactctccgccgcatcaaagaaataaccgtcaacatcaaacttcttcagctgcgtcggcttcgtcaggcgcttctcaatcacataacggctcatcaggccacgcgccttcttggcgtagaaactgatcaccttgaacttaccgtttttctcatcgaggaacaccggcttaaccagctcggcattcagctgcttcggcttgatggctttgaaatactcatcggaggcgaggttgatcagcacgtcatcgccctgttccgccagcgcgtcgttgagcttttgcgtcagcaggtcgccccagaaactgtagagatctttgccggccgattcgccagtttgatgcccatctctaagcggtacggctgcatcaaatccagcgggcgcagcaggccatacaggcccgaaagcatgcgcagaattgcctgccgcgcattatcgggtgagaagggcggctgccactggctgaaacggtcggcgttgaggtgcgccagtttgtcgctgatgcccatcagcgaagcgatttgcgccggggaaagatcgcgcgccactgtcttggctggcgagataaccatcagcattgtgtctgtcctcgttgacccgctgttttcaggggatggatgggaaaaatgtcgcgacgaggcacgcggcgatgttgcgccgcttagcctgcgtgatattatcgcaacagccttttacaccctgacagtcaacttaagagaaaagagaaccatgacggacaaacttacttccttgcgtcagctgactactgtggtcgccgacaccggtgatatcgcggcaatgaaactctaccaaccgcaagatgccaccactaacccttctttgatcctcaacgctgcgcaaatccctgaataccgtaaactgattgacgaagccattagctgggcacgtcagcagagcagcaacaaagaagagcagctggcgctggtttctgacaagctggccgtcaacattggtctggaaattctcaaactgatcccgggacgtatctctactgaagttgacgcgcgtctctcttacgacaccgaagcgagcatcgcgaaagcacgcagcctgatcaaactgtacaacgatgccggcatcagcaacgatcgtatcctgatcaaactggcctcaacctggcagggcatccgcgcggcggagcagctggagaaagaaggcatcaactgtaacctgacgctgctgttctccttcgcccaggcgcgtgcctgtgccgaagcgggcgtgttcctgatttcgccatttgttggccgtatcctcgactggtacaagcagaacaccgacaagaaagagtacgcagcgcatgaagatccaggcgtggtatccgtgtctgaaatctacaactactacaagcagcacggctatgaaaccgtggtgatgggcgccagcttccgtaacgtcggcgaaatcatcgagctggccggttgcgaccgcctgactatctctccgggcctgctgaaagagctggccgagagcgaaggcagcgtagagcgtaaactgagctacagcggcgaagtgaaagcgcgtccggctaaaatgaccgaagcggaattcctgtggcagcacaaccaggatccaatggcggtgaccaaactggccgaaggtatccgcaactttgccatcgaccagggcaaacttgagaagatgatcgccgaactgctcgataactctatggatactttacgtattggcttaatttccgtgtccgatcgggccgctaacggcatctatcaggatcagggcattccggcgctggaaagctggcttagcgctgcgctggcgacaccgtttgagattgacacccgcctggtgccggatgaacagccgatgattgagcaggcgatctgcgagctggtcgacgaacgtttttgccacctggtgctgaccaccggcggtaccggtccggcccggcgcgacgtcacgccggatgcgaccttagcggtagccgaccgcgagatgcccggctttggcgagcagatgcggcagatcagcctgcagtttgtgccgaccgcgattctgtcacgccagatgggcgtgatccgcaagcagtcgctgatcctcaatctgccgggacagccgaaatcgattaaagagacgctggaagggttgaaagcggatgacggtacggtgaaagtgccagggattttcgcggctgtaccctattgtttacagctgctggaagggccttacgtcgaaacccacccgaaggtggtagcagcttttcggccgaaaagcgcacggcgtgagacaaacttctga

SEQ ID NO: 38280 - DNA, 1251 bp, Glycine max
  misc_feature (1233)..(1233): n is a, c, g, or t
  Peptide Sequence Number=SeqID_129965
atgcatttccccctgatccttgtctcacccgctcgcccggagaatatcggcgcggccgcccgcgccatgaaaactatgggatttagcgagttgcgtattgtcgccagtgacgcctggcaggatccggccgcgcggcgtgtagcccacggtgccggtgagattcttgaccacgtgaaaacctatgacacgctgagcgccgcgctggcggatgtggatttttccgtggccactaccgcccgcagccgggcgaagtttcgctattacgccacgccggcgcaggtcgaaaccatcctgcaggagaagcgtcagtggctgaatcgtatcgcgctggtgtttggccgtgaagacagcgggctgactaatgaggagctggaacaggtcgatctgctgaccggcattccgatggcgcaggactatccttcactgaatctcggccaggcggtgatggtgtactgctatcagctgtcggcgctgcaccaggtggcggccgcgccggttgaggcggctaacgcgcagcagctgcaggcgctgcgtcagcgctttcatcagctgctggtgacgctggacgtcagcaatgatgccaagctggcggactggatcgatcagcgcatcggtctgctggagcagcgcgacagcgccatgctgcaccgtttgctgcacgacgtaacggtgcgggctgacgcatacaggaaaaacaaaagaaagaagcccgcacctcaacagtgcgggcttttttttcggcaaaaattcaggagagcttcaatcatgcgagtgctgaaattcggcggaacctcggtagccaatgcggaacgttttctccgcgtggcagatattctggaaagcaatgcgcaacagggacaggttgccaccgtgctctctgcgccagcgaaaatcaccaatcatctggtagcgatgattgagaaaaccatcagcggccaggatgcgctgccgaatatcagcgatgccgaacgcatttttgccgaactgctgcaggggctggccgacgctcagcctggtttcgattacgatggcctgaaaacccgcgttgagctggagtttgcgcagctgaaacaggtgctgcacggcatcagcctgctgggtcagtgcccggatgccgtgaacgccgccattatctgtcgtggcgagaagctgtcgattgccatcatggaagcgctgctgcaggcgcgcggccacaaagtgacggtgatcgatccggtcgaaaaactgctggcnggtgggccattatcttga

SEQ ID NO: 38281 - DNA, 1221 bp, Glycine max
  Peptide Sequence Number=SeqID_129966
atgacgtttctggtcaaagaagcgcaccacctgcagctttttaaacaccagcgaagtgcgtttgcgaaacaccacttcaccctgcgccttgccctgcgcgattttatcgctaagctctatcggtcccacctgctgacaggagatggccgcgtcggaagtatcttccgccagacccagtccgcccttaataccgccggtttttgcccggctgatataacaggttacatttttaacgtcggggtcgtcgaaagcttccaccacgatcttatgatcggggccaaacatcttgaatacggtgtcaacggagccgatctcctcggccagcacgctctgactcaacataaatgttgccagcccggtatcattcgcgatttgcttgtctggctggaaagccatctggatcaacccctttcgctcgataacgttgcgctaaaagcgggctattccaagtggcacctgcagcgaatgttcaaggaagttactggccacgccatcggcgcgtatatccgcgcccgccggctgtccaaggccgccgtcgcgctgcgtctcaccagccggccgatcctcgacattgcgctgcagtatcgcttcgattcgcagcaaacctttacccgcgcgtttaaaaagcagttcaatcagacacctgcgtggtatcgccgctcgtcggagtggaattcgtacggcattcgcccgccgattcgcctcgatgattacccgatgccgcaagcgcagttcgtcacgctgccggaaacggtgctggtggggcaaacgcaaagctatacctgtacgctggagcagatctccagctaccgcgacgagatgcgcatccacttctggaagcagttcctgctggagaccgataccgtgccaccggtgctgtatggcctgcatcaggtacgcgccagccatgagaaggatgatgagcaggagattctgtacaccacggcggtgccggccgaccagcaggcgctgagcatgcagtcaaaccagagcgtgattctggaagccggggagtatgtgcagttcagctatcagggaccgcgcactgcgctgcaggagtttattctgctgctgtacggcacctgtatgccgaccctcggcctggtgcgccgtcagggccaggatattgagcgtttctatacgcacggtggcaagaagcgcagcgagccgccaatggagattcgctgcgaatatctgattccgattcgtccgcagcagtaa

SEQ ID NO: 38282 - DNA, 1797 bp, Glycine max
  Peptide Sequence Number=SeqID_129967
atggcatcgaccttcggttttacgcttcaggattggcaacgttgcgcacagcaggatgcacagcagatccctgcactgctggccgcacatctcgacgcactcgataaccaggataatgcctggctgtacctcgcttcgccggcccagctgctggcgcaggttgaaccgctgctggcggcgtatcagcgcaatccggccgcgctgccgctgtttggcgtgccgtttgccgtcaaagacaacattgacgtggcaggctggccgactaccgccgcctgcccggcgctgacgtatcaggcggcggccgatgccttcgtggtggccaggctgaaagcggcaggcgctatcgtcatcggtaaaaccaacctcgaccagtacgcgaccggtctggttggcacccgctcgccgtatggcgcggtgagcaacacctttaatccggcctatgtcagcggcggctccagctccggctccgcgtccgtgctggcgcgcggcctggttggcttctcgctcggcaccgatactgccggctccggccgcgtgccggcaggttttaacaatatcgtcgggctgaagccgaccaaaggctggttctcggccagcggcgtggtaccggcctgccgtctcaatgacaccatctcggtgttcgccctgacggttgccgacgcctttagcgtcgccagcatcgcgggcggctacgacgccgatgatgcctatgcgcgccagtcgccgcgcagcgcaccggccagtttccagccgcaaccctcgctggcgatccctgccgcgccgcagttttacggtgaccagcaggcggaagcggcgtggcacagtgcgctggagcagctcacggcgagcggtgcgacgctgcaccctatcgacttcgcccctttccatcagctggcagagcagctctattacggcccgtgggtcgccgagcgcaccgtggcggtcggcgagatgcttgaccgcccggaagagatggatccggtggtgtacggcatcgtcagcagcggccgccagtacagcgccgtcgaggcgtaccaggccgaatacctgcgtgccgaactgacgcgccagatccagcagacgctggcccggttcgatgcactggtggtgccgacctcgcccaccatccatacgctggaagagatgcagcaggagccggtgcactacaactcgcagttcggcacctataccaacttcacgaacctggctgacctcagcgcgctggcgctgcctggcccgttccgcgccgatgggctgcccgcgggcatcacgctgatcgccccggcgtggcacgaccgcgcgctggcgacgtttggcctgcgctggcagcagcagctggcgctgccgctcggggccaccggcaaagcgctgccgccgcagcccgccgcgctgccgccgtcgcctgaccacgtgcgcgtggcggtggtcggtgcccatctcaccggcatgccgctgaatttccagctcaccacgcgtcaggcggtgtgggtcgaagagacgcaaaccgccagccactatcgcctgttcgccctgcttgatggcccgatcaaaaagcccggcctgctacacggcgacagcggtgccgccatcaccgtcgaactgtgggacatcccgctggcgcgctttggcgaattcgtcgcggaaatcccggcgccgctcggcatcggttcgctgacgctggcggatggacgcatcgtgaaaggctttatctgcgaaccggcagcgctgacccaggcgctggaaatcactgaattcggcggctggcgcaactggctgacgtcacaggggaatcactaa

SEQ ID NO: 38283 - DNA, 165 bp, Glycine max
  Peptide Sequence Number=SeqID_129968
atggatgctatggttgtcatcatcaaaaagggggagattgtagaagcaagcttcatgatgatgaatcaagttgattcaagtagttttgatgatgacaaagatgatgacaaaaagctaaagagaatgatttcaagattgagtcaacaagttcaagatcaagattaa

SEQ ID NO: 38284 - DNA, 570 bp, Glycine max
  Peptide Sequence Number=SeqID_129969
gaagacgaagaagtgcaggctcttaggaccgaactcaagcaagctcaaacagtcaaagaaagggctcgtagggaagaacacggccggaacaagttccgaggggctctgtggggcagtaacagggagcttaaactccaaagagaggaaagggaccaatcacgagtagacagtttgatcttgaaagatgaattgaaggcttgctcgaggtccaaaagaagtttgtctcagcggttatgcgagacagagaccaacatgttagctatcatcaccaagtaccaagaagaattaagtctagccacgacccacgagcatagagtagcggacgagtatgcccaagtgtacgccgaaaaggaggctagaggaagggtgatcgactcgttacacgaagaggcaaccatgtggatggaccgatatgctcttaccttgaacgggagccaagaacttccccgattgctagccaaggccaaagcaatggcggacacctactccgcccccgaggagatccacggacttctcgactattgtcaacatatgatagatttaatggcccgtataattaggaactgctag

SEQ ID NO: 38285 - DNA, 219 bp, Glycine max
  Peptide Sequence Number=SeqID_129970
gctggtaatcgattaccagaggctccctaagtttcctgacttcgttttcaagcctggtaatcgattacaccccttggagctcgcctgtttaggtacatcacaggttctcactgaccgactatgcccgggttgggtcgggattggtcaagcttggttttggacaatagcacctctcctgacatcctcaaggtctcctgacccccgcgacatattctccag

SEQ ID NO: 38286 - DNA, 972 bp, Glycine max
  Peptide Sequence Number=SeqID_129971
atggacaagaaaatacgcagcattgtgagtagcatcttgaaagacgcctctgttcctgaagctgatgaagatgtcccaacatcgtccaacccaaatgtttctgtgcctgatgtcaagaaagatgttccaacatcttccgctccaaatgctgaagcactcccttcacccagtgaagagggatcaactgaggaagatgatcaagccgcagaggagactcctgcaccaagggcaccagaacctgctccaggtaacctcattgaccttgaagaagtagaatctgatgaagaacccattgccaacaggttggcaccgggcattgcagaaaggttacaaagcagaaagggaaaaactccccttaagagactggccttggaaagagaactgggaagagctgccttggattgcaaggagatcatggacctcatcaaggctgctggactgctgaagactgtcagcaaattgggagattgctatgaaggcttagtcagggaattcattgtcaacattccctctgacatatctaacagaaaaagtgatgagtatcaaaaggtgtttgtcagaggaaagtgtgttaaattctcccctgctgtgataaacaaatatctgggcagacctactgatggagtgatagatattgctgtttctgagcatcaaattgccaaggaaatcactgccaaacaagtccagtattggccaaagaaagggaagctttcagcagggaagctaagtgtgaagtatgcaattctacacaggattggtgctgcaaactgggtacccaccaatcatacttccaccattgccacaggtttgggtaaatttctgtatgctgttggaaccaaatccaaatttaattttggaaactatatctttgatcaaactgttaagcattcagaatcatttgctgtcaaattacccattgccttccctactgtgttgtgtggcattatgttgagtcagcatcccaatatgtaa

SEQ ID NO: 38287 - DNA, 234 bp, Glycine max
  Peptide Sequence Number=SeqID_129972
atgactgaagcacgtcaaaagggggtacggaaagtaaatgaaaacgagaataaaattgaagaccgaagaaaacgaagaacgaacgatgaatgtcaaagaacggttgaaaatcttcgcgtaattacccacggaaacgttatagaaacgttacggaagcgccttggcttgtattttcttcacggaaacaattttcctcagcaatttcaagagaatacgaagtgccaagaaggttga

SEQ ID NO: 38288 - DNA, 948 bp, Glycine max
  Peptide Sequence Number=SeqID_129973
atggggacaaatcaaaacggcaaaaggttttatcaagtcaaggttaagagtctagatgtcaccagcctcaacgaattgggacgattgatgggacctctccaaaggcaagccttccgcaaagtgtacggaaagattctagatttgaccgtagcggaggtgtttacggaagctgtcctatccctcacccaatactatgaccagccgttgaggtgcttcatgtttggggacttccaaatggtaccgactattgaagacaagattgcagctgtggttgaagattcggcaaaagagttggatcgcatgaagcaaactcggaacagcgtagtgggcctgcctcggaaatacttggaaggcaaggcaagggatatggcaagccaagaaaagtggggcccgtttgcggatatactagctttgttgatttttggggttgtcctctttccaaacgtggacggtttggtggacttagccacgattgatgctttcctcgcatatcaccatggcaaggagagtccagtggtggctatcttggcagatttgtttgacacctttgaccggaggtgtgagaaaaacagtgcacggattgtctgttgtttacccgctctctgtgtgtggttggtttcacacctattccaacaagacacaagacacccgtgtccgcttcaaagctatcgctcatgcgccgaaaaaggaagagtcgattgggaccaacatttggctgggataggaggcaacgcaatcaattggtttcctcgatggaaggaaggcaaggagggagttcttttctcgtgtggggactaccctaatgttctgttgatagggacgaggggttgtattaactataatcccgcacttgccataagacagctagggtaccccatgaggggagcgccaacggaagggagtctctcacctttccttgtgaaagatttaggcgcgcaaggtctcaag

SEQ ID NO: 38289 - DNA, 485 bp, Glycine max
  Peptide Sequence Number=SeqID_129974
atattgctgtttctgagcatcaaattgccaaggaaatcactgccaaacaagtccagcattggccaaagaaagggaagctttcagcagggaagctaagtgtgaagtatgcaattctgcacaggattggagctgcaaactgggttcccaccaatcatacttccactgttgccacaggggacacatgtcccagacattgtctcgacatcaggaaagctgctgcttcaggtgctgtgtccaaggatgctttgattgctgaactcaaggacacatgcaaggtgctggaagcaaccatcaaagccaccacagagaagaaaatggagctggaacgcctgatcaaaagactctcagacagtggcattgatgatggtgaagcagctgaggaagaagaagaagcagctgaggaagaagaagaagccgctgaggaagaagaagatgcagcagaggatacagaatccgatgatgatgattctgatgccaccccatga

SEQ ID NO: 38290 - DNA, 258 bp, Glycine max
  Peptide Sequence Number=SeqID_129975
atgagtttctctctgggttccttgttgaaccaattatcagacttatcttccttaaccggaagtggcgtctacccagacttatcttccctctttggaagtggcgtctacccagacttatcttccttcaccggaagtggcgtctacccagacttatcttccttcactggaagtggcgtcatccaaatcttcgtagcctgtatcaaacgatccgctcctactcaggttcacatcatttggtatcagagcttcggttcttga

SEQ ID NO: 38291 - DNA, 414 bp, Glycine max
  Peptide Sequence Number=SeqID_129976
atgagaaagaacctcaactttggaaccgatatcagtcatcattcaactagtgttaatgatgagggtactagtcataaggaccctctaagagagttaagaaaagaaaagcatgcctcctatagtagtcataactcttgcaagagcctaagtgaagaacttcgtgattattatgaaggaaggcatagggcacatattagacctcactcccattggagagaaagggaaagaaagcctcaagaggctaacattaacctcccatacttccatgggaaggacaatgtagaggctaacttagattgtgaaataagggtagagcaacaacttaaaaaagaagtctacttcaaaatcttatggctctcactcttatccaaagaaagaccaaggttaaggcatcttaggggtgataccttctaa

SEQ ID NO: 38292 - DNA, 84 bp, Glycine max
  Peptide Sequence Number=SeqID_129977
atggtggaggacacattgtcataccctaatttcgtccggggacctttgcttgatgacatgcgaccattctttggtccttgtgag

SEQ ID NO: 38293 - DNA, 150 bp, Glycine max
  Peptide Sequence Number=SeqID_129978
atgaacttgctaagcgagcatgctgcgctaagcaagttcattagtactcattgtatagaggcgttctttgaagaactcgctaagcgcgcctaccgcgctaagcgagttcatcctttgaggatgaatactcatcctcttgctgaactacct

SEQ ID NO: 38294 - DNA, 432 bp, Glycine max
  Peptide Sequence Number=SeqID_129979
atggaatgctaccggcagccgtttgccatcagcgaacgtctgttgtggtccggcgagatcgtggtaaaccgtccgcaatcctttggcgttttagccagctcgccgttgacgcctgattatatcgtcgatgaaggcgtccttatctatctttccaaccacggtctggtcatcatctgcggctgcggacatcgcggcgtagagaacattgtgcggcattgtcagaatatcaccggcatcgagcgggtccacgcgttgatcggcgggctacacctgcgcgccgcatccgtcgccagggtctggcaggtccgaagttatttacagcagctgcaggtggagaaaattttggcctgccactgtaccggcgcctggggaaaactgtggctcgccggcgcacaggcgccggctacaggggatattttgcagctagcttaa

SEQ ID NO: 38295 - DNA, 297 bp, Glycine max
  Peptide Sequence Number=SeqID_129980
atgatggaaaaccttcacggattcactcacgaaaacatctcggaagcgttacggaagcacctcggcttggattttcttcacggaaacaatttttttcacccaaaacagaaaaagggggaggaggttgccgctcagctcgcccaggcgagctgggttgcttcctccagaagcaaccctgcttcgaaaatactatggaagggttatgggaattttacggaagcattacggaagtcccggaagccattttttaacaaaacgggggaggtggttgccgcccagctcgcccaggcgagctag

SEQ ID NO: 38296 - DNA, 1259 bp, Glycine max
  Peptide Sequence Number=SeqID_129981
atttgtttgatacctttgaccggagatgtgagaaaaacagtgcacggattgtctgttgtttacccgctctctgtgtgtggttggtttcacacctattccaacaagacacaagacacccgtgtccgcttcaaagctatcgctcatgcgccgaaaaaggaagagtcgattgggaccaacatttggctggaataggaggcaacgcaatcaattggtttcctcgttggaaggaaggcaaggaaggagttctcttctcgtgtggggactaccctaatgttccattgatagggactaggggttgtattaattataatcccgcactcgccataagacagctagggtaccctatgaggggagcgccaaccgaagaaagtctctcgcctttccttatgagggatctaggcgcgcaaagtctcaaggtgatacaaagagtccacaaggcgtggagaagtccgttgaggaaagacaaggagcttaaaggcatccgaaatggcgtcatcggtggttatcatggatggctaagagttcacacgcgagggttagattggctctccaaattgaaagttatcaatgaggagaactttgaagctctggaggaagacgaagaagtccgagctctaaaattagagctagggaaagcaagactcgccaaggagaagttcaaatcagccgctacacacatccggaaagagtgcaccgagttacaagaggaaaacgcggccactgcaagagcccttgaacgagaaactaaaagggcctgcaaggaggaatatggccgagagaaattccagagagcattgtggggtagcaacaatgagctcaagctccgaagagaggaaagagaccggtcacaggtgcatggcatgatcttaaaagaagagttagctgcttgcgcaaggtccaagaggaatttggctcaacacttggaagccacggagcaaagcatgctagctatcatagggcaatacaaggaagagttgagccagtctgtgacccatgaacaaaagctagtggaggattttgcacaagtgtacgccgaaaaagaagcaagagggagggtgattgatgcattgcatcaagaagcgactatgtggatggataggttcgccttgaccttgaatggaagtcaagacctcccgcgtctattagccaaagcaaaagccatggccgaagtgtgtacggcccccgaagagattaatgggctaatcaattactgtcaacacatgatagatttgatggcccatataattagaaaccgttag

SEQ ID NO: 38297 - DNA, 453 bp, Glycine max
  Peptide Sequence Number=SeqID_129982
atggcggccaatactgtggtaggtacgcgagggtggcattcgccgaagaatggagaaaggttgtcaaagcgagatagcggcgaggtaaatgtgccagttacactatggtcacaacacattgaatatcgacttccgtacgccattcctgcctttatattacttgccctctgcattgcactgggagcatggagtatttggttacttattttgaggcgcgtcggcctcaaacaaatgcgaacgtacctcgctcgtacctccccgggtaggatactcgggcatgcgctacatgaagatcaagggaatattcttgcgtctacggacgtgtggcttcagcagataggcttacgaaaggtcacgctgccagggcgaaatgaagacagcgaaattccattgctagatgttcagcggacactaacccacgaggatggtggaggagataagagctctaagtag

SEQ ID NO: 38298 - DNA, 117 bp, Glycine max
  Peptide Sequence Number=SeqID_129983
atgtggaccactacgggggaggtggttgccgcccagctcgcccaggcgagctcagctcgcctaggcgagccaggttgcttcctccagaagcaaccgcctcctggaggaatattctag

SEQ ID NO: 38299 - DNA, 225 bp, Glycine max
  Peptide Sequence Number=SeqID_129984
atggtgattttccaccatggagatgcagcggaagataaaggagaagaaagaatgaggggtgaagcgagaaaggatccagctaaagggaaacttcccctaaagtgggaaggaccctttagagtcactacaacactacagaatggagaataccaacttgatgaacttgatggaaaggtcatacctcggatctgggatgcaactcatctaaagccatattgtagttaa

SEQ ID NO: 38300 - DNA, 456 bp, Glycine max
  Peptide Sequence Number=SeqID_129985
atggaggcctgctgtaggccggctgaggtctccatcgtccaaaaaaaatgtatgactagaggcaatccatctgacttacaaccctttgatcctgagatagataggacatttcatagattagttaggcatcattttataccttttgatcattctgagcattccataactagtgaatctatgcattctgttattggtgattttgaacatcctgatcttgagcattataattttgagcattctgattctgagcattctgattttgcacattctgagaacatggcacaacctccacctcgtgagaggactctaagggaaatggctgcacctgatttcacctatgaaagcttgtgcatccaataccctaatgaggatgtcctatatgttcttaaaactggacagattcatttgcttccaaagtttcatggccttgcaggtgaagacccgcacaaacattga

SEQ ID NO: 38301 - DNA, 183 bp, Glycine max
  Peptide Sequence Number=SeqID_129986
atggacaagagaataaaaatacatgaaacaaaatgtggaccaccacggcaaaatagggagaagcttgccgcccagctcgcccaggcgagcaaggttgcttcctctagaagcaacagccttctggaggaagggtctggaaggcccaagtgggccagattgctatttgcaccccctttttactaa

SEQ ID NO: 38302 - DNA, 450 bp, Glycine max
  Peptide Sequence Number=SeqID_129987
atggcatctaagaaaaggaaggctccttctacaccttcccaagtcagatataaccagtctaggttcacctctcaagaaggttgggagagatatacttatataattgtacccaggaagctgttaccagaaaaaaatgtggtaatctaccacacagagttcaatgagattaaaaaggaattaatgataagacagtgggatgaagagctcacaagctttgatgaaggcaacattgatgttgccataaccccagtgattgtagaagagggggagaatttatatgtttattcgagatttgcactcctgaggcctgatcctcaggagatagctgctaaactctgtatcccagggaggggatttaagctgaatgttgatggtctccccttgatgatcttaaggaagaacatgactactctcgctcagacatggagtgttctttctattgtaacttga

SEQ ID NO: 38303 - DNA, 182 bp, Glycine max
  Peptide Sequence Number=SeqID_129988
aaaaatgttatgcatttactggttgtggaaagagcagtgcagaatgagttctggatgttttctagtagatcccaacgagttttctgcctttgccctgttttgcttggctgtgatagcttgtgctgtttgaatgttgctttgcttggatgttgtggaagcttgggaggattgatggggacccg

SEQ ID NO: 38304 - DNA, 522 bp, Glycine max
  Peptide Sequence Number=SeqID_129989
ggtccgcccttgacagtgaagaacacattggagaatggaggaatccaatcgggaaaatacggtccgctcttgacgggtccgctcttgacggtgaagaacacattggagaatggaggaatccaatcgggaaaataacaaagatcacatttgccaatcaagagggttcgctcttgacggttaagagtacattggagaatggaggattcaatcgggaaaataacaaagataacatttcccagtcaagagggtccgctcttgatgggtccgctcttcacggtgaagaacacattggagaatggaggaatccaatcgggaaaataacaaagatcacatttcccagtcaagagggtccgctcttgacggtgatgaacacattggagaatgtagatatcaatcgggaaaataacaaagatcacatttcccagtcaagagggtccgctcttgacgggtccgcccttgacagtgaagaacacattggagaatggaggaatccaatcgggaaaatacggtccgctcttgacg

SEQ ID NO: 38305 - DNA, 508 bp, Glycine max
  Peptide Sequence Number=SeqID_129990
ggctcgcaaggaagagcatggccgagaaaaattccgtggagctttgtggggcagcaacagtgagctcaagcttcgaagggaagagagagaccaatcacgagcacatagcatggtcttaaaagaggagttagctgcttgctcaaaatccaaaagaaacttgtctcagcgtttatgtgagacagagaccagcatgttagccatcatcaacaagtaccaagaagaattaaatctagccatggcccacgagcataaagtggcggacgagtatgaccaagtgtacgcggaaaaggaggctaggggaagggtgatcgactcgttacatcaagaggcaacaatgtggaagcaccgatttgctcttaccttaaacgggagtcaagagcttccccgattgctagccaaggccaaagcaatggcggacacctactccgccgccgaggagatccacagacttctcagctattgtcagcatatgatagacttaatggcccatataattagaaaccgctag

SEQ ID NO: 38306 - DNA, 123 bp, Glycine max
  Peptide Sequence Number=SeqID_129991
atgacgcattgtaatcgattacaggtattggtaatcgattacatgcccaataagccttctggctgcctgttcatgtgtaatcgattacactggatggtaatcgattaccagagcctatcctag

SEQ ID NO: 38307 - DNA, 724 bp, Glycine max
  Peptide Sequence Number=SeqID_129992
atgtcgcaaggacaagcagttccgtttggctgggaagttggcaacactttacagtcagggatgatggagaaaaggtggtcccagaaccacatggcgacgcagaacagacagaaacctgggaatcagaggatttttgatagtgagccttacaactttaattgtttaagcaaacccaacaaactctttcgatccgccccgtcaatagcccatagggattacctgccttggcttgatcgagtcgaacaagcgtatgaggatttctggaagacatatggtatctttgatttgatacaattctctcgatctggtcctgaatatcgaccagaaatgctgatagcagccatgcacttcttcgaatcttctaccaacacctttcagtttaagtgtgggatgatgactcccactctcttagatgtggccgcccttacaggccttaggcctagcggagaaacttacgaccccactaattctagtgataatatcaagctagtatataaggagaacaccttttccaaatacatagctgaacacaaaggaccggtcgaagaggaggtttctgatgaagagcacgtggccttcttaaccctgtggctatctcactatgtcttctgctcgaaatccttgcaagtagccaaaagatttattccaatggcattacaaattcatgaaggtcagaactttggatttggacgcctcttgttagcagtgctatacgaatcgcttg

SEQ ID NO: 38308 - DNA, 334 bp, Glycine max
  Peptide Sequence Number=SeqID_129993
ggggtgcaaacacgcgaacgctgtgggtcacgccactcagcctcgtgatattggttaccttggccgacaacgagctgatgtcggtggcctcttacttcctttcgcttggaggcgcatacctccatggaactgcgtggctgttttgataaacctcctggggggtcgtcacgtccttcaaaggcttggacctgcgcggcctacccgactcgacggcattaacttctccccctccatgattggcaagcgggcattttttggtggagtggcccggggtttcccatggtatgcgcaagttgcatcagggttataccactttaggaaaggaggttggtag

SEQ ID NO: 38309 - DNA, 218 bp, Glycine max
  Peptide Sequence Number=SeqID_129994
atgggctacgtgggagtacgtgagctcagttggaggtgggctacaggggatggtgggtttatgcgcgcattgtggatgtggaaaaacttgttgtgcaccatcgcccgaccgccacctagtaccacatgtgatggggtgaaacttcctgcttttattgttgaccacagagtggtacctggagatatgtcgcgggggtcaggagaccttggggacgtcag

SEQ ID NO: 38310 - DNA, 351 bp, Glycine max
  Peptide Sequence Number=SeqID_129995
atgaccatgattacgccaagctcgaaattaaccctcactaaagggaacaaaagctgcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgccccttcccaacagttgcgcagcctgaatggcgaatgggacgcgccctgtagcggcgcattaagcgcgggcgggtgtggtggttacgcgcagcgtgaccgctacacttgccagcgctga

SEQ ID NO: 38311 - DNA, 639 bp, Glycine max
  Peptide Sequence Number=SeqID_129996
atgacccaaaagctggtagcccgcggagacaccttacggttatccgcacctcgtcatccagtgatcccaagtgtgattgacgagcggaggccaatgtggtcatctgcgccctttccggaggtgttagcattttctggtggagactttttcaagtctcacaagttatccagaactaccacccttgtatcatccagaggcggcgggcccgatgatcgcggagacaccttacggttatccgcaccctttgtcatccaggaggcggcgggcccgatgacaagcagagacaaaattgtggtcatctgcacccttgtgtcatttccagaggcggcgggcccgatgatacgcggagatttttcaagtctcacaagttatctagaacctacggttatccgcacccttgtgtcatccagaggcggcgggcccgatgatacgcggagataccttacggttatccgcacccttgtgtcatccagaggcggcgggcccgatgatacgcggagataccttacggttatccgcacccttgtgtcatccagaggcggcgggcccgatgatacgcggaaatacccgagtggttatccgtataaacattcttttgctatctgtaagacaaaacgcttgatagcatgcagaggctga

SEQ ID NO: 38312 - DNA, 829 bp, Glycine max
  Peptide Sequence Number=SeqID_129997
ttggcccaggagcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatccatatctatactagggcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 38313 - DNA, 462 bp, Glycine max
  Peptide Sequence Number=SeqID_129998
atgatgcgtcaagagcatgtcgacatgatccttgaagttctctccttgaagtatcactcagtcatagtgattatagagagcaagtttgaaactcaacctcttgagcaggttgaagctttgcttcttgctcatgagccgcgtatgatcaagtttaagcagtgtcttgctgaatctcccttgatcaacttcacacactcgcaaacgaccaacaagtcatactcgcatcaagatcctgagagattttcaaacgtcagagcgaaggagaagggattgaagcctacatttgactgtcaccgtgcgagggacgtttatctctttacggatattatttcgcaaataccaacggaagagttttacttagacggatttgagtgtagcgggaaaaagatagggttttgggaaaggggaaggaaaaacggatttgagaggaaaagagagtgtagatacatatcggaaatgtaa

SEQ ID NO: 38314 - DNA, 456 bp, Glycine max
  Peptide Sequence Number=SeqID_129999
atgcctcgccctgcacctgcagcgccttgtcctgccagccacggacgctgcgcaaagtgctgcgcttcaaactggctgatatccgcttcatattgcagcgtccagtccaccgcgctgccgccaccgatcagcatttcgcgcttcagggcactgaccgtaaacgacacgctgatggtgttgcgctgcgcatcggcggccaccgcgcgtcagacgctgataatccgcctcgctcagactcagcgtcagcacgccgttacgctggcagttatcgtcaaaaatgccggcgaagctggtgccgataatcgcgcggatgcccagctgattcagcccccacaccgcatgttcgcggctggagccgcagccaaaattggcaccgaccagcaaaaacgtcgcgttctgccagcccggctgattaaggatgaaatcaggccggcagcggtgccagcttgccggtga

SEQ ID NO: 38315 - DNA, 414 bp, Glycine max
  Peptide Sequence Number=SeqID_130000
atgtcattgcctagcgctgttcatgtgttctccattatcaagtgtgaagcttctggtgactgggaagcacgttattctgttgttttccagatcggttccttcgccaagtataagaaaaaagaagaagtagagatgagagtcgtcatcgcgaaaagggcaggacggacgaaatcagtgtcctatctttgctttcctcttatctccgatgagagtctcgaggcgtgtcagaaatctcaaggaagcaggcttgcgcgatccgtgaaattccgtaatgtggcggaaatcgaaaagaggggggtacaaatagcaatctggcccacttgggccttccagatccttcctccagaaggctgttgcttctggaggaagcaaccttgctcgcctgggcgagctgaggtcgcttgggcgagctgg

SEQ ID NO: 38316 - DNA, 210 bp, Glycine max
  Peptide Sequence Number=SeqID_130001
atggttcagctaagcgcacatcggtgcgctaagcccaacatcttcactgtaagttgcaccttaagcagtgggcttagcgtggatgtcattgaaagtgcgcttagcgcaggtagtagcgctaagcctgaatcactcactaaaatgctaagcgctgctgctgtgctaagccccaaatgcttactggaggttacaacttcaatttgggcttag

SEQ ID NO: 38317 - DNA, 546 bp, Glycine max
  Peptide Sequence Number=SeqID_130002
atggtggtgcgtgttatgctcagaaacggatttgagcccggaatgggtctaggcaaggactgcctcgggaatgccgacgtggtcgatatcaagggaaatccatacaagtatggattagggtatgaacccgggatgccgggggggaggaacgtgccatcaagatttcgggcggatagggtatggcccggccgtattagccagtgtttcaccagcgctgggatggtgtccgaggaggaggtggccgcaatagaagaggagttccctcaagacccaccaagttttgtgcaaccatgccaccccgattcccaagtggggaactggcgcgtgataagccattcagaagtctatgccgctgattcaatatgtgagggtcgattctttgaggatcctaacaacgatcagggtttgacgatcgatttcgatcgagatataagccaaacgatgaacgaagaagaggaagatgacatcctgtcaccagagttggaaaggttggtcgctcaggaagaacgtgaaatgaagcctcaccaagaaaaaccgaattggtaa

SEQ ID NO: 38318 - DNA, 471 bp, Glycine max
  Peptide Sequence Number=SeqID_130003
atgacttgttttaggaataaggatcatgaaggaagcattgctgcctataggaaaccttccatcaaagtcgatttcatccacaaatctcttgaattcagtgtagtttacaaaagcaaaggtgaaacgaaagatattgagctggtagaggaggaacaggcacgggttggtgttgatccttctagtgagacctccaataaatctgagaattataaagaggaagcacggaatgcaacacagaagcataaaccaaagaagaataagacaggagattcaactgtgctgaagataggaaattcgggtaaagttgtgataaaccaagacatgaagggaagaaggcataaatatgggtttaacaacaacaaacatgagaaggcaaagaagaaaagggtggtggatgatgaagctggcgacaaacatcagctggatgaagtcctaaggattccatgtacatgtgtatttctgaagatatag

SEQ ID NO: 38319 - DNA, 204 bp, Glycine max
  Peptide Sequence Number=SeqID_130004
atgaattataccccatcgtacggaaagacatggttagcaaagcaaagagtgttggagatgattcatggaaattggaaagaatcatatgccaagctgtcaaaacttttgagagctttgcaattttgtgttcccaagactgtgggcgttgctcaaacagaatccgtgtttgagggagaaaaccataccgggcaaaagaatgcttaa

SEQ ID NO: 38320 - DNA, 606 bp, Glycine max
  Peptide Sequence Number=SeqID_130005
atgggtgatcaagaggagacacaggaacagatgaaagccgacatgaatgaggcagctcatggagaaaaacgcggcgaccgctgccgctgtcagttcggctgccgaagcagacccaactctcttggcaactgcgcaccatcctccctcaaacatagtaggacgagggaagggacacactggggcacgatggcaaccctcacctgggatacaaccgagcggcttacccttatggattgccgcccaactactcaccacccgtcttgcaagacgatgcgggccatattgcttctcccgtccttgaaagagagcctcctcaacagccccgacgaggtccacaaagatcctcaagactatgctcgaagggatgtcgagttctatcccccgattcccgaagggccggcacccagcacgttgcctcagcctaacatcacgacacaaccaatagtttcgtccacggaaggaccgcccccggcaactgaagaaaggaaaaagctcgatctcctcgaggagagattgagagccgtggaaggatttggggactatccgttcgcagacatgacagatctttgcttagtacctgatgttgttattcccccgaagttcaag

SEQ ID NO: 38321 - DNA, 378 bp, Glycine max
  Peptide Sequence Number=SeqID_130006
atggtgaaagttggaacctcttacgtgccgatcaacgtctcattttcgccaaaagttggcccagggcttcccggtatcaacagggacaccaggatttatttatctctgcgaaggctaccaggcttctgtttctatcagctgtccctccgttcagctactgacggggtggtgcgtaatttcgagcccggcgtaatcatgggcgctaactcacattccattcaggctgcgctcaactgttccgggaagggccgatcggtgcgggccttcgctattaatgaatcgccaacgcggcgaaagggggatgtgctggttgcgataagttgggtagccagggtgtcccatactggttactatgttgtaaaactgagaggccagtga

SEQ ID NO: 38322 - DNA, 363 bp, Glycine max
  Peptide Sequence Number=SeqID_130007
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttgggtgactgcgctcctccaagccaagcaagagattacgcgcagaccaaaacgatctcaagaagatcatcttattaa

SEQ ID NO: 38323 - DNA, 829 bp, Glycine max
  Peptide Sequence Number=SeqID_130008
gcgaattgggaccaactcttggctagcatggagaggcgtctgttaattggttccctcgctggaaggaaggaagaatcaggattctattctcatgcgaaggaggtccaaatgtccctggtaggaacgaggggttgtattaattacaatcccacgctcgctataagacaactagggtaccccatgaggggagcaccgacggaagaaagcatgtctcctttccttgtgagggatctcggcgcacaaaattccaagattatacaaagaatccataaggcatgggaaaccccgttaaggaaagatcaagagattagaggcattcgtaatggcatcattggtgggtaccacgaatggctgaaagttggcatacgaggtttagattggctcgccaagttaaaagtagtcagagaagaggattttgaagcaccggaagaggacgaagaagtccaagctctcaaaagagagttaggaaaggcaaaactccccaaagagaagttcaagtccatagccatcaaaggcagcaatagtaagatcaagctccgaagaggtgaaaggaatcatcacggggccatcatcgataagtgcaaagagaagctaaatctagcggcaactcacgagcaaaggctagaggatgagtacgccaagatatcagcagaaagggaagtaagggaaagggtaattgattcattgcaccaagaggcaacaatgtggacggaccgatttgctcttactttgaacaagagtcaagaacttccccgatttctagccaaggccaaagcaatggcggacacctactccgcccccaaggagatccacgaacttctcagctatt

SEQ ID NO: 38324 - DNA, 426 bp, Glycine max
  Peptide Sequence Number=SeqID_130009
atgcctcaaaatgttctttacgatgccattgggatatatcaacggtgttggaacctcttacgtgccgatcaacgtctcattttcgccaaaaagttggcccagggcttccccggtatcaacagggacaccaggattttatttattctgcgaagtgatcttccgtcacagcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 38325 - DNA, 240 bp, Glycine max
  Peptide Sequence Number=SeqID_130010
atgaaccacctgcaatcactgatgaaagtagctcagttgatgttgcgctatataagcggtgggaggtgggagcgatcaaaccgactcaacgtgatgttcattaagactaaaatctcaactcgaatacgtggttctattgatcagcatgaaaagactttagcaagcaccctgatcatgaagttctcctctcttcggctcaccagtgtgaaaggtgtgcataagtacataatgaaaatgtga

SEQ ID NO: 38326 - DNA, 522 bp, Glycine max
  Peptide Sequence Number=SeqID_130011
atggcccgcacgaagaagacaggggagataacgactgaggccgcaaaggaaatcgccgagaagattgattcgtttgaggagcaggccacacagggatcgttcgtcccccatggacgtccggatgttctggcagctgctattggacatccagagcaccctggacgtgtccgtgcagctggagccggtgtcaccatcaagcaatactttggatcggctccacggacgtcccacagcgcttcctccatgcctccttacgaattacagcagctgacccagcagattagggaccagctagaggagtccatcacagagaaagtgacgaggcaggtgagtgtggaggaggttacagatacagatgctccagttcctgtacccactgatgaggtttccttagtggggcaggcacttcacaccttccttgcttggccgacacatctggtcaagtctttatcacagcagttgtgtctccacccaaaccacctccgaagcccgatccggaggtcgatgatctgctttatctga

SEQ ID NO: 38327 - DNA, 465 bp, Glycine max
  Peptide Sequence Number=SeqID_130012
atgtatcaccatgaagtgagagtcatattgttgataaaaggctttaaatacactgtggctaatttctctgtgtctccgccaaaaccacctccgaagcccgatctggaggtcgatgatccactttatctgatgacattgaccatcccagagcttttcttgaggccttatcaggttagatgggatgccaccgtgttcggggtcgttaatccagatttccccctgtacataaagcacgaagacctctctgaaatcgcacacggtggtcaatgtctcagcatatcagtgttacagttgtggattctgcatctcactgaaacatgtatgcgagcggggaattctgatatctatggattcctcgagccacagtccattcagaggtctaggcaatcgcagtttgaatctgaaagttacataaagagtggatgcagagttcacaacgcgatgtgtatcttggagcctacctaa

SEQ ID NO: 38328 - DNA, 212 bp, Glycine max
  Peptide Sequence Number=SeqID_130013
gtatgctagaagtagtgtctaatccttggaggtttatagtagggaactggttatgtgactcagatctggttagtcctactggaattgaacgggttctaaccgaaaaagaccttctggctgacgcatattcagacctagaggcttctatccttgatgaaaaagaatttctcctattgaaaggttggggaatagacggtgtgccttctccataa

SEQ ID NO: 38329 - DNA, 231 bp, Glycine max
  Peptide Sequence Number=SeqID_130014
atgctgaaacctccagaaagggcgcagatgaccacattggcctccgctcctcaatcacacttggggtcactgaatgacgaggtgcggataaccgtaaggtgtctccgcgggctaccagcttttgggtcatgggtaacaaaaagcgggtgcggtccacaaaagcaaggcttttgctcctacgtatcctcaaatgagggaactcagacctccgtagttctggataacttgtga

SEQ ID NO: 38330 - DNA, 1005 bp, Glycine max
  Peptide Sequence Number=SeqID_130015
acctagcagcaatcgacgctttccttgcctaccaccatagcaaggaaagtccggtggtagctgtcttggcagatctgtttgacacatttgaccgaaggtgcgaaaagagtagcgcacggatcatctgttgcttatccgccctctgtgtttggttgatttcgcacttgttccgacaagacacaagacatccatgtccgcacctgagccatcgctcgtgcactgaaaagaggagaatagattgggaccagctcttggccgggataggaggtagaacaatcagttggttcccccgatggaaggaaggaaaagaaggagtccttttctcatgtggaagatacccaaacattccgctggtaggaacgaggggttgtattaactacaatcccgcgctcgctataagacaactagggtaccccatgaggggagcaccgacgggagaaagcatgtctcctttccttgtgagggatttcggcgcacaaaattccaagactatacaaagaatccataaggcgtgggaaaccccgttaaagaaagatcaagagcttagaggcattcgtaatggcatcattggtgggtaccatgaatggctgaaagttcatatacgaggtttagattggctcgccaagttaaaagtcgtcagcaaagagagttttgaagcatcggaagaggacgaagaagtccaagctctcaaaagcgagttaggaaaggcaaagcttgccaaggagaagttcaagttggccgctacacacgttcggaaggagtgtgccgggttacgggaagagaatgcaattaccgcacgagcccttgaacaagagaccaagagggctcgcaaggaagagtatggccggaacaaatttcgcggagctctatgggggtccaaaagaagcttgtctcagcgtttatgcgagacagagaccaacatgttagctatcatcgccaagtaccaagaagagttaggtgtagccacggcccacgagcatagaatcgcggatgagtatgctccaa

SEQ ID NO: 38331 - DNA, 596 bp, Glycine max
  Peptide Sequence Number=SeqID_130016
atggctacacgccctcgccttgcttttagaggacaacacatcatcgccatcagaggactacacgtcttcgtcttaagaggactacacgtccccgccttcagagggctacacaacctcgccttcagaggactacgcgtcctcgccttcacagggctacaagtcctcgccttcacaggaacacacttcctcgtcttcagaggactaaacgtcctcaccataagaggactacacgtcctcgcctttagaggactacatgtcctcgccttcaaagggctacacgccctcgccttcaaagggctacacgccctaaccatcagaaggctacccgccctcgccaagctttcagaggacaaaacatcgtcgccatcagaggactacacgtcctcaccttcagagcgctacactccctcgactttagaggactacacgtcctcgccttcagaggactacacgtcctcgtcatcagaggactacacgtcctcgccttcagaggactacacgtcctcgccttcagaggactacacgtcctggccttcagagggctacacgtccttgccttcagagggctacacgtcttcgccttgggatcctctaga

SEQ ID NO: 38332 - DNA, 270 bp, Glycine max
  Peptide Sequence Number=SeqID_130017
atgggtgaagtaaaggagatacaagagaagatgaaggccgacatggaggccattaaagagaaaatggccacaatgatggaggccatgatgagcgtgaagaagataatggaagcccatgcggttgcaattgccgctaccagcgttgttgctaagatcgaagtggatctgaaaagaggcaaatttaatcatcctgcttggacgaatgagaaaactggggcaaataaagagggtgaggatgagggagaaacccatgctgtgactgccattcct

SEQ ID NO: 38333 - DNA, 279 bp, Glycine max
  Peptide Sequence Number=SeqID_130018
atgttggtgcgcatgatccgcactcgtctctttgcagcggcacgggtgaaatcttgccccagtatgcatagtagcagtgtgatagcctccctctctagttgtgctcgcacagttggccctcctccaatatcaggggtacccaaggtgagggcgtgtagccctctcaaggcgaggacatgtagtcctctagaggtgagggcgtgcagccctctgatggtgaggacgtgtagtcctctcaaggcgaggacgtgtagtcctctcaacggtgagggtaactag

SEQ ID NO: 38334 - DNA, 315 bp, Glycine max
  Peptide Sequence Number=SeqID_130019
atgggggaggagcttgccacccagctcgcccaggcgagcaaggttgcttcctccaaaagcaacagccttctggaggaagaatctgaaaggcccaagggacagatgtcgtaccggatgtcacgacatcacgcttcagaacatgcagattgtatgtgtccgtatgaacagattaaacaagtaaataacacaagagaattgtttacccagttcggtgcaacctcacctacatctggggctccaagccagggaggaaatccactctcaatagtgttagttcaaggtctaacagcccctgtttacaaccttctcacctaa

SEQ ID NO: 38335 - DNA, 956 bp, Glycine max
  Peptide Sequence Number=SeqID_130020
atggcccacttgggagctctcgattccatggcgcggctcaacagagcagccgcaccgtcctacctatttaaaaactcgcccgcgggctccagctatcctgagggaaacttcggagggaaccagctactagacggttcgattagtctttcgcccctatacccaagtcagacgaacgatttgcacgtcagtatcgctgcgggcctccaccagagtttcctctggcttcgccccgctcagcatagttcaccatctttcggtcccgacaggtatgctctcactcgaacccttcacagaagatcagggtcggtcggcggtgcaacccacagggggatcccaccaatcagcttccttgcgccttacggagtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatg

SEQ ID NO: 38336 - DNA, 209 bp, Glycine max
  Peptide Sequence Number=SeqID_130021
atgggaacaaatcaaaccggcaagaggttctaccaagtcaaggtcaaaagcccagataccaccagcatcaaggaattagggcggttgatggaacccctccaaatgcaagccttccgcaagacttacggaaagatcttagagttgaccatagcagaatcgaattcctgcagcccgggggatccactagttctagagcggccgccaccgcg

SEQ ID NO: 38337 - DNA, 273 bp, Glycine max
  Peptide Sequence Number=SeqID_130022
atgggctacatgggcatcattgaggacttttatcaacagcgtacgatgaggctcggagtttatgagcagttcaagcaacgagatccttgctggagttttattcagttgctcgactaccttaaactcgctttattggatgaggcgaaggaactcatggacctcttccaaacccctcttaccactggaggatctacctatttcgagggggtggctacgtctgtaggctcttggaccatgggcgctttccccttggagggaaactccgccgggtga

SEQ ID NO: 38338 - DNA, 255 bp, Glycine max
  Peptide Sequence Number=SeqID_130023
atgggacaccttagtgatcaaggggttcccatgaaccctaagagaataaaggtcattcctgaatggcccactccaccaagtataagaaaaatttgggacttccataacttaacaaactttcatgatgtaagctccattggagcttgtaggcctaggatcttcttcatcaatggattcctttgcttcttggaagataaatggcagcagaatgcagaaggaagacagagaggagacgccacttcaaggagaagatga

SEQ ID NO: 38339 - DNA, 567 bp, Glycine max
  Peptide Sequence Number=SeqID_130024
ttttctaattcaaggagcagtgcaaatagcttggtgacaggagatgaagcaatcaccaatgatcaaacacagcaaattgagcccaaagaaattcgattttcacctgagcaatacaaagctctacttgccttaatccagcaaccaagtgaagggaattcagacagtatgtctagcagttcaaaacagattgcctcttgttcagttgatacaacaccagtccatgattcaggtgcaacagaccatgtgtcggcatctcttagttcttttaaatcatatacaaaattgaatcctccaatcctagttaagcttcccaatggtcaccatgtgtcagctacacattcgggtgatgatgcactcactcaagccaagattggtatagttgaaatgagaaatggattatactatctcactccaaccagaccagccacttgtagtattgaaacagaaattgttcatccaaattgtaccatcataccaatagatctatggcattctagattaggacacctgtcttttgaaagattacagaaaatgcaaggcacttatccctttctggaaattcaataa

SEQ ID NO: 38340 - DNA, 870 bp, Glycine max
  Peptide Sequence Number=SeqID_130025
gtttccctcaggatagctggagcccgcggcgatctctatcgggacggtgcggctgctctgttgagccgcgctttggaatcgagagctccaagtgggccatttttggaaaacaagaactggcgatgcgggatgaaccggaagctgggttacggtgcccaactgcgcgctaacctagaccccacaaagggtgttggtcgattaagacagcaggacggtggtcatggaagtcgaaatccgctaagggagtgtgtaacaactcacctgccgaatcaactagccccgaaaatggatggcgctaaagcgcgcgacctatacccggccggcgcgagcccgggcggagcggtcgtcggtgcagatcttggtgggacgggggaagcccgtctgatagcgctctgtgcgcgtactccgaaaggaatcggcctgccccaccctggaaacggctcagccggaggtagggtcagcggctggaagagcaccgcacgtcgcgtggtgtccgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaagcgaaaccacagccaagggaacgggcttggcggaatcagcggggaaagaagaccctgttga

SEQ ID NO: 38341 - DNA, 374 bp, Glycine max
  Peptide Sequence Number=SeqID_130026
caccgccggacatcagcgctggccaagtgtagcggtcacgctgcgcgtaaccccacccccgccgcgcttaatgcgccgctacagggcgcgtccccattcgccattcaggctgcgcaactgttgggaagggcgatcggtgcgggcctcttcgctattacgccagctggcgaaagggggatgtgctgcaaggcgattaagttgggtaacgccagtgttttcccagaattcgatcagaatgctactcacaatactgcggatcttcttatccatctccgggtctacttccctaggacttgttgcaaggctagggttgttcctggtgcggagatgatggtacagagggtgaaccaggagctgaagtttcttttggtgag

SEQ ID NO: 38342 - DNA, 216 bp, Glycine max
  Peptide Sequence Number=SeqID_130027
atggctaccgtcttcaccctgtaccccttcccgaaggatgtcagagatcttttggccgacactacgaaaaaagtttcatttgctaatccattcatagcacgatcgcaagcagtgactaacgtcgtcaccagcaccctttccagagatgtcagcgtcttccgaaccgagcactacgaaaaagcctcatttgctatccgtaagactaacgcacgatag

SEQ ID NO: 38343 - DNA, 522 bp, Glycine max
  Peptide Sequence Number=SeqID_130028
atggataatgaagagggcgtgcaagaacagatgaaggccgatctatcggctttaaaagatcaaatggcttccatctcggaggtcatgttaaaactccagaaaaccatagaggataaagccaccgcaaccgcctccagtacagttagggaagcggagccgatgctgcagcccgccttgaatccgggcctagatagaaacacggtccgtgttcggtcgaaggggcaactcccaccttatgaagactatcccgggcaagatgatggggaaagagatacccatcttggccccctactccacctcaaagatccatccccgcatgaactaccccaaccgaacatagtccgccatatcccggcctcacccacacccgtaaaagaatctgttccctttgcggaagataaggaaaagatagaggcgcttgaagagaggttgagagcagtcgagggcctcggcaattacccattctcggatttggcagatttatgtcttgtgcccaacatcgtcatccctcccaagttcaaa

SEQ ID NO: 38344 - DNA, 418 bp, Glycine max
  Peptide Sequence Number=SeqID_130029
ctgaacggtctggttataagtacattgagcaactgactgaaatgcctcaaaatgttctttacgatgccattggatatatcaacggtgttggaacctcttacgtgccgatcaacgtctcattttcgccaaaaagttggccagggctttcccgtgcgtcgggtgatgctgccaactttactgatttagtgtatgatggtgtttttgaggtgctcccagtggcttctgttttctatcagctgtcccctccctgttcagctactgacgggggtgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtt

SEQ ID NO: 38345 - DNA, 454 bp, Glycine max
  Peptide Sequence Number=SeqID_130030
cttgggaggattgatggggacccggtgttgagagaaacgagggatatggggctacgtgggagtccccccccctcagttggaggtgggcaacaggggatggtggggtttatgcgcgcattgtggatgtggaaaactttgttgtgcaccatcgcccgaccgccacctagtaccacatgtgatggagtggtacctggagatatgtcgcgggggtcaggagaccttggggacgtcaggcgagctcctggcagtcaacagataaaaggaacaaagaccacaaagcaaggaggcttgtggtggctggccagctgtgaatcttgtgtgatatatgggttatggcctctggtaatcgattaccaagggcttgaaaacgaggttgtagaggcctctggtaatcgattaccagtctgtgtaatcgattacacagaggaatgggtcactggtaatcgattaccag

SEQ ID NO: 38346 - DNA, 659 bp, Glycine max
  Peptide Sequence Number=SeqID_130031
tggtggagctcttggtgatatgactcctgttgaggctaggaatctaattgagaagatggcttccaactcccaacaattcagtgcaagaaatgatgctattgtccttagaggagtccatgatgtggccacagattcatattcatctgctgaaaataagaagcttgagggaaaacttgatgccttggtcaacctacaatctggagtcaatgagcaacctgaagcctatgctgcaaacatttataatagatcccctcagccatatgttcctcctccaatgcagcagcaacaacaaagacaacaagcaactaaggccccttctcaaccttccttagaggagttagtgaggcaaatgaccatccagaatatgcaatttcagcaagagacaagagcctccattcagagtctaacaaatcagatggggcagatggctactcagtcccaaaattctgacaaattgtcttcacaaactgtgcagaatccgaaaaatgtgagtgccatcaccttgaggtctggcaagcaaattgaagtgcctccaccagtagcagcacctgcacctgaacctgtcaagcttcattctacacctgaaaaagaggatgagctagctgcacaaaagagaaagcttcctgatcatgagggagctaacaaaaattttcatgcag

SEQ ID NO: 38347 - DNA, 742 bp, Glycine max
  Peptide Sequence Number=SeqID_130032
atggcgtcagcggttctggaacgccggcggtcggcgctgcaggaacgcgccggtgccttcgcgcatgtcctcggtggcgaacagcaggccgaactgcgcgctttcgtactccagccctgcctccaggctgcattcgccacccacgtgcacggcatccagcaggccacgcagggccagcggcgccgagcgcgccaactggcgggcgacatcctgcacacggttgtccagcgcgtcggcgggtaccacctcgttgacgatgcccagttccagcgcacgcgcggcgttgatcggtgcacccagcaggcacagctccagggtggcggcgcggccgcacaggcgcagcagacgctggctgccgccgaagccgggaatcaggcccagattgatctccggctgcccgaccttggccgtatcggcagcgatgcgcaggtggcaggccatggccagctccagcccgccgcccagggcgaagccgttcacgcgcgcgatcaccggcttgggcatgcgctcgatctggcgcatcagggcctggccgagcagggagaaatcacgtccctgaaccgcactgagtgtgttcatctcggcgatgtcggccccggccacgaacgccttcggaccggcaccggtcagcaccaccacgcgcacgtccgggtcggcagcggcggcgctgaacgcttcggccagcgcctgcagggtcgcggcattcaaggcgttgagcttgtccgggcgctggacggtcacg

SEQ ID NO: 38348 - DNA, 665 bp, Glycine max
  Peptide Sequence Number=SeqID_130033
tcaccactgctattggacgtccagagcaccctggacgtgtccgtgctactggagccggtgtcaccatcaagcaatacttcggatcggctccacggacatcttgtggctcctcctcactgcctcctgaagaattacagcagctgacccagcaaatcaaggaccagctagaggagtccatcacagaaaaagtgactcggcagctcatggcatcgtttagccagatgcagtcccagatgcaatctcagggacttgcactgccaccggagcctccacttggtccctcaggaaacgatcctgagacgggtgactcagataggtgcggcttgtacatcgaagcaaatcctgctcgcctggttgccctggggagagtttatgagggatccactgttgttcataacactcctttgttgcctggccaagtaaaggtgggtgtggaggaggttaaagatccagatgctccaattcttgtacccactaatgaggtttccttagtggggcatgcaattcacaccttccttgtttggccgacacatctggtcaagtttttatcacagcagacagttgtgtctctggcaaaaccacctcaaaagccgaatccggaggtcgatgatccgctttatctgatgacattgaccatccccgagcttttcttgaggccttactag

SEQ ID NO: 38349 - DNA, 555 bp, Glycine max
  Peptide Sequence Number=SeqID_130034
gcgcacatgaagggcatcacaggagcaccgtacagggcacgttgtgatggtttgaccgtcacagatgtgtcctggttgccgtacactgagcatcggggggttagggcatttcaggagatttcatcgttccagggtcagctcagatgtggtcctatgatcgtcacagttcgaccggagagggtggtacgccagttcggttacatccagagcatccctccgccgcctgttagtgcacgattgtcacacgatcagatagatgacaggtggatggagtttgcggatcacttactacctgcgggtcagctctgtctagtgcctgggcaagtatctgcggattacatggagtggtttttccgcatatctcaccctttcatgacaccgacccaggcaggtgaccagcagatggatgcaccagctgcagaccctgaggactacatacagccgcccagcccccaggatgattacgagggatatgaagcgattgcacagaggttggagcgtgtgctcaaccttaggatagtcattgcaggcacagagttatatgacattatgtag

SEQ ID NO: 38350 - DNA, 210 bp, Glycine max
  Peptide Sequence Number=SeqID_130035
atgaggctcagcctctgtttagataacgagacaaaagggcctgcggataaaccgtacagaatgaccaaacttggtctctgcttgtcatcgggcccgccgcctctggatgacaaaagggtgcgaataaccataaggtatctccgcgtatcatgggtgcagaatgaccaaacttggtctctgcttgtcatcgggcccgccgcctctggatga

SEQ ID NO: 38351 - DNA, 506 bp, Glycine max
  Peptide Sequence Number=SeqID_130036
ttgccctaagaagactttatgaggggtcaacaaccgttcacaacatccctttgagtcatgatcaagtcaaggtcggtgttgaggaagttagagatgcagatgctctcatttctatacccactcaagaggttcagttagtggggcagacacttaacaccttcgttgcttggccgacacatcttgtcaagcgtttattagaacaggttatgtgggatgctaccgtgtttggggtgtttaatgacaacttccccttttacataaagtatgaagatctgtctaaaacaacacatggtggtcaatgtctcatcatctctgttatacaattgtggattctgcatatgactgagacaagtatgcgagcagggaatgtcgatgtgtatcgattcctcgagccacagtccatacagagatcagggcaatcacaatttgaatcagaaagttatattatgaactggatgcataattcaaaaagggatgtgtacctaggagcctacttgaatggttaa

SEQ ID NO: 38352 - DNA, 561 bp, Glycine max
  Peptide Sequence Number=SeqID_130037
atgattgatgctgccagtggtggagctcttggtgatatgacccctgttgaagctaggaatttgattgagaagatggcttccaactcccaacaattcagtgcaagaaatgatgctattgttcttagaggagtccatgaggtggccacggattcatccttatctactgaaaataaaaagcttgaaggaaaacttgatgccttggtcaacctagtaactcagcttgccatgaataaaaaatctacccctgtcgcaagagtctgtggtctatgttcttttgcagatcaccatacaaatctttgtccttctttgcagcaatctggagtcaatgagcaacctgaagcttatgctgcaaacatttataatagacctcctcagcagcaaaaccaacaaaagcagaataattatgacctttcaagcaatagatacaatccaagttggaggaatcatccaaatctgagatggacaagtcctccacaacaacaacagcctatccctccttttcagaatgttgctggtccgagcaagccatattatcctcctccaatacagcagcagtcataa

SEQ ID NO: 38353 - DNA, 186 bp, Glycine max
  Peptide Sequence Number=SeqID_130038
atgggacaccttagtgatcaaggggttcccacgggccctaagagaataaaagtcattcctgattggcccactccaccaagtgtcgagggaaggagcacagagtatgaagaacctcaggatttgaggtcaaatcctttccaacatggaggggatgatgcaatcctaccccccaagggtattggatag

SEQ ID NO: 38354 - DNA, 697 bp, Glycine max
  Peptide Sequence Number=SeqID_130039
gaatgatagtaaggccttgtctacaaaggccaaggggaaggaaaaagaggaaaaggattcctccaagaagaatgttaaaaaggaaaatcattttgcaacaaaatgtgatatcaaaatagcactccttcttaaacaatctttctaccttctcctatcaagggaaacatcccttagcaccgccatacctcttgagcttgaggttattcctcaagtaaaagagttgttggatgagggtttcgtttgtaagagcttaaatccttgtgctttgttagtgcccaaaataggtattataagacaccaaatccctatgataggtggtatgatgaatgtgttgaatggtgcaaccctcttttgtaaaatcactcatgcacccaacatcttcatgatttgtgtacacagggactcattagatagtgatcaagggcttcccatggaccctaagagaataaaggtcattcttgagtggcctactccaccaagtataagggaaattttgggcttcaatgacttaacaaacttttacaaaaggtttgtcccatatttttctatacttgtagcaccactcattgagttggtgttgaggaaaaaacctcaaagtttcaggaacctcgggattttgaggtcaaatccttttcaagggggagggaatgatgcaatcatactctgcaagggcatttggatagaaaactccaagtag

SEQ ID NO: 38355 - DNA, 414 bp, Glycine max
  Peptide Sequence Number=SeqID_130040
atggatatctctaaagatactgacatccatgtaatattgggaaggccattcatgttgaccgcaagttgcatagttgatatgggaaagagaaagctggagctaggttttgaagatcagaagattgattttgatttgtttgttgaagacaaccctgctctagaacacaatggtttcaatttgttgagaaaaggactaaaatataacttagaaaacatttttctgaaaaaaagtcctttcgctaagcgcgaacctcacgctaagcacatctttggtcatgcgctaagtcgcgagtctcaagcccttaacgcccaacccttgcatctgaggttgattttgtccgctaagctggcaaaggatgagctaagccaacttcaatttgatctgaattcgtctaagcttcaacctgatcactaa

SEQ ID NO: 38356 - DNA, 570 bp, Glycine max
  Peptide Sequence Number=SeqID_130041
atggggagaagtatgattgatgttgccagtggtggagcccttggagacatgacccctgttgaagccaggaatttaattgagatgatggcttccaactcccagcaatgtagcgccaaaaatgatgctattgtcattagaggagtgcatgaagtagccaggaattcattttcatcagctaaaactaagaagcttgaagagtctgtggtttatgctcctctgccgaccaccatacagaccattgcccttctatgcagcaacctggagcaattaagtagcctgaagcttatgctgcaaacatttacaatagacctcctcaacctcaatagcaaaatgaaccacaacagaacaattatgacctctctagcaacagatagaatcccggatggaggaatcaccctaatctcagatggtctagccctcaacaacaacaacagcagcctgctccttccttccaaaatgctgctggcccaagtagaccatacattcctccaccaatccaacaacaacaatagccccagaaatagccaacagttgaggctcctctgcaaccttccctcgaagaacttgtga

SEQ ID NO: 38357 - DNA, 195 bp, Glycine max
  Peptide Sequence Number=SeqID_130042
atggcctcctatggtggtgagcttctttctagactcatcttctccttgaagtggcgtctcctctttctcttcctttctccattgcactgctattcatcttccaagaagcaaaggaatccattgatgaagaagatcctaggcctacaagctccaatggagcttacatcatgtggttctatcatttttcattcataa

SEQ ID NO: 38358 - DNA, 453 bp, Glycine max
  Peptide Sequence Number=SeqID_130043
atgtgtctaccggggaaggagactatgctgatgaattttctcataaccataaatgagattttggatgttagcatttcgtttctaaccgaccatttagaggaaacactgggtccaacaaaaatagaagaaaatcactcaaaatgtatcaatctcacacggctattgtctggtccaaagacctttctgcatatttcttctgttttcttccgatccttgatcgggaaatttctttcctccctttttttcccctcttcgattgggaatttcctttccttttttgctttctccccctcttcgattgggaatttcctttctttttttgctttcttccgagggcaaggattgacattctcaccctgggtcaaggtttatggtaagttgggattttggctcaaggcttgtagaaaggctggacatgacatatgtcagttttggccagcggtttgggggtaa

SEQ ID NO: 38359 - DNA, 159 bp, Glycine max
  Peptide Sequence Number=SeqID_130044
atgccacaccagaatgagtttgttggttactcgttcataggaaaaaatctcaaaaagtttgacattccttctggatgtacgatggatgaactgaaggatttgatcaagcaagttgcgcctcatgagattccctcttatggtattcatgaaacacaaatg

SEQ ID NO: 38360 - DNA, 300 bp, Glycine max
  Peptide Sequence Number=SeqID_130045
atgacaagcaagtgtgggaaaccggtcaatttaaagagggattgtcggatttcagaagaaagaacaagagctggtccaagtgggtctatgtctctgaaaagcaacaaggatgatgacgttgcttggtggtttgattcgggagtcaacaagccatttttaaataattatggtttcttggaaagacttcaagcataccttgaaacatatgaaggaagagtacatcttggttcaagacatggttcgtttgttggatttggttatcgtgagggaattgacaaagtcaatgataaaaccgcatga

SEQ ID NO: 38361 - DNA, 402 bp, Glycine max
  Peptide Sequence Number=SeqID_130046
atgccacctaccaggcaccctctagacccagataagtctaacagggccctgggttttccggcattgatcatgggtctctgccagtcgttcggggttcctgtcacacctagtaaagtgattcgactgccgatcacccgagctttcatagagaagtattgcatgccaagacaggcacagggtggcgacccgcaggcccctgacgcaccgccaccacttcatcaggcagatccagctgggtcatttgacacagagcggtatttacgacatttggttcaccagcaggcggccaaccacagggtgcacgtgcagacccatgactgtctctaccagctcagcctcagcctgcagagccagggtctcgcttcttttccatgccctactccggatcagttcagggcatag

SEQ ID NO: 38362 - DNA, 240 bp, Glycine max
  Peptide Sequence Number=SeqID_130047
ggccgcccgcacgctttaagggttgttgaaggtattgcactaagaaagactcctgccgttgctatgctaaaggaagagatcgaggatcacagcaggatcctatctgatctttgtcaacacagggactcgaagccccctgctcaaactaaaggggggggagccattgtgaagcctagagaggcggaagcggcaaatcgcttctaccgagttccacaacagcagcttagcttagtagcttaa

SEQ ID NO: 38363 - DNA, 111 bp, Glycine max
  Peptide Sequence Number=SeqID_130048
atgacaatgcatacaagtttgaattgcccgatgagtataatatggagaagccgaattgagagggagagagtgatgaggacatggaaaggactaaggaccaggaacctttag

SEQ ID NO: 38364 - DNA, 108 bp, Glycine max
  Peptide Sequence Number=SeqID_130049
atgtcggatacggagttttctattcaatcccttaaagaaatatgcaggatgtcggatgtcggtaaggaaatgttcgatcggcgtcatgcggtgatgcttcttttttag

SEQ ID NO: 38365 - DNA, 708 bp, Glycine max
  Peptide Sequence Number=SeqID_130050
atgatagttaaccaacaagtgaagattaccctcacccatcttggcactaaatttgtgttgcatcctcaaacaccttctcaggtggccaaagatcaactaactaagaaaaataagagggatgaagaagaaaaactagaaaaccaaaagaaaaagaaggatagtaaggccttgtcttcaaaggccaaggggaaggaaaaagaggaaaaggatcaagcacatgtagctaaggatcaagcagaaataaaactcaaatgggatgaggaaaagaatagaaaaagaaaagaagaacaacctttaatggttaaggagaagtgtaaggaggtaagtgtctcctccaagaggttagctaagaaggaaagtcatcttgcaataaagacaaacattaaagaattttcccttcttagacaatctccgcatcttctcctttgtaaaaggacacttgttagcactaccatacctcttgagcttgaggttattcgtcaagtaaaggagttgttggatgagggtttggttcataagagcttaaatccttgtgctttgttggtgcccaaaataggtattatgaggcaccaaatcccaatgataggtggtatgatgaatgtgttgagtggtgcaaccctcttttgtaaaatcatccatgcatccaacatcttcatgattcacatgcatagagactcattaggttggtgctcatgtgggacaccttag

SEQ ID NO: 38366 - DNA, 387 bp, Glycine max
  Peptide Sequence Number=SeqID_130051
atgcaccagaggaccagcataagaccacattcacctatccatttggcacctttgcctacaccaagatgccttttagcctatgaaatgctccttgcaccttccaaagtctatcaattctttgcgacaaaacatccacaagtgcgtaattggctgcatgatgggagaggtggtaagcctcctcctcagctccccaaatgcctctctacaaggctggtcgagcacaaaatgtacgtccttatgaaaaagccaggacaatggcacacaaatcttgctaaaatcctgaatgaatctcctgtaaaaacctacatgtccaacaaaaaaatacatcccgcacagaagcgagccttgaggagtttgatattgagttcagagacaggagtggtgtag

SEQ ID NO: 38367 - DNA, 327 bp, Glycine max
  Peptide Sequence Number=SeqID_130052
atgtttgcttacagtcctttcgctaagcgcaagcctcgcgctaagcgcatcttttgtcatgcgctagacacctattcactgaatatagctttaccaagtaacacaagttccctgagagttcgatactcggttcttaccgttttatactacttacgcgatccagtgcacttgacaggtgcagttgaaattaaaaatgaagttaccagcaaggtcttcaaagtgaacggtcgccaactcaagctttttcatgagagcccccaagtggaggaggaatttgttgcagacctctctttgatcttgccaattttatgtgatgatgtgccttga

SEQ ID NO: 38368 - DNA, 294 bp, Glycine max
  Peptide Sequence Number=SeqID_130053
atgtccgttcgcagccttgggctctatggctcagatcacatctatcccccacatggaaaagggccacggtgcggccaatacattcaatggcaagggtggagcgttgagattgtttgcaaacgtctggcatttgtgacacttccttacatggaggcaacggtcgctttccatggcatggcgtgcccgttagcgtgcataccgaaagagccctcatggacctcctccagcatgcgtctagcttcctttagtgttcacgcatcggagcaaaaccatgtcatggttgctcttgtatag

SEQ ID NO: 38369 - DNA, 353 bp, Glycine max
  Peptide Sequence Number=SeqID_130054
gtgaacaagccaccgacgcacagaattttggttggcaattgtcataccctaattttgtccggggacctttgcttgatgacaggcgacctttatttggtccttgcccacttggcccctccagaagattcctccagaaggctgttgcttctggaggaagcaacctggctcgcctgggcgagctgggcggcaaccatctcccctattttgctataaataggggaggaagtgaagaagaaaaggccgaggcgcttccgaaacgtttccgtaacgttttccgtgaggaatttcgcaaaggttttgaccgttcttcgacgttcttcattcgttcttcatcgttcttcgatcttcaacgg

SEQ ID NO: 38370 - DNA, 502 bp, Glycine max
  Peptide Sequence Number=SeqID_130055
atgtcaccacaagggaggaacacatggacagttgatgatctcgtgccttatgtggagaagataacgattttatccgaagagcaagagagaatcactgagattgtgacacatggtccagcatcagagcgtcgatttccaccacaagagtttcacatgcttcagtcaagtgttgaaactcgaggttttgacagacgaagggaggctgttgaagcgcaagaattttcccaacaaattgaggagcgtgaccatggaatgtattactcgccaccaacattttctcagtatccttcacagatgtatcagtatctgtttgaaggtcatcacactaatatgtctgcaagcgaacattcgtttggtggtgttgcagaaacacatcctcatttttcatggccgactatgaccccttcacaacaacatgatgccccaatggcaacacctaacgccccattagctctacaatggaatgcacccggagcaatacctgatatgagtgacttattag

SEQ ID NO: 38371 - DNA, 628 bp, Glycine max
  Peptide Sequence Number=SeqID_130056
agcacaaataccccacagaggaaatgaaattagtacttgctgaggagttaggattgacagaaaagcaaatatctggatggttttgccacagaaggttaaaagataaaagattgatgaaagatgaagctgttgctaatgggcgacaagatcgttcaagtggtgtcatccaagatcgtggcagtggacttgggcaagattcatgcggaagcagtaagcatgctgatcacaggtatctggatcctaaggaggttgagagccatggcctctacaatcacgaattgtcagttgcagatatgactcatggatgtctggatccatatgatatggagccttctagacatcttacacctaacggagctcttccacccctaaatcccaaaggtgcaattaacatgggacacaaaccatcaggatatttgaaagtgaagggcgagatagaacatgctgctataactgctgttaagaagcaattaggaaggcattatctggaagatggtccactacttggtatagaattcgatctgcttcctccaggggcatttgaatgccaaactgcagatccagctaatggcagtgaatgcttaaagatagaactgggtgtgataggggatgaattgtttatggaaca

SEQ ID NO: 38372 - DNA, 411 bp, Glycine max
  Peptide Sequence Number=SeqID_130057
atgaattttgcagcgagaaagcctgtagaattcaccccaattccggtgtcctatgctgacttgctcccatatctacttgataattcaatggtagccataaccccaaccaaggttcatcaacctccatttctccgagaatatgactcgaacgcaacgtgtgcttgtcatggagaagccctggggcattccattgagcattgtaggggcctgaagcgtaaggtgcaaggtctaattgatgcgggctggctgaaatttgaggagaatcgcgtgattttcaactttcaccagaattgggtgcaagccattggtctatttgctcaagcgacctgtgctcctgagtttggacttccaagaccattcaatcagagattactcgtcttgcacgttggtggggctgtcgtaagacaatga

SEQ ID NO: 38373 - DNA, 603 bp, Glycine max
  Peptide Sequence Number=SeqID_130058
atgacgttgctgctcagcaacatccagcccagcgatcataattctgacctccccctgccaaagtgtatgccacctaccaggcaccctttagacccagataagtctaacagggccttgggttttctggcactgatcacgggtctctgccagtcgttcggggttcttgtcgcgcccagtaaggtgatccgaccgccgatcacccgcgccttcatagagaaatactgcatagctagacaggcacagggtggcgaccctcaggccccagacgcaccgccacctcctcaggctgacccagctggttcatttgacacggagcggtatttacggcatttggttcgccagcaggcggccaaccacagggcgcacgtgcaaacccatgactctctatacagcttagcctcagcctgcagagtcagggttttgcttcttttccatgccctactccggatcagttcagggcaagaggtcgcatggcccggagattggcctgaggcccaagcaggggaggcacccgcagaggctcccggcgaggcagatgaggtctgcatggacgaggagatgaccgatttgcttgatttcttgggagggagcagagccacatga

SEQ ID NO: 38374 - DNA, 393 bp, Glycine max
  Peptide Sequence Number=SeqID_130059
atgcttctgtgcctgatgctgagaaaagatgttccaacatcttccaccccaagtgtttccgtgcctgatgctgagaaagatgttccaacatcctccgctccaaatgctgaagccctcccttcacccagtgaagaggaatcaacagaagaagaggatcaagcctcagaggagactcctgcaccacgggcaccagaaactgctccaggtgacctcattgacctggaagaagtcgaatctgatgaagaacccattgccaacaggttggcacctggcattgcagaaaggttacaaggcagaaagggaaaaacccccattgagaggtctggacgaatcaagactatggcccagaagaagagcactccagtcactcctaccacatccagaagaagcaag

SEQ ID NO: 38375 - DNA, 132 bp, Glycine max
  Peptide Sequence Number=SeqID_130060
atggggtgtagtgccaaggagaagaggagtgatgaggacatgacaaagagtaagggcaaggatccacttgaaggacttagaggacctatgacatgggctagagcaaataaagccaaggaagctcttcaataa

SEQ ID NO: 38376 - DNA, 243 bp, Glycine max
  Peptide Sequence Number=SeqID_130061
atgagcccaattttgtcagacctgaagagaccctacgtgagtggatgtgcggaaaaaggcacaggccatccagaagcaaaacacttcccccccccccacgtgttgtcttgtgggggttatgaatatttagaacaaaagctcatggcggagaagacaaagaaaagattggaggaagatccccagtccggaagcactgagggcgtcattgaccctccatctcccatcaaacgccacgtgaagtga

SEQ ID NO: 38377 - DNA, 251 bp, Glycine max
  Peptide Sequence Number=SeqID_130062
atgctgatgctcgcattcttgtacccactcaagaggttcagttagtagagcagacacttaacaccttccttgcttgggcgacacatcttgtaaagccttttttagaacaagataaactggcagctaaaggatcaacgaaacctgtagatatgtcggatcctatcgtcaatcccctgtatttgatgacattgaccatcccgcagcttttcctcaagtcgttgcaagtgtcgtgggatgctactgtgtttggg

SEQ ID NO: 38378 - DNA, 162 bp, Glycine max
  Peptide Sequence Number=SeqID_130063
atggcctcggcgggaagttccttgtcgtgttggaattaccggccgggcgagtcgtgttcggagttggaacttggggagcttccctctgggcattcccggtatgagccgagaagctcgggtgatgttgcgcgtactgatgggtaccatgaggtgtttgctggg

SEQ ID NO: 38379 - DNA, 256 bp, Glycine max
  Peptide Sequence Number=SeqID_130064
atccgacgacgagtccctcgaaggtactaatacttgggacccgaccatcgatttcaagcaagaaacagatcagacagaaggtgaagaagacgaagatgtgggacttcccccagagttggagaagatagtttcccatgaggaccaagagatggggcctcatcaagaagagacggaactagtggacttaggaatcggcagtgggaaaaaggaagtaaagataggcacgggtatgactgcaccatccgtgaagaattga

SEQ ID NO: 38380 - DNA, 615 bp, Glycine max
  Peptide Sequence Number=SeqID_130065
atgctgctgttggttgagttactaatggtctcagcagacgtggccatggtcgagacaggccaatgtggtggaccatacgccctacgtgacctcattcttgctgggcggtatgcatggggagctgctggcctcgtccatatgtacgatcagcttaataatgctagtctcagcaccagccgacagcttgctggttacatcaccttgttacaatattggatatacgagcacttttcgtcagttgcggagtgcaatgccgatttagactacgacgaggtgtcaggacgtacatgtcggtggattgcgacaaagaagactgtgaagaaggtatctacaacgacgtataggcagcgtctagatcgtttgaggatcccagatgtctgttggatgccatatgcggagcaccgacctatgcagtactttcatccaatttcgtgcttctcgggacagctccgttggggcctgttgttgtcagatacagaccagagagggttatgcgctagttcaactacgtccaatgcattcctgcacaccctatccattcatcggtgtcatatgatgacatggacgatacgtggacgcactactcagaccatctggcagcaacaagtgatctat

SEQ ID NO: 38381 - DNA, 322 bp, Glycine max
  Peptide Sequence Number=SeqID_130066
atgagtcatcattcatctagttttaatggtgagggaaggcataggtcacatcttagacctcaatcccataggagagaaaaggaaagaaatcctcaagaggctaacattaacctcccacactttctttggaaggacaatgtagaggctaacttggattgggaaataagggtaaagcaacaacttaaaagaaagtctacttcaaaatcttatggctctcactcttatccaaagaaagaccaaggtctaggaatcttaggggcaccaccttcaaagcccaaagatggtaaggggaagacaatagaaaagaaaccccctaaggcta

SEQ ID NO: 38382 - DNA, 225 bp, Glycine max
  Peptide Sequence Number=SeqID_130067
atggaagggattaaaggtttgctatgtagtgagaactcccaagggtggtcgcacataacattcaaagtagggactaccagcgacaacatatcatcaaagagaaaaacactagatgaggcttcactgttatcaagcaagtcgaagacccaacataaccacaaatcaacctccacttcgtatgtctccatggacccagatataggtagacagccacacccaacataa

SEQ ID NO: 38383 - DNA, 168 bp, Glycine max
  Peptide Sequence Number=SeqID_130068
atggcagatgagcatgatcagaggactactcttgaggactattcaagtggctatgtaccacaatttttcactagcattgcacgtcctgaagagaggccaagaggtggctccactcattcaacgacaacagtcttaaaacctgggaagaagtggtggaaaaatttctaa

SEQ ID NO: 38384 - DNA, 325 bp, Glycine max
  Peptide Sequence Number=SeqID_130069
atgtcgtctcgagtttcgaagcgtattacagagcaagagtctggtcaggacctgctcgaatcgaaaagagaggagagtctttaagaaggaattcccaggttcaaaggagtattttcgaagtacaaagctaagacaagaaagaggacttcgagttattgggcatttcgaactggtgtatggacgagtcgaagtaatttctgaacaaatcttcaccaaattagttcgatctcgagtaatgtggataaccgttctagggagcggttatatgtgcatgcaaggtgtacgtagcaggatacttggcgttaggatagcgttcgaccgttag

SEQ ID NO: 38385 - DNA, 814 bp, Glycine max
  Peptide Sequence Number=SeqID_130070
tccgagaagctattggacacgttctgcaggtgggaaaatcaaattgaagacccctgaagaagccatggatctcattgaaaatatggttgcaagtgacattgctattttgagagatagagctcacattcctactaaaaagagtttattggagctaacctcccaagatgcattgttggcacaaaataagttgatgtctaagcaacttgaggcgttgtacgatgtaccatttgtgggggagctcatgaatctagatgttgtatccctattgaagaacaacccactcatgaagtcaattacatgggaaatcagcccagaaacaattttaatgcaggaggattttctggattccaacatggctagcaatacagtcaacatcagggacaatggaggaaccaccctagaaatcaatttaatagagatcaacgtttctatttataaccagaagagcacagagtctgccattaaaaatctggaggtccaagtgggacagcttgcaaagcaattggcggatagatcatcaagcagttttacagctaatacagagaaaaatcccaaggagaagtgtaaagatgtgatgactagaagaagaatggcaatccatgtagatgagagtgaagctaagaagaagatggaggaccataaacaacaactggaacctaagccagcacttgaatccatttctgattttgtagaacttgaagagattaatgaggaggctgaagatgataaggaagaagagacaccaataaaagagaaagaaaaagaaagaataaacgaagaagaaaaagaaaaaagaaaaaaagttgaaaaatga

SEQ ID NO: 38386 - DNA, 261 bp, Glycine max
  Peptide Sequence Number=SeqID_130071
atgacccaagagctggtagcccgcggagacaccttacggttatccgcacctcgtcattcagtgaccccaagtgtgattgatgagcagaggccaatgtggtcatctgcgccctttccgaagatacacagtcgtgtccgatggcacgcagagacaaattatggtcattctgcacccttcgtcaatcgtggccgacaagcccgttcacacgcggagatttacatcatcttccgcacttacaagatctatcatactgacttttga

SEQ ID NO: 38387 - DNA, 243 bp, Glycine max
  Peptide Sequence Number=SeqID_130072
atggcggtgcgtctgtttcccgctgccgaccatcccaatgctgctgtggtgtttcgccctgcgcctgtctggggcgcaatacttcttgatgaaggctcgattagtagggggcctgatgcccttgctggaggactgatagaggcccgtaaccagagctggaaaccccagggccctgttggacttttccgggtccactggggggagattggcattgcggtcgctgggcagaatgttgctaagtag

SEQ ID NO: 38388 - DNA, 899 bp, Glycine max
  Peptide Sequence Number=SeqID_130073
atggcagaggtctccacggaggccatcgcccaatattatgaccagcctttaaggtgcttcacctttggggacttccagttaacacccacagtggaagagtttgaagagatcctgggatgccctctggggggaaggaaactatacctcttctcgggattctatccctccttagctagaatttctaatatagtcaaaatctcgacacaggaattagaccgcagaaagcaagtcgaaaatggggtggctggggtaccaaggaaatgtttggaagcaaaggcgagagtcttggcgagtcaaggtgaatgggccccgttcatggacatcctgacacttttgatcttcggggtggtcctctttccaaatgtggatgggttggtggatcaggcagcaattaatgcttgttttgccttttacgaccgcaaggaaagcccggttgtcgctatcttagtcgatctatacgacacatttgaccgaagatgtgagaagaacaatgcaaggatcatttgctgtatgtcggccctttacgtatggttggtttcaaacttctttcgccaagagatgagacacgtttgcccgttagaaggccaccgctcatgcactgagaaaaaagaggcaaattgggactggctcttagcaaacaaagagggagcgtctgtcaattggttcccccgatggaaggaggggagaaccggggttcttatttcgtgtgggaaatttccaaatgttcccttgatagggacgaggggttgcatcaattacaatcctgtcctcgcgataagacaacttggttaccctataagaggggcgccatcagaggaaggcctcatgccttttattacacgaggtttcaatagcaccaacgcgggggtgcttcagaggatccacaaggcatgggaaat

SEQ ID NO: 38389 - DNA, 255 bp, Glycine max
  Peptide Sequence Number=SeqID_130074
atggcatcaatacggctgtccagcgagtcaaagcgctctccgacaaaggtgtggagtccatccagaagagactacatttgcaccaatagagaaggatctcctgactttgacaaagggctcagagtcaagagggacattaaaatgttgaagaaacaaggtaatcagatggggatatgggagtggagcattggattgcagtgccttatgcatgcgatatctcacaagatgggcccagtcgatttgtcgaccggttaa

SEQ ID NO: 38390 - DNA, 45 bp, Glycine max
  Peptide Sequence Number=SeqID_130075
atggctcgtgctagccatcagtggtcgtgggtggtggagaagaag

SEQ ID NO: 38391 - DNA, 126 bp, Glycine max
  Peptide Sequence Number=SeqID_130076
atgccgccgacctttaatgttggtcaagaattatatgtcggcatggaatttgatagtaaagatgcggtcaaaaatgaactcaaacaatatgttatgaaggcatggtcagagaagatccatcaataa

SEQ ID NO: 38392 - DNA, 414 bp, Glycine max
  Peptide Sequence Number=SeqID_130077
ttggaaaccccagggccttgttgggctcctccgggtctactgggtgtcttgtgggcgcgatccctgcaaataatagatggcatcagaaatcagttggaccatatgcatacttacctatgtcgggacggcacagaccaactgatacttccgcagggggagatcgacattgtggtctgtcgcaacatgccctttcgcgggcgagcgaggcaaggctcacgggtgcgctttccaaaggaggaaagatgcgcggagtcgccaccaacgtttatttgtggaaaacgtcggaaaaaccgaggggaactggtcacaatgaaaattcaaagttcggggagttgtatttacgtttgaggaaggtcgacaaaagcggggcttttgctcctacgtaccctcctttggagaggaaatcagacctac

SEQ ID NO: 38393 - DNA, 255 bp, Glycine max
  Peptide Sequence Number=SeqID_130078
atggaaagtatctcggaaaggaagaacagaggccaaggcttgcggttgggacaacaagccaaagggcccccgccctgccacatcagtagaagctttataagtgcaggtctaagacacgaaggccaagtcgccgcgatatgcgaggatgactcctcgaggagatcggatttggtacggccatgtcctcctggtttccgactaggaaattggcgagtggaggagcgcccagacgtttacgcgacaagcataatgtaa

SEQ ID NO: 38394 - DNA, 60 bp, Glycine max
  Peptide Sequence Number=SeqID_130079
atggagaaaaacgaagaaacaacaatggaagagaagcggaagataaagaagaagaggtga

SEQ ID NO: 38395 - DNA, 171 bp, Glycine max
  Peptide Sequence Number=SeqID_130080
atgtggaccaccacgggggagatgcttgccgcccagctcgcccaggcgagcagggttgcttcctccagaagcaacaaccttatggaggaatcttctggagggcctaagtgggcctggttgctatttgcacccccatttttactaagtacaccccctgcccttttttggtga

SEQ ID NO: 38396 - DNA, 294 bp, Glycine max
  Peptide Sequence Number=SeqID_130081
atgggaagcaaaaacctcaaggatggaatacttacttgttggagtgaattgaaacaccaaaaacgaaagcaaaacgcgatcaaaagcggcttaggggagcaagaaccgggttgctcgcctaggcaagctcagctcgcccaggcgacgacgttctctgcttcgtttagcgccgggaagggcaacgattgggtcggccgtgaccccatccccacttgcatccgtccctatgtaccagcaagtaggaaacaaaaatccgtggccaatcgtgtccggtcatcgtcttaccttggttga

SEQ ID NO: 38397 - DNA, 297 bp, Glycine max
  Peptide Sequence Number=SeqID_130082
atgtcagttctagaattgtacatagaaaaggatgtggctggtggttcaatgtttcattctgcaaattcccttacatcatgtggaaattatgtatctaatgattacacacaaccgccaacaaatatgagcaatttaaatcttgacgaagatgatgatcatgatgatgataattatcttgtgtctaactcatacgttgaagagttgttagacgaagatgacagtgttgacggtatatcagatacagacaatgaagtccccgagatgattccaccagtaaataatatcatacaaatgtaa

SEQ ID NO: 38398 - DNA, 132 bp, Glycine max
  Peptide Sequence Number=SeqID_130083
atggccttagaacaagagcttgtgagggctttcatcattgtggtggggtttacgcagtttgtttatccacgtgtatgtgtcatgtggacaggaggtggcatcactggaattggttcacggttttttaagtga

SEQ ID NO: 38399 - DNA, 207 bp, Glycine max
  Peptide Sequence Number=SeqID_130084
atgatgacaaaggtggtgaacaaaaagctcaaaagatcaaagaacaacttaagtgaatcaaagaacatctcaagtaaatcaagaacaagtcaagagttcaagaatcaaggagaattcaagactcaagaagaaagcctagaatcaagaatcaagatcaagattcaagactcaagattcaagaatgaagaaaagactcaatcaagataa

SEQ ID NO: 38400 - DNA, 273 bp, Glycine max
  Peptide Sequence Number=SeqID_130085
atgagtcatcattcatctagtgttaatggaaagggaaggcataggtcacatcttagacctcactcccatagaagagaaaaggaaagaaagcctcaagaggttaacattaaactctcatacttccatgggaaggacaatgtagaggctaacttagattgggaaataagggtagagcaacaacttaaaaagaagtctacttcaaaatctgatggctctcactcttatccaaagaaagaccaaggtcaaggcatcttagggggtgacaccttctaa

SEQ ID NO: 38401 - DNA, 339 bp, Glycine max
  Peptide Sequence Number=SeqID_130086
atgaccaacacagtggtccctgtaagatcgaataaggaaaaatcaactggacctgcaaatggaggtccaataaccctattagccgctatccctggttgtggttgttgctctagcaaatgttgttgtcgtcgcttgtcatcacagcgcgtaaatttgcgggagggaaatatcattgtagagaggggttctaaagggggagaagtgacgagaaggagaaaggaagggaagggtttttggatggaaagagaagggaggagggtcttattcagggagaaaagaggtgggggcacagctaggggtgggaaggaggaaggaagagggaggggtgagaaattttga

SEQ ID NO: 38402 - DNA, 550 bp, Glycine max
  Peptide Sequence Number=SeqID_130087
atggcagatgcagagccctcatcagaaagagaaatcctagcaagggaggagcagcagctggatttcgtgatgagcgttggaatagtgaaggaatgtgagttgagcatgccctacagagctcaactcaccggcgacaagtccaacttgttcttgttgcgagtgccagagtttgaagatatcctcttggatttcctggaggaaagggaagacgttagagaggggattgaagtgaatgtgtatgacaggggagggcacgagttccagatgatgctgaggaaatgcgaggggaatggcaatgttttctacgcgctgaaccgagttgctacgtgcacccagcaaaattgttggggcacccagcaaacagtgaatgggcaattatatcctctgagaaggctattttcggaagaactttcttccggaacactttcggaagactgtgtttccggaaaagttccggaagaatttcagaaaaacttcccgaagaagtgtcttccggaagattttcggaaaagcagtcttccggaatacttcattcttctttcggaagaag

SEQ ID NO: 38403 - DNA, 63 bp, Glycine max
  Peptide Sequence Number=SeqID_130088
atggagtgtgaacccaggtgtatgcttgctcaggataaacaaatgggaaatgaagagtgttag

SEQ ID NO: 38404 - DNA, 324 bp, Glycine max
  Peptide Sequence Number=SeqID_130089
atgccaccattcaacgatgttgaatcacacttttttagtagtggagtttggatcgtagatcttgaaattggacaacactgtttgcttgtgcagatgtccctacccgaatatgaaagaacaagcattagatatggagattcacagccaactaatactgcaagatgggaacattccactgctcaaactagacctttacttaacctatatgactcacaacacatagataccaagaagcatagaagtggttccaggggcgaaagcagtcagaactctgaatcaagtgacacccaagaaccagatttggagttaagactatctctttga

SEQ ID NO: 38405 - DNA, 399 bp, Glycine max
  Peptide Sequence Number=SeqID_130090
atgactaatgtaaaacagtttgcaagaatcattgcattcagtctcaaacaggaatctaaggtgtgtgatgagggtttgtgtgtgtgtgtcatgagggtgatgagggtgggtgtgtgtgatcagggtagttttggtgtagtggtgcttgagagtgtaagtggacttaaggctatggattttaggcaacctgaggtgctattggtaaaaaaggttcatcaatttaaggtgagaaaaaggacacttgaggcattagcagatatgggactaaatggagagtacaatttgaaggagttaatgacattggtaagcttaggagctgcacgcacccgttctgacccaaaattaagaccaaccactagacagatagtgggttcagtcaaattgaagaaaaaagggtag

SEQ ID NO: 38406 - DNA, 285 bp, Glycine max
  Peptide Sequence Number=SeqID_130091
atgggtggaaaccttggattgttacctgagaggttgttgcaacaacgtaacaacctcattattcaggctatggttgaaaggttatccagtgtgagcatgatttatatcccttcgggtagagtcaagttgatgcaagctccattggagcttataggcctaggatcttcttcatcaatggattcctttgctccttggaagatgaatggcagcggaatggagaatgaagagagagaggagacgccacttcaaggagaagatgagtctagaagaagctcaccaccatag

SEQ ID NO: 38407 - DNA, 201 bp, Glycine max
  Peptide Sequence Number=SeqID_130092
atgggaaccacttcctgctctatcataggttgccaaacaaaacccctagagtcacttcctcccatgcccaatgcagaatcagaagcagtagacatagcaggggaaaagagtgtacttgaagtgaagttgcaatcgaaaaaggaaagggataaattaaagaaaacccagaattcacaaagcgctacagttggaaatatttga

SEQ ID NO: 38408 - DNA, 557 bp, Glycine max
  Peptide Sequence Number=SeqID_130093
ggataatcactcttgctaaatctgtgctagcagcagtccctacctataccatgcagaatctttggttgcctgaaggaacctatggcaagattgactcttacatccgtgctaatgtcaaggcattgcttatgaacattgcccttcatgctaatactcgagaaatttacatgttgagaccaggcagtgatggtatttacacaactccttctgcctatagatggatttcacaagagcctaataggaagctcaaacttgataacagcaatgacttccattcagtagatgttcaacattggcttcattcacagtttcaactcccgtcgggtatcctctttgcttgcgcctcttggcaactatggaaggctcgaaatgatgcagtttttgaagataaacacacaaaggttcgagatggggaagaagagatcatgaggatacaagtatgttggttcaaagtggggatgcaatgtgtacaaggggagacacttggtgttgcgagcacaggaaaaaaaaggcaacctttactatttgaatggacaagccttgaagaggaaccatga

SEQ ID NO: 38409 - DNA, 699 bp, Glycine max
  Peptide Sequence Number=SeqID_130094
atgaagcttaagcagttggaaggtctcctcggtggtcttcaacagttccctcaacccaaggtcgagcttgaacagtacccaacaggaccccatatagcttctcgaatgcttttcactgtgttccctctttccctttatttaccatggattagggaaagatggggaggttatgtttcctttgctgttcatgagaatcaggcagagaattcttttgaggatgtgagcgacaaagtagtggctgactttggatgcggttgtgcattgatcagacatgttcttggcattgacattgatccagaatctcttgaaatagcttccaataatgctgaggaacttgaggttgacatcgattttattcagtctaatgtcatggacttgggatggagaggtcgaattgttgatacagttataatgaatcctccatttggtactcggaaaaaaggtgcagatttggattttctctccgttgctttgaaggttgcttctcaagctgtttattccttgcataagacttcaacaagagatcatgtgaaacgaacagcattaagggatttcaatgctagcagtgctgaagttatatgtgagcttcgatatgatgtaccgaaaatgtacaaatttcataagaagaaggaagtagatattgctgtggacctctggcgttttgtaccagcagcaagtcatcaaagcagaaatacttga

SEQ ID NO: 38410 - DNA, 244 bp, Glycine max
  Peptide Sequence Number=SeqID_130095
gaaaaatccttttcaagaaggagggagtgatgaggacacaactaagggcaaggaccatgaagcacttgaagggcccatgaccagaggcagacttaaacaggcccagcatagtgatgaggacacaactaagggcaaggaccatgaagcactggaagggcccatgaccaaaggcagacttaaacaagcccaacacatcacagagacaaggctggttatttgtatagctgccattgaggatgattga

SEQ ID NO: 38411 - DNA, 186 bp, Glycine max
  Peptide Sequence Number=SeqID_130096
atggcgatagcagaagctagtaaggaaactgtgtggttccacaagatcaaggagttgatgacatctggtcagattttgctcagaaaggttcacacttcagataatgcagttgatatgttaaccaaggcagtcacaactaacaagttcaaacattgtttggacttgttaaacattgttgagtgctag

SEQ ID NO: 38412 - DNA, 282 bp, Glycine max
  Peptide Sequence Number=SeqID_130097
atgtcggtgactctgcacacaaacctaggcgacatcaagtgtgaaatcttctgcgacgaggtccctaaaacctccgagaattttttagcgctatgtgcaagtggttactatgatgggactatatttcaccgcaacattaagggttttatgattcaaggtggagatccaactggaactggcaaagggggaaccagtatatggggcaagaaatttaacgatgagataagagaatctctgaagcattccatagatatgttggaagaggcagaacatagcatatga

SEQ ID NO: 38413 - DNA, 141 bp, Glycine max
  Peptide Sequence Number=SeqID_130098
atggaagaagaattctctcttcaagagaagaatattacaatgaagatcatctatttctcaaccctgtcttctggtaatcgattacacttcctggtaatcgattaccagagccttgcatgtcttgaaagcactttgttttaa

SEQ ID NO: 38414 - DNA, 90 bp, Glycine max
  Peptide Sequence Number=SeqID_130099
atgggttttccaaggttagtgtggacaaagtggatggatataacggagatgagatatgtcattgcatcacggtacattgaaggtagttag

SEQ ID NO: 38415 - DNA, 102 bp, Glycine max
  Peptide Sequence Number=SeqID_130100
atggcagcttcaggcgtggaggaaggaacgaagaaaagaagaaagaagccagaaagcaagtttgaaaagaagaagtcaaaattttcagcagcaaccacatga

SEQ ID NO: 38416 - DNA, 2500 bp, Glycine max
  Peptide Sequence Number=SeqID_130101
atggcttaccgaaacggcgtcgctctggctcagaggggaagtgccgttaagttcgaacgcccaaaccacctcagaacgccgtcgtcgcctaagccccgcttccctcactcgccgggatccgccgtccgccgctccacctccgccgcagctagaagcggagacggagtgcctggaagagttcgagtgtctgtaaggttgagacctcaaaatactgaagaaatgatggctgatgctgattttgctgactgtgttgaattacagccagagcttaaaagactgaaacttcggaaaaacaattgggattcagatacctatgagtttgatgaagtgcttactgaatttgcatcacaaaagcgtgtttatgaagttgtagctaagccagtagttgagagcgttcttgatggttataatggaactgtgatggcttatggtcaaactggaacgggcaaaacttttactcttggacaattgggggaggaagatacctctgatcgtggtatcatggttcgttctatggaggatatcttagctgacatatctccaggaactgattctgtcaccgtctcatatctgcagctttacatggagactctccaggacttgcttaatccagcaaatgataatattcctatcgtggaagatccaaaaactggtgatgtgtctttgtctggagctactctagtggaaatcaaggatcagccaagtttcttggagttgctaagagtaggggaaactcatcgaattgctgccaacacaaagttgaataccgaatcttctcgtagtcacgctatactgacggtacacgttaagaggtctgttgtggacagtgaagatgttgtttctactgaaaataatgatgcctctcacttgactaaaccttcaaaaccacttgttcgaaagagcaagttggttgtggtagatttggcaggatcagagcgtatccataagtcaggaagtgaagggtacatgctagaggaagctaaatctatcaatctttcactaagtgcactgggaaaatgtattaatgctctagcagaaaacaattctcatgttccatttcgtgattcaaaacttactagattgctcagagattcatttggaggaacagcaaggacttcattgattgttactattggcccatctccacgttatcgaggagagacttctagtaccatattgtttgggcaaagggctatgaaggttgagaacatgctgaaaataaaggaggagtttgattataaaagtttgtctcggaggcttgaggtacaattagataaccttattgcagaaaatgaaaggcagcaaaagacttttgaagaagaagtcggaagattaaatttggaggcacaatgtcgtatatctgaggttgagaggaaatttgctgatgcattagagtatgagagaaaggtagagagagaaacagtgagtgggtggggggatgcatctgatgtccaatctatctacttcacaagattcctagaagagatgagtgaaaatgagctatggtatgagtttaagaaatggggtgatatgcgtgaggtgttcattgcaaggaatagaaatggcaggaggtatggctttgtgagattcaagggggtgggcaatgtgaggagacttgaaagacaattggataacctgatactagggatgttgaaactacatgttaacataccaaagcacggaagagtgagaatgttaaggggagaaacaaacagaaatgtcaaatacaggattgaggtaaccttggataaatcatgcgatggggggaaacatcaaggtaacctggaaggggtaacggaacagcagccccaacgaaggcaaatgacaacctcatatgcgagagcgatggtgtcaggcaacaaaatcgtggggcaaagactgaacctaatgcgtgcgagtccatcgggaacaaactcgtactcgttagtgcatctgaacatacctgcggaaaaatggacatggctcagtaactcatgggttggaagattgaaaaacttggcgatgttcgatagagtgggagacaaactcttgtggaatggtggagaagatatcaagccaaaatacttagaagatgacatggtattgttagtgggattcacagatgacaaagctatacaactggtgcaagggtcacgtgcttgtccacaagataaggagggtgacaggcccttaatgggccttactaaaaacaccaatactggaataagtgaaggggctgatggcaatatggtaggaaaagcaaatgggccagcaagcgcgatgaaagtttattccaaaatcaaagggtgtagaaagcaaatgggctacatcagagtagatgggcttgttgatgagatatcaacaaaatcaaacagaaaggaccaaaaggaggctagaagcacaccaaatacttgtgataaatactcaccagtaacaagaggcaatggtttgaaggaagtggctgaatgggaagaacaggataagggacagcatgcaccacgtgctctaccaaatagcaaac

SEQ ID NO: 38417 - DNA, 1596 bp, Glycine max
  Peptide Sequence Number=SeqID_130102
atggcgtgggcgtgtgcggcttcacgtcgtactagtgggggcatttctcgccctcgtaggaggacgcgacctttcactgcttttagggagcctatcctggttattgtgatcttcccctattttgcttctgggggtgtgaggagaggtagtggcggtggagatgttagggcatctcctcgcactgggttgtcatcatccacacctgtcgtcgctagctatgagtgggttaagctagcaagccctgaagacacttgcaagttagtcgttcaggcttgcgggagtgatgacttccctttctggaaggcggcgtcaggcagtccaccctcatcttttatgtatatgtgtctctttgaggtcttgggtcttattctccccttgatcgctttcccatatgctctgcttgaacacttgaatgtggcttcttctcagctccacccaaacatttgggatatgcctgaccctaccaggttcaagttgtttgacgaggatttgttgacccttatagagagggtcaaaaaagctagtttttcggcgagtgatcccctcactaccgaggacggtattataggtgacttcgcctggaggccactcgtgaaacaggtcacctctagtgccccttcctctattttggaaaagaggaaacaaaattatggtgttgggtcatctagtcgtaacaagtcaaaggtgtttatgagccttcgtgccctaagacaagctgtagggttggcgcacagtgcgggtcacccttcgatcatggaggatgtttctttggctccatcgaccatcgaggctcctactactgttgtttctgctgtacttgttcagaaggccactcctgctactggtgttaacgtgccagccacttcagctggttctgttgtcgttccatcgtccaccatcactgcatccttgttcagctcatgtagtgttggtgtggcgactgcaagtgctcatatagtgtcgcctcctccttcttcagctccaccctttgttgtattggcgatggcgtcaccttcctcatcttcttgtcctcatgtctcattagatcacctgtacacctcaagcgatactaattcattgtgggggtgcaaacttcgacaaaaatttgattcagttagccgaggtgcagaatgctacaaattctgccaatgtctttctccagagaagtttggcgattctagaggagaacagacaacgtcactaaaaggctttgcaccgggtggcgtccttagaggcggaggttgccaaatgaaggagataaaggacctggctggcaaggtggagggcattgtggcaaagagggacaagctcacgaaggtggttgctgatttagaggcccaacttaaggagttggagtctagtctggaggggcaggctagattcttcaccaaggaccttgacttgggtctctttgatgctttcaaggacgtgaaggatggttttctacttgacgaggaagaaattactgcaaatgaggaggttgttgatgaggagcagggttctgaggagcaaggcgatgatgccactgttaggttaccttttgtttatcttcttttcttttgcatggttggatttttggccatacaggccttgtaa

SEQ ID NO: 38418 - DNA, 456 bp, Glycine max
  Peptide Sequence Number=SeqID_130103
atgagggaagcacaacggcaacgcatggggagagggagaggagagtggacatggcaatggagcagggcggggacaagtattatctccccaatccctgacctcgactcccccaacatgtttccatacccgtacccgatacccgacgagttaaaatttattatctcatccctgtacccgttgggtatcggtggcgggacgggttcgggttgggagttgggggcggatgcagtaatcccatattcgacttttggttatcagagaaaatctgaactcgaacccatacccgatcaactcgggtattactcatcaaaatcaggacatatacggatggatacctatgggtacggattttcttgcatgtgtagaggagagggagaaccttttaagattttaagtgaagtgaaggacaagtttgccacttcacttaaaattatggtgcatgtgcggtgcacctag

SEQ ID NO: 38419 - DNA, 225 bp, Glycine max
  Peptide Sequence Number=SeqID_130104
atgtgtgcaagcaactctcaacattcacctcaaccattgaaggatgaagggggaaagggaagtggagttgtggaggagggttggtgggtgggtgaccacaatggtggatacatcttgatgaagccgccacaagtggtatacaatggaaggattgttggaaaagaagggagatattttcttcaaaaagatagaactgacaaattgatacctagttacttgacctaa

SEQ ID NO: 38420 - DNA, 171 bp, Glycine max
  Peptide Sequence Number=SeqID_130105
atggctcgtattctagacaagatacaagacataaatggatccaaagaaaccctgaaacttgctgtcaggataactgatctttggtttgtgggaacaccgaacaagcctgagcaagctgagatgggagaccaaattcatgcggtttgtaagcgagaccaactcaagtcttag

SEQ ID NO: 38421 - DNA, 546 bp, Glycine max
  Peptide Sequence Number=SeqID_130106
atgagagagtggtttgctttcagactacaatgcagatcaaatgaagcccaaactctgttgcactctaggaaattattccagcaatttgtagttgaaggatatactatggttgaatcagaaagactttccttcattagaaacaatcaaaacaaacttagagttgacaactattgcaatttacaagagtcattggatactggttccaccagaggcttacataaagttgatgatgaaaatgatgcaagcttgcatgttgcaagccatcatgatgagatcaaagaatatctagattgcatatacatttctccctgtgaagctacttggaggatctttggttttccaattcatggcaggaagcttgctgttgaaagactgcatttccaccttccaggacaacatgctgttttttatcaagaccatgatgatattgacgatgttctatccaagccaagcattttcgattcaaagttcatttcttggatgaacactaataaaaaaaaagacattggaaactcaggaaaaaatgatacactattgggaggctaa

SEQ ID NO: 38422 - DNA, 279 bp, Glycine max
  Peptide Sequence Number=SeqID_130107
atggaaaacgctaaggtggtgaacactcctcttgctactcattttaagttgagttctaaacagagtccatcaattgaaactgagaaattagatatgcaacgggttccttatgcatatgcgatggaaagtttgatcgggagctgtgacttggcagtccaagcggtagaagtgtgtagctttgtctactacaaaggcaaaattcatgtatattacctaagcatgcaaggagttgctatgggtgaagaaattcttgtaggagtttggttctgttcaggataa

SEQ ID NO: 38423 - DNA, 408 bp, Glycine max
  Peptide Sequence Number=SeqID_130108
atgtctatgccacacattttcaactacaatgttgtagtcctgatgcgcacaccaaatacacatggtctagggagcacttcaaagacaaccttgggaattaatgcaaatttcacttcattttctggcaaaaaggagaaaaattggaaggtgcagcagctgcatgcactcagtgcgttatcagctcgtccaacgagtcaattgtctattctggtgcttaggatgcctggctcgctaagccaaagttcacttactcgtgctaagcgtgaaaatggcactaagcgcaccttcgaggacagaaagccctttttaaagcctaaagtgaaaaatcaaaaagaggaagaagagagtgcggagaacagagaacagaggcacaaaacagagcaaggaagcaaaaaccttagcttctaa

SEQ ID NO: 38424 - DNA, 466 bp, Glycine max
  Peptide Sequence Number=SeqID_130109
atgctccaaccatatgagatcagcataggcttaaaggagcactcaaacccggtgacccccaaggcctacactccgaagagtccgtcagggcctctccctcctgattcagacagctctgggtttctgcgggaaagaaaaagactacaatgcgaagggtttttctctcagttcagacatgatattgaaattcccaacggtgagaatgctcggaattgtgttgcgaacatgatactcaaatttcacgacgatccaacggtgaacgggttcgagatcgtcgtttttctgagactgggaagccggagcttcaggcaacgccttcttctctctactctctcctccactcccattctcatcgaggacattcgcgccgacgagacatggcctggtctccgaaaccacgaaatttcactccttcgactcttcgaaaccgtctgcgacgattgccacgtcgaaatcaacgaaaccg

SEQ ID NO: 38425 - DNA, 890 bp, Glycine max
  Peptide Sequence Number=SeqID_130110
gaattacaaatgattctaaagatccatctattgataccttcaagtcaactactttacctatattgaagcgctttggagttccatttgaagacttggagcttaaagtagagagtcgtggattacctcccaatggtggtggtgaagttgttttgtctgttccagttgttcagaatctaacggcggttagttggattgatgagggttttgtgaggaaaattagaggaactactttttcaacaagagtgtctgttcagtttgaatatagcatgattaaatctgcccgtggaatcatcaatccgctggtttctgatgtgcacattttctctgatcacagatcaggtccagaggcgggaaactctcctggatatgggatttcgctggttgcagaaactacgtctggttgcttcatctctgcagatactgctgtttctcaagcaagggatgaagatacttctggccttgcagatgatgcaaaaagagacttgatgcctccagacgatatcggtgtggggattgctaatgctttagtaggggagatagctcaaaatggagtggtagattcaacacatcagggtttgttatttcttctttgtgctctatgccctcaagatgtttccaaggttcgtgtaggaaaactttcccagcatggagttgaaactctcagaaatctaagggattttcttgatttgaagtttattatcaaaccagatccgaactcacagtcggtttttctaaagtgtattggttatggcatgaagaacctttctcaaaagaatatttctctgttatgttctgaatgctatcatagggaagtttttcgtgagagcatcactgtgaatgagtgtgtggatttgtttttagaggctgaatatgatagtgtgcatgaatga

SEQ ID NO: 38426 - DNA, 435 bp, Glycine max
  Peptide Sequence Number=SeqID_130111
atggcttcaatggcatcttcaagctccttctgcaacctcaagtttatcaccaaacccaacaacaatggtagaaccaatgcttcttctcttccccgtattgtattctgtcagaagcacaacgatgacacccccaccgaccaaatcaaccgaagagaactcatattgagaagcagtgaaatagcgaccattggtgccatcttcaacttcggtgggaaaaaacctgattatcttggagtgcagaaaaacccaccagcattagctctgtgtccggcaactaagaactgcgtgtcaacctctgagaatatcagtgatcgcacacattatgctcctccatggaactataatcctgaaggtaggaaaaaacctgtgagcagggaagaagcaatggaggaacttatagacgtggtaataaatgcaactgaactgaaatcttga

SEQ ID NO: 38427 - DNA, 327 bp, Glycine max
  Peptide Sequence Number=SeqID_130112
atggtgaagctaaagcttgggagcagagaaaacaagaagagtcgtttagggctgagagtagaggaaggagtacctacagggatccacacgacaacatcgttgaacgccactacggccatggcgatctctcccacacgcgtggtgaggagcttgagccccgctaggatgcgcgcgagcatagggaatgcgatgatagaaagggcgactcccatgaagacgaggatgccgcaaatgaaaggaagagaggttctgacggcggtgatgcagaattcttatcggccgctccggcgaatggagtggagatcaagctccagacccaaaagctag

SEQ ID NO: 38428 - DNA, 806 bp, Glycine max
  Peptide Sequence Number=SeqID_130113
atggttagaatacgaggtttaggtcgtgtgttaggagctggtagaggtagaggcattagtgaggatgcgcatcaggctgatgatcctcggcgtcgtaggcctactgcttcagcatgtaggcaacgggttcatctgtgtgaggacgtcacagagagacctgaggatgtgcctcagttgcatgaggatgtttctcatgtgtctgatgccaccccagagatgataggcgccgccgatgctgttcagacaaaggaagtggcaactgatgggagcttggggtcacctactgcagatgagggattcctcggtggaccacgcgacccatcgattttgaccgcttttgctgagcatgtcgcacacagcatctggagtggacaggtctcccatggtagaaaagtagataaaattgggagaccagcgcttgagatcgaaggcatgattgctgccaccggattgagtccactgatcaggtgttctgttatcaccactgatcttggactcatatccgccttcatcgagaggtggcatcgcgagactagcacgttccacctgccagtaggcgagttgacgatcacgctggatgacgtggcgtcactcctacacgttcccatcactggcgcgctgcataagttcgagccgctggttacttcagacgcgattggtctactgatggagcttcttgaggtcagtcatgaggagtctacatttgagacccgacaggctggtgggcctcatgtccggttggggtggcttcaggacttgtatgagagccagtgcagggccagacgaagggttgtagcagccctcac

SEQ ID NO: 38429 - DNA, 498 bp, Glycine max
  Peptide Sequence Number=SeqID_130114
atgttagagaccgagccgaagagcaaaaagataaaacgcattcatggcggcgtcgatgaggacttgagcaataagcaccctttgcaccacgacgtgcggatgcggaactgggggaaatgggtgtcagaaatccgcgagccgtggaagaagtcgcggatatggctaggcacattcccaacgccagaaatggcggtgtgggcgcacaacgtggcggctcttagcatcaaaggctccgccgccattctcaacttccttcactttgccaactcgctcccttgcccaacttatctcacgccgcaagacgttcaagccgcgacggccaaagtggtgcacatggacccttcttccctctcctccctcgtaattaaattttaccactgcaaggtaaaaaaaatgcaatgctttccggtgaaccactcagatgttgacacatggcagtcaacgtctgaggttaacggtcaacgttcaattgggacgttcaggaccaattttgcataa

SEQ ID NO: 38430 - DNA, 352 bp, Glycine max
  Peptide Sequence Number=SeqID_130115
atgtcctcgagggaacaacatggccatgctccgacacgacaacctcggagcgggaaaaaagtgttttcttggcgtcgtgcggttcttgcttggtctgtgggttcggtgaatctagggtttatggagaaaattgggttggaaaagggggattttgatttatgggtgaaggtagcggtgttcagtgttgcggcggtcgtcgacgacatacgaggaggaagtgatactgaaatgcaacatctcatgaaacttcttgaacgggatcagtatattcattggcacagaataaaggatgaagacgtggttcgtgatatcttttggtgtcaccctaatgcagtgaagttagtcaacgcat

SEQ ID NO: 38431 - DNA, 336 bp, Glycine max
  Peptide Sequence Number=SeqID_130116
atgtgcccagaagaacacgacgcagcatttgagactggtccggcgagcttccggtggccggaaggcggcgtgtggtcttcacgcgctggaatgggcgcaagctggtggcggcgcgtggctgggaatctggccacgcgacttgcagggaagtttacctcaatagtggttgtattagcagccaccaaagatatgtgcatgatgagaaatcctaagacgctcagtgcaaaggctaggtttaaaactgcaggtgttccaggaatttctccatcgctaaagaatgttatgaaatgtggcagcaaggatgcagtcactagagtcgtctcaagaaaagtgtag

SEQ ID NO: 38432 - DNA, 501 bp, Glycine max
  Peptide Sequence Number=SeqID_130117
atggaggagggtactggctggggtggtaagaataagtgttcaacagaggagctggcaacggcggtggcggtggtggctgcaccgaagaaagctaatgagatcgagtttgaaaagcatggagacttggattgtggcaaaacaaagttgagatgcatggagatcggaatccatggaagtttaggctatggcgaggttgccttgggttgcggtgaggttggccatggcggcctccaggcgatccaggctggcggaggaagaattgagggagcaccatggctatcccctaacagaatagtgggcttaaggcagttccttattggtctggtagtcgctaggctgctattgctatcacaatccaactcaaggtatgcaaaccccgaattcgaacccattctagttaggaaatcagcacacacatttccctccctcaaggaatgttttaacacaacattccaagtattccttaagagttcttgcacactcgctataatggaagcataa

SEQ ID NO: 38433 - DNA, 477 bp, Glycine max
  Peptide Sequence Number=SeqID_130118
atgcagaagacaaacagagaaaaaggaatagttatagaagaattagacactgatgatgagggggctgataatggccctgaaactggagaaaaagattttgataagaaaacaaagaagctgacacaacaactggccaggcaacacatagggtcactagaggaatccatgacaaggaggcttgactcagatggtaacgttgataccacacaaacactccacaatcttaatgaagatgagcttgtaggatttgaagaagcatggaaaggaaataatatggcacaatttcccggatttaatgtgcataggaaggaggagcacaacaacgtagcagattctagcagtggcaagcataacagaaacccggtttggccacttcagtatttggagccagcaggaagatcaagaggatttccatcaaactatgaggcaggaaccaattccgggggcagaacaaagaaagttgctcatgctgcttag

SEQ ID NO: 38434 - DNA, 420 bp, Glycine max
  Peptide Sequence Number=SeqID_130119
atggggttagcgtggcaaatggtaattggaggattggattgtgaaagcacgactgagattgagaataaggagaaaaaattgaaaagcaaaggatggagatggtgtcgcatagtggaagggcctcgtattggatcgaattcagaacagggtcatgaacttgcgaatctttcttcgcgaaccagctcccctcggggcggtgatgtgggtggtggtgatgttgctccatcaccgttgaagttgcatctcgatggtggattgaacacaaacccagcgcacgatagcgacattgccgagcagggtggtgtcattgtggtaggggatctcgtgacaatggttgtggcggagaagggcatcgagtttggagatcgtggaggcttgagttgcagtgaattcgacaatgacgtcctcaaggcggtctaa

SEQ ID NO: 38435 - DNA, 174 bp, Glycine max
  Peptide Sequence Number=SeqID_130120
atgcatgcattagttttaggggttagatgttcgacagagggtagaactgcagctagagatatagcccctatcaacttggaaattgaagctacttgcaggcgtaagaacgttggaagaagaagggagcaagaagcacaaggaagtagtcacacctcacctcctccttctccataa

SEQ ID NO: 38436 - DNA, 264 bp, Glycine max
  Peptide Sequence Number=SeqID_130121
atggaatttctggtcggggaggtggaggaacacaccgtactcgtcattgttgtcgaggttgggcttgcgcttggtctagacgagctggaggacgagggggcggcgcgtgcagatgtcgttgccgcgggggaggaagtcgcggccaacaaaggcttcgaggacgctggacttgtcgttgctccggttgccgacaacgatgacttgggggaggtcgatggtggattggctttcgacacgggcgaagatgtcttgaacctagctagg

SEQ ID NO: 38437 - DNA, 255 bp, Glycine max
  Peptide Sequence Number=SeqID_130122
atgaaccagatccagatacacgctccagacgaggggaagacgacattcatcactgaagatttcaacttctactacaagagcatagcccaacatgtggcatacctggaggaagtctttggagagctccacaaatatgacatgcgcctcaactcagaaaaatgcactgctattttggagatgcacagtcctactaacatccaggaagtccaaaagatgaatggaaaactagcatccctgactaggtttctcccctag

SEQ ID NO: 38438 - DNA, 672 bp, Glycine max
  Peptide Sequence Number=SeqID_130123
atggaggtggcacttgtaggactagctggactgtccttggttatcgattgcatctttgtgattgtgtttctatcttcctcgatgttctgctttgtctcttcttctatctgcgtcgtgattcctatcctgctcctcatggtgtccttcgagtctcgctcctacttgtatttggtcgcatctaaccccggcctgggaggttttatcggaggtagcttgatgggtacctccaagttgaaagcctcttcaaggattatagtgcaattggttattaaggatgtcttatctgacttcattcttgaatatgggcatttcttccgtcttgatgtagcctttggctcgttcgcgcaactcgtcgatgctactagggatctggacaacaatgcgtccaaacctatctatgaatttatggagagattcatcatctctttgttgcagactgaccaggagtccaccataccaggtcagtgtcgcccctttaagggacgtatggaagacatgacacacgattgcatcgtcattgcttggtattttagcttccatgatgaggtcgacaaatgggtgtcgatgagtagtccgccttataggacggcaatgtgtgagcggaatgctcgtcgccttgggggcatctggcacgagcctccagctgatcatggtcaatcttctgctttctaa

SEQ ID NO: 38439 - DNA, 231 bp, Glycine max
  Peptide Sequence Number=SeqID_130124
atggatgaattcattgaactgataaacgaacataattgggaaatgttgggatgcttgagtgcccacctggctgtagccatgactaattttgcacgttgttttcaaatcatcattgtcacgcgtgccttatggaacaatatggaagttcagcccgaaatcgacaccttgatacccaaatttgattcgccccagatatcaagattgggttcccacgataaaagaccccattga

SEQ ID NO: 38440 - DNA, 253 bp, Glycine max
  Peptide Sequence Number=SeqID_130125
atgacaagcagagaccaagtttggtcattctgcacccttgtatcatccagaggcggcgggcccgatgatacgcggagataccttacggttatccgcacccttttgtcatccagaggcggcgggcccgatgacaagcagagaccaaagaccaagtttggtcattctgcacacatgatacgcggagataccttacggttatccgcacccctttgccattcagacacagtcgtgtccgttggcaagcagagaccaa

SEQ ID NO: 38441 - DNA, 426 bp, Glycine max
  Peptide Sequence Number=SeqID_130126
atgaggcagcgacaaactcatctacatcatctgaaactaagaagcttgaagcaaaatcagccacaacagaacaattatgacctctccagcaacaagtacaatcccaggtggaggaatcatcccaaccttagatggtcgagtccttcacaaaagcagcagcaacaacaacagccttattttcataatgtcgctggcccaagcagaccatacgtccctccaccaatccagcagcagcaacaacaacaacagcaacagccccagaaacagcaaacagttgacgcccctccgcaacctttccgtgaagaacttgtgaggcaaatgactatgcaaaacatgcagtttcaacaagagaccagagcctccattcagagcttaactaatcagatgggacaattggctacacagttaaatcaacaacagtcctag

SEQ ID NO: 38442 - DNA, 351 bp, Glycine max
  Peptide Sequence Number=SeqID_130127
atgtaccctctcttgttctcagtcacaacaacccaagtagatgtaccctctacctttaccacaaaggatgtatcctccagtgtgttaagacaaagttctcaggcggttagtccttcaaaactttgtgaagggggaaacaaaagaattctcaggcgggaagaatcaaaagaattctcagaccgtgtcgttttgaattctttgacaagggagaagggagacacaaaagaattcaggcggttagtccttcattcttttggaaaagggagaagagagacacaaaaagaattcaggcggttagtccttggcgaattctttttggcaaagggagaagggaatgaaaaagatgaatag

SEQ ID NO: 38443 - DNA, 552 bp, Glycine max
  Peptide Sequence Number=SeqID_130128
atgcggattttgcttccacgatcttccaaccttgcccaggtttctgaggaagatcttgttatcatgtgggcctttcataccgagcgtcaacttgactgggcacacttagtcagatatcgcatgcataaggcattgcaattaaatgctcctttgccatatccacaccttgttactctcttttttcgccattttcaaattcctcttgattctgaaccttatgttccaatcaagagatcttttttaattggtgctgctgtgattgcttcttttggttaccgcaaagagcatgatggctcttgggtcaaaaagggtgctcaacccgctgatgatgaaggcaacctaccaactgaagatagttcctctcttcttcgaaagcttctggacaagttcgatggtcttcaggcttttgttggtgacaagtttgatgccatggaattgcaagtcgacatgcggttcgatgccatggaatcaaggatcaccaaagttgaagaagatgtctccttcatccgtacttgctttgatccaccaccaccacctccatcatcctcttag

SEQ ID NO: 38444 - DNA, 884 bp, Glycine max
  Peptide Sequence Number=SeqID_130129
agtagattgggaccaacacttggctgggataggaggcggaacagtcaattggtttccacgatggaaagaaggaaaggagggtgttctcttctcatgtggaagctacccaaacatcctgttgataggaacgaggggttgcattaactacaatcccgcgcttgctataagacaattagggtaccccatgaggggagcaccgacggaagaaagcatgtctcctttccttgtgagagatttcggcgcgcaaaatttcaaggctatacaaagggtccataaggcatggggaagcccgttaaggaaagataaagaactttggggcattcgtaatggcatcattggaggttatcatgaatggctgaaagttcgtacacgaggtttagattggcttgccatgctaaagattatcaacgaagagaacttcgaagctccggaagaggatgaagaaacgtccgaaaaagagtgtgtcgggttacgagaagaaaatgcagctaccggaaaagcccttgaacaagaaatcaagagggctcgcaaggaagagcatggccgtgacaaattccgtggagcattgtccaaaagaaacttgtctcagcgtttatgcgagacagagaccaacatgttagctatcatcaccaagtaccaagaagaactaagtctagccacgacccacgagcatagggtggcggacgagtatgcccaagtgtacgcggaaaaagaggctagagaaagggtgatcgactcgttacaccaagagacaaccatgtggatggaccgatttgctcttaccttgaacgggagtcaagaacttccccgattgctagccaaggccaaagcaatggcggacacctactccgccctcgaggagatccacggacttctcgactatt

SEQ ID NO: 38445 - DNA, 240 bp, Glycine max
  Peptide Sequence Number=SeqID_130130
atggcctcatcaaactttctatttcccgaagcgaactctattaataggcctcctatattcaatggtgtgggttatcattattggaaaacccgtatgcaaatcttcatagaggctatagatttaaacatatgggaagccattgaaaccagtccttacatccctactatggtagcaagaaatgcaactatagaaaaacttagggaacaatgggatgaagaagaaacgaaaatggtacaataa

SEQ ID NO: 38446 - DNA, 120 bp, Glycine max
  Peptide Sequence Number=SeqID_130131
atgttgttgaagtattggcgactagaattgccattccttggattaaagggtttgtcataccctaatttcgtccggggacctttgcttgatgacatgcgacctttctttggtccttgtgag

SEQ ID NO: 38447 - DNA, 81 bp, Glycine max
  Peptide Sequence Number=SeqID_130132
gcctcaaaaattcatcgtaggctaggctcagaccttttaaagcctggtttgacctggcctattcccacccctagtcatcat

SEQ ID NO: 38448 - DNA, 258 bp, Glycine max
  Peptide Sequence Number=SeqID_130133
atggtgtcacaaacaaattttcattgggacctaaagggaaaaaggttacccttacacctatgtctccaagtgagggagaacactgaagtggatggaaagcgcagctccaaatttgtcaaagccttctctgagtcgaacaagcaagcgcagctccaatccatccatgacaatctcaagaaaagccttctttcgagtctagggtttcgagcagggatagggacaacgatagaagtagaagatgaagtcggagtagagtaa

SEQ ID NO: 38449 - DNA, 417 bp, Glycine max
  Peptide Sequence Number=SeqID_130134
atgttgaagaacggtcgagaatcttcgcgtaattactcacggaaacgttacggaagcgcctcggcttggattttcttcatggaaataattttcctcagcaatttcgagagagagagaagtgccaagaaggttgaacttgaaattctgataccaatgacagatgtcgtaccggatgtcacgacatcacgcttcagaacatgcagattatgtttgacaggtaacatcaaggtggctcacaaaacactcaagtcccaaaactcacaaaataactcttcaatcccggacttggtccagaactcgtgcagccttcatgtttatatagcagtgtgcgtatctgggctgcaacaacttgcgctggatgagatctatcattctcctgaaaaatctgcacttaaagaactaaaagataaagtttga

SEQ ID NO: 38450 - DNA, 1632 bp, Glycine max
  Peptide Sequence Number=SeqID_130135
atggtaccaactattgaagagtttgaggaaatattaggatgccctcttgaagggagaaaaccgtatcttttctccggctttcttccttccttgagcaagattgcagctgtggttggagtttcagcaaaagagttggatcgcatgaagcaaactcggaacagcgtagtgggcctgcctcagaagtacttggaagacaaggcaagggatatggcaagccaagagcagtggggcccgtttgcagatattttagctttgctgatttttggggttgtcctcttcccgaacgtcaacggtttggtagacttagccgccattgatgctttcctcgcatatctccatagcaaggaaagtccagtggtggctatcttggcagatttgtttgacacctttgatcggaggtgtgagaaaaatagtgcacggattgtctgttgtttacccgctctctgtgtgtggttgatttcacatctatttcaacaagacacgagacacccgtgtccgcttcaaagctatcgctcgtgcaccgaaaaaggaagagtcgtttgggaccaacatttggctgggatagggggcagcacgatcaattggtttcctcgttggaaggaaggcaaggaaggagttcttttctcgtgtggggactaccctaatattccattgatagggactagggggtgtattaattataatcccgtactcgccataagacaactagggtatcccatgaggggagcaccaaccgaagaaagtctctcgcctttccttgtgagggatctaggcgcgcaaggtctcaaggttatacaaagaatccacaaggcgtggaggagtccgttgaggaaagacaaggagcttaggggcatccgaaacggcgtcattggaggttatcatgggtggctaagaattcacacgcggggcttaggttggctctccaagttgaaaggtgtcaatgaggagaaatttgaagctccggaggaagatgaagaagtccgagctctaaaattggagctagggaaggcaaggctcgccaaggagaagttcaaatcagctgctacacacatccagaaggagtgcaccgagttacaagaggaaaacgcggccactgcaaaagcccttgaacaagaaaccaaaagggcccgcaaggaggaatatggccgagagaaattccgaggagcattgtggggtagcaacaatgagctcaagctccgaagagaagagagagatcggtcacgggtgcatggcatgatcttaaaagaagagttagttgcttgcgcgaggtccaaaaggaatttggatcaacacttggaaaccaccgagcaaagcatgctagccatcatagggcaatacaaggaagaattgaaccagtccacggcccatgaacaaaagttagtggagggttatgcacaagtgtatgctgaaaaagaggcaagagggagggtgattgatgcgctgcatcaagaagcgactatgtggatggataggttcgccttcaccttgaatgggagtcaagacctcccgcgtctattagccaaagcaaaagccatggccgaagtgtgtactggccccgaggagattcatgggctagtcaattactgtcagcacatgatagatttgatggcccatatacttaggactcgttag

SEQ ID NO: 38451 - DNA, 324 bp, Glycine max
  Peptide Sequence Number=SeqID_130136
atgaaggcccaagtggagaaggatgaaggcccagaggcagagacactatcaagactattaattgttgctgaaggcccaaacttatcttcctttaccggaagtggcgtctaccccgacttatcttccttcaccggaagtggcgtctaccctgacttatcttccttaaccggaagtggcgtctaccctgacttatcttccttcaccggaagtggcgtcatccaaatcttcgtagcctgtatcaaacgatccgctcctactcaggttcacatcaccagctttggacaaacggaaagcattgctgcaaggcgacccaatatcctttaa

SEQ ID NO: 38452 - DNA, 113 bp, Glycine max
  Peptide Sequence Number=SeqID_130137
atgaataaacaagttgggcccggtccgccatctgattgtgaggcatcgacagccttcccagactacaattcggacgccgagggcgaccgattttcatggtgggcttttcccgg

SEQ ID NO: 38453 - DNA, 363 bp, Glycine max
  Peptide Sequence Number=SeqID_130138
atggtgtatccagcagacggtctttcatcagtaagcgatgtgctagtctttgttggtgaatacctatctggtgttcaagtctccggtccttgtccttctattagtggtgcgtccgctcactggccctttgaatctggagatgtagttgcgtgtactgattctcatcgagattgggttggtcttcagtgtaccgcttgtgtagcctatgcgaagcgaacaagcaagggattgaggcgaaagccgcgttcgcgcattcgtttgtttgggtacaagatcgaaaagaatgcattggatggatgcccgggcattgagaaggaaggacgctttcagaggcgaaaggccatggggagataccgtctgtga

SEQ ID NO: 38454 - DNA, 935 bp, Glycine max
  Peptide Sequence Number=SeqID_130139
ttggttcccccgatggaaggaaggaaaagaaggagtccttttctcatgtggaagatacccaaacgttccgctggtaggaacgaggggttgtattaactacaatcccgcgctcgctataagacaactggggtaccccatgaggggagcaccgacggaagaaagcatgtctcctttccttgtgagggatttcggcgcacaaaattccaagactatacaaagaatccataaggcatgggaaaccccgttaaggaaagatcaagagcttagaggcattcgtaatggcataattggtgggtaccacgaatggctgaaagttcatatacgaggtttagattggctcgccaagttaaaagtcgtcagcgaagagagttttgaagcaccggaagaggaagaagaagtccaagctctcaaaagcgagttaggaaaggcaaaacttgccaaggagaagttcaagttggccgctacacacgttcggaaggagtgtgccggtatggccggaacaaatttcgcggagctctatggggtagcaatagtgaactcaagttgcgaagggaagaaaggagaccagtcgcgagcacatagcatggttctgaaagaggagttgattgcttgttcaaagtccaaaagaagcttgtctcagcgtttatgcgagacagagaccaacatgttagctatcatcgccaagtacgaagaagagttaggtctagccacggcccacgagcatagaatcgcggatgagtatgctcaagtatatgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccacccccgaagagattcatgggcttctcggctatt

SEQ ID NO: 38455 - DNA, 279 bp, Glycine max
  Peptide Sequence Number=SeqID_130140
atgcctaaatcatctcccaacatgcatgggaagcaagaagtatcaacaagagtaaagccaaggctattgtgcaagcaatcaacggggcaaaacacacagaataaaatagatgatgatggctcaaattctcaccaaggcacaatcaataaagaacaatcaataaatttggacaagtgcaataaaagtaaagaaggagacagaaaaagaaaacttcctaagtcatggtggaagagaagtagggtgaagtacggaggtctcctccaccactacatccactaa

SEQ ID NO: 38456 - DNA, 2667 bp, Glycine max
  Peptide Sequence Number=SeqID_130141
ctgtttcgcaactgctcgctggcggtactcaactccggcagccagaccgacagtagccacgaactgctttcccgctttgaaaactttgacatcaacgtgctgcgccgcgagcgcggcgtgaaactggagctgatcaacccgccggaagaggcgtttgttgacggccggattatccgttcgctgcaggcgaacctgtttgccgtactgcgcgacattctgtttgttaacggtcagctctcggcggcggatcgtttacaaaatcaggacgtcaccgactccgcgcacatcaccaatcaggtgttctctattctgcgcaacgcacgcgcgctgcacgtgggcgaatatcccaacaccgtggtgtgctggggcggtcactccatcaacgcggtcgaatatcaatattgccgcaatgtcggaacccagatgggcctgcgcgagctgaacatctgtaccggctgtggtccgggcgtgatggaagcgccgatgaaaggggcggcggtaggccatgcacagcagcgctatcacgacagccggtttatcggcctgactgaaccgtcgatcatcgctgcggagccacctaacccgctggtgaatgaactgatcatcatgccggatattgaaaagcgtctggaagcctttgtgcgcatcgcgcacggcatcgtgatcttcccgggcggcgtaggtacagctgaagagctgttgtatctgctgggcattctgatgaatccgcagaacagcgatcaggtcctgccgctgatcctcaccgggccaaaagagagcgccgattacttccgcgtgctggatgatttcatcgttaatacgctgggtgaagctgcgcgccggcattacaaaattatcattgatgatgctgcggaagtggcgcgtctgatgaagaaagccatgccgcaggtgaaagagtatcgccgcgaaaccggcgatgcttacagctttaactggtcgattcgcattgcgccggatctgcaggtgccgttcctgccaacccacgaaaatatggccaacctcaagctgttcccgaatcagccagcggaaaaactggcggcggatctgcggcgtgccttctcgggcatcgtggccggtaacgtcaaagagatggggatccgcgaaatccgggaaaaaggtccgtatcagctgcaaggcgatgccgatctgatgcaccgtatggacgaactgctgcagggcttcgtcgcgcagcagcgcatgaagctgcccggcagcagcctgcgggctgccggtatcactatgtcgcgtcatctgcttattatcgacgcgctcaatctgatccgccgccgtgcacaccgtgcaggccatgaccgacagcctggctggcgtcatcagttattgccggactataaagcgggtcgcccgccgatgccggacgatttacagcaggagatggcctcgctgcagcggcctttgaggccagcaggtgtcagctgctgggttgccgaacatgatgaagcggacgatctggccgcgacgctggcagtgaagatggccgacgccggtcatcaggccaccatcgtttccaccgataaaggttactgccagctgctggcgccgagcatccgcatccgcgattattttcagaagcgctggctggacgtgccgtttatcgaacaggagttcggcgtcgcgccggcccagctggcggattactggggcttatgcggtatcagcagcagcaaaattccaggcgtgcccggcatcggaccgaaaagcgcacgggaactgctgctgcagtttggttcgcttgaggccctgtatcagcagctggatcaggtacctgagaagtggcagaagaagttacgcgatcaccgcgcgaccgcggaagtgtgccgacaggtgtcaacgctgaagcgggatttggtgttgcaggggaatttaaatacgctgcggtatcagggcgctgccaacgccgcgatagtgcaaagaatgaagcagaagttctgcgaaataatttgtgccaccgcaggacggcaagcacgagctggtcaggcaggtttcagccccattccacaccggcgcagccaacgccgcgatagtgcaaagtatgaagcaggcctagcgttcgtcgcgccgtccgccgactgccgcccagatccggcgcacatgcacggtcacttcttcgcggtcgtgatacagctggcgcgcctggatctgcgcgtttacgcccttctccttcagcgccgcgtccatcattgccaggttctgcgtaacttcttcatagcgctttttcattggcagcttgaggttgaagatcgcctcacggcaccagccgttgaccagccattcggtcatcaggctggcgacgcgcaccggtttttccaccatgtcgcacaccagccagctgatgttgctgcgcggcgggcggaatttgaaaccgtcttcgcggcagtgcgtaacctgtccggtatccatcaggcttggcgccatcgggccgttatccaccgcgtagacccacatgctgcgcttcaccagctgataggtccagccgccggggcaggcaccgagatcgaccgcatacatgccgctgcccagccgttcgtcccactcatcggccggcacgaacacatggaatgcttcttccagcttcagcgtagagcggcttggcgcatcggccgggaacttcaggcgcggaatgcccat

SEQ ID NO: 38457 - DNA, 990 bp, Glycine max
  Peptide Sequence Number=SeqID_130142
atgtcgtttctcgatggcgtgctgctggcgctgtttctgcccatcaaaccggtgttcgccgtctattcttcgatcagtgaacagtggtatatgcgcctgctcaggccggtcatcgacttcgtgccgctcgaccccaccaaaccgatgtcgatcaaacatctggtgcgcatgatcaacgaagggcgtccggtggtgatctttccggaagggcgcattaccgtcaccggctcattgatgaaaatctacagcggcgctggcttcgtcgctgcaaaatccgccgccaccgtggtgccgatgcgtattgaaggcgcagagtacaccccgtttggccgcctggccggggtgtttaaacgccgcctgttcccgcgcattaccctgacggtgctgccggccacggtaattcccatgccggaagcgaaacgcgcgcgcgaccgccgcgtgctggccggtgagcatttacaccatgtgatgatggaagcgcgcatggcgctacaccgggctgctgaaaaaagcgctcggcgtcggacgcattctggagcgctacagccagcagggcgaattcgttggcctgctgctgccgaacgctacggtgaccgcggcagcgattctcggggcttcactgcgcggtcgcgtgccggccatgctcaactacaccgccggcatcaacggcatgcgcgcggcgctgaccgcctcgcaggtgaaaaccgtgtttacctcgcgccagttcctcgagaaaggcaacctgtggcacctgccgcaggggctgacggaggtgcagtggatctatctggaggatctgaaggataccgtcacgctgcaggacaaactgtggatcctcgcgcacctgctgctgccacgccggcgcaggttgcgcagcagccagaagacgcggcaatggtgctgtttacctccggctcgaaaggcaatcccaaaggtgtggtgcactcgcataaaagcctgctggcgaacgtgagcagattcgcaccgtag

SEQ ID NO: 38458 - DNA, 1262 bp, Glycine max
  Peptide Sequence Number=SeqID_130143
atgctgctgctggcgatgaccatcagcacgctgctgcagtatcatcgcgcactggcgctgggatttagccagcagtggcagcagcgccaggcgtggcaggtagccgggcaggcgctgctcgggcgtgataccaccggctggcacattgtgcatcagccgcagagtttacctggcagctgcgtgctggatcgcgttaccgtcaccggaccccatcagcgcacggcgtcactggcgcggctcaattgccgcgaaggtgatgccggcgggagttttatgttccgggtttaccactccaatcggttagatttattgaaagacttagcggtagagctgataaaactccagccgctggccgatccgctcgcggctgagcaggtgctggtacagagcccgggcatggcgcagtggctgcagatggagctggctaaccgcttcaacattgccgccaatattgattttccgctgcccgccagctttatctggagcatgttcgttaaagtgctgccggatatcccggaagagagcgctttcaccaaagccagcatgagctggaagctgatgcaccggctgccggtgctgctggagcaggaggcgtttcagccgctgcgcagctatctgcatgacgacgacgatcagcgcaaactctaccagctcagcgcgcgcgtggcggatctgttcgaccagtatctggtctaccggtccgactggctgaaccgctgggagcgcggcgaacaggtggacgggctgagcgacgctcagcagtggcaggcggcgctgtggcgcgatctggtcgaattcacgcgcagcctcggtcagccgatgtggcaccgtgccaacctctatgcacggtttatccaggcgctggagcaggcgtcaacgccgccgccggggctgccgcagcgcgtcttcatctgcggtatctctgcgctgccgccggtttatctgcaggcgctggaagcgctgggccgccacattgatattcacctgctgtttaccaatccctgtcgtcactactggggcgacattcaggattacgccttcctcgcgaagctgcagagccgccagcggctgcgcctgcattcgcaggagacacagccgctgttccgcgatccggatgccgcgccagcgctgtttaacgaactgggcgagcagcagctgaccaatccactgctggcctcgtggggcaagctgggccgcgacaacctgtttctgctgagccagatggagtcagccgccaatgacatcgatgcgtctgtggagat

SEQ ID NO: 38459 - DNA, 2619 bp, Glycine max
  Peptide Sequence Number=SeqID_130144
atggtgctgatggggtcaaaaaattatccgcagccggataacctggcggagtttctcaagaagcacggtggcagccacaatgccagcacagcctcgtaccgcaccgcgttttacctggaagtcgaaaacgatgcgctgcaaccggcggtggatcgtctggcggatgcgattgcgcaacccctgctcgacccgaccaacgcggaccgcgagcggcatgcggttaacgctgagctgacgatggcacgctcgcgcgatgggctgcgtatggcgcaggttggcgcggaaaccctcaacccggcgcaccccggctcgcgctattcgggcggtaatcttgataccctgagtgacaaacccgacagcaacctgcatcaggcgctgctcgatttctatcatcgccactactcggcgaatctgatgaaagcggtgatttacagtaacaaaccgctgccggagatggcgacgatcgctgccgagacttttggtcgcgtggccaatcatcaggccagcgtgccggatattaccgtgccggtggtcaccgatgcgcagaaaggcatcatcattcattacgtgccagcgcagccgcgcaagcagctgaaaattgagtttcgcatcgccaacgacagcgaccagttccgcagcaaaaccgacaccttaatcagctatctgctgggcaaccgcagcaaaaataccctgaacgactggttgcagcagcagggactggcggatggcgtcaatgccggcgcggatccgatgaccgagcgcaacagcggcgtgtttgccatctcggtttcgctgaccgacaaaggcctggcgcagcgcgatcgcgtggtggctgcggtattcagctaccttgatatgctgcgcaaacaaggcatcgacaagcgctatttcgatgaagttgcgcacgtgctggcgctggatttccgttatccgtcgattacccgcgatatggattacattgagtggctggtggataccatgctgcgcgtgccggtgacgcacacgctggatgcaccttacctggccgaccgctatgatgcggccgcgatcaacgcccgtctggctgagatgacgccgcagaacgcccgcatctggtacatcagtcccgctgagccgcacaacaaacaggcttactttgtgaatgcgccttatcaggtggataaaatcaccgccgcgcagtttagcgactggcagcagcaggcgcagcagattccgctgtcgctgccgaccctgaatccctacattccgtcggacttcgccctcatcccgtctgacggtaagcattacgatcatccggtggcgctgaccagtggcgacagcatgcgcatctactggatgccgagccagttctacgccagcgagccgaaggccgctattacgctcgcgctgcgtaacaaatccgcgatcagcgatgcgcgccagcaggtgttgtttggtctcaacgactacctctccagcctggcgctggatgagctgaattcgcaggcttcggtgggcggcatcagcttctctaccggtgaggacgacgggctggtattcaatgccagcggcttcacccagcgcctgccggagctgctgaaaaagctggttgaaggctacgccagcttccagccggatgcgcagcagctcgagcaggcgaaatcctggtatctggatcggctggaagcagcggaaaagggcaaagcgtttgaacaggcgattcagccgatgcaaatgctgtcccagctgccttatacccagcgtgaggcgcgacgccagctggtgaaacagatcacgctgcaggaggtgatggattaccgcgatgcgctgatccagcacgccacgccggaaatgatggtggtcggcaacctgtcggccgatcgcgtcaggcagctgggcgaagagcttaaacagcagctgcacagcacggggcacggttactggcacagcgattatgtggtggtggataagccgatcaaagccaatctgcagaaaaccggcagcagcaccgactcagcgctggcgacgctgtatgtgccgctcggctacagcgagtatcaaagtatggctaacagcaccatgctgagccagattgtgcagccgtggttctacaatcagctgcgaaccgaggagcagctgggctatgcggtgttcgcttatcagatgccgattggtcgccagtggggcattggcttcctgctgcaaagcaacagtaaaccgcccgcttatctgctgcagcgtttccaggcgttctatccgcaggcggaacagcgtctgcgcagcatgaaagcggaggatttcgcccagtatcagcaggcactgatcaacgacctgaaacagcgtccgcaaacgctggatgaagaggccaaccgttacagtcgtgatttcaatcgccagaacttcgcgtttgatacgcgcgaaaaggccattgcgcaaattcagcagctgacaccggccagcctggctgactttttccatcaggccgtgctggcgcagcagggcatggcgatgatctcgcagattggcggcagtcacgatggcacccacgatgcggattacgcgccgctgccgggctttaccacctgggatgaagtcgcccggctgcagcagtcgctctccgtgaagagtgatgcgccatga

SEQ ID NO: 38460 - DNA, 732 bp, Glycine max
  Peptide Sequence Number=SeqID_130145
ctggctgcggcggtcaacgccggcgaagcgcaggcggtcgaggcggcctttcaggcgggcttcagtgatatcgtgcgccagccgctcaacgatgccgaagcgtatcaggcgatgctgacgcagattgccgaaggctatcggccatttctccagttgattaaccagcgtgccgcaccggccgaggtgattgctgcgtttggccgttatcagctgctgtgcgcgctgcgcgaagggccatttggcgtgcaggggctcaatcagcgtattgagcacaagctgatgcagctgcagctgattcgtcgtccggcagggggcagccgctggtatcaggggcgtccggtgatggtgacgcgtaacgacagcgcgctcggcctgttcaatggtgatatcggcattacgctgttcgatgaggaagggctgctcaaggtgtttttcccgctgcctgatggcagcatcaaagcggtacagccaagtcgcctgccggcccatgacacggcatgggcgatgacggtgcacaaatcacagggttcggagtttgaccacaccgcgctggtgatgccggctcagttcctgccggtactgacgcgcgagctgatttacaccgccattacccgggcgcgcagccagctgacgctgttcagtgatgaagcagtgttccggcgcgcggtgcagttgcgcacgcagcggcgcagcgggctgctggatcgcttagggggagaagagggcagatga

SEQ ID NO: 38461 - DNA, 1017 bp, Glycine max
  Peptide Sequence Number=SeqID_130146
aacctgcacatcaacagcgcgctgaaaggcatcgataagctggtgcgggtggacgatccctacattaaaaccgcgcgcgtcggtcagttcgatcccaccacggtgcgcgtggtgctggagctgaagcgcagcgtggcaccgaaaaccttcaccctcgatccggtcgctggtattcgccaccggctggtggtcgatctctatcccagccagtcgtcacaggaagaggatccgctgctggcgttactgaaggattacaaccagggcgaactggagcgcgatcaaccggcgcaggcgccgctaccgggtaaagccgggcgcgatcgaccgattattatcatgatcgatcccggtcacggcggggaagatcccggcgcgcacggcaagtacaaaacgcgcgagaaagatatcgtgctgaagattggacgctatttgaaagcgctgatcgacaaagaacgtaatatgaaggcttacatgacgcgcaacgaagatgtgtttataccgctgcgcgtgcgggtcgcgaaagcgcgcaagcagcgcgccgatctgtttgtctcaattcacgccgacgcctttaccagccgggcggcgcgcggctcttcggtcttcgcgctctccaccagcggcgcaacctcggccgccgcgcgctttctcgcccagacgcagaacgaagcggatttgatcggcggggtcagcatgagcggcgatcgctatctcgaccacaccatgttcgatatggtgcagcggcagaccatcagcgacagtctgaagtttggcaaagaagtgctgacgcgcatgggccacattaaccacctgcataaacgcacggtggatcaggccggctttgcggtgctgaaagcgccggatatcccgtcgattctggtggaaacggcgtttatcagtaacgttgaagaggagcggaagttgcgtacgccgcgttatcagcatcaggtggcggaagccattctgcacggcatcaaggcatattttgacaaaggcggcgtgctggcacggcgttag

SEQ ID NO: 38462 - DNA, 2181 bp, Glycine max
  Peptide Sequence Number=SeqID_130147
atgaaaggacattgggcgaagtatgcacttactggcgcatttctggcgctgttagccggttgtagctctaagccgaccgatcgcggtcagcaatatattgatggcaagctggagcaaccgctcgggctggtgaatgagccgaacgccaaagggcgtccggtcaatggccgtgatttcggcctgcaggtgcagcagatccagtcggcgtcgtccggtctgtatggccgcaacctcggcacttacagtgcgattcagaactggctgctctccggcgccgatacgcgtcagctgcgccagttcggcctgaacgcctatcagatggaaggcaccgacagctacggcaacgtacagtttaccggttactacacaccggtggtggaagcgcgttatacccgtcagggcgaattccagtatccgatttatcgcatgccgccgcgtccgcgcggacagaagctgccaagccgcgcttctatctatagtggcgcactggatgagcgttatgtgattgcctggagcaactcgctgatcgacaactttatgatggacgtgcagggcagcggctatgtcgatttcggcgatggccgtccgctgcgcttcttcggctacggcggcaagaacggctgggcttaccacagtattggcaaagagctgatcgatcgcggtgaagtgaagcgcgaagacatgtcgatgcaggcgattcggcagtgggcgcaggagcactcgccgcaggaagtgcgcaatgtgctggaaaccaaccagtcgttcgtgttcttcaagccggaagagtatgtgccggtgcgcggtgccagcgcggtaccgctgattgccaaagcctcggtggcgtccgatcgttcgctgattcccgccggcacggcgctgctggctgaagtgccgcagctgaatgagaagggcaaattcaacggcaaatatgagatgcgcctgatggtcgcgctggacgtgggcggcgcgatcaaaggccagcacttcgatatctaccagggcgtcggcccggatgcggcgcatctggcgggcttctacaaccattatggccgcgtctgggctgcgcaccctgggtttgtcgggtgcgcgtctgcgcatcgtactaaaaggttagctatgaaagttgtcagcgacgcctggcgccagcgatttggcggcacggcgcgtctctacgggcaggaagcactgcagcgttttgctgacgcgcatttctgcgtcatcggcatcggcggcgtcggttcctgggcggccgaagcgctggcgcgcaccggcatcggtaaaattaccctgatcgacatggacgatgtgtgtattactaataccaaccgtcagattcatgccttgcaggggcatgtcggtcaggcgaaaaccgaggtgatggcgcagcgtattcacgccatcaatccggagtgtgaggtgatctgcatcgatgactttatcacgccggacaataccgctgagctgatggcggcggggttcgactatgtgattgacgcgattgatagcgtgcgccctaaggctgcgctgatcgcctggtgccggcgcaataagatcccgctgatcactaccggtggcgccggcggacagatcgatccgacgcagattcaggtcagtgacttagccaaaaccattcaggatccgctggctgccaaactgcgcgagcggctgaaaagtgattttggcgtagtgaaaaacagcaagggtaaactggggatcgactgcgtgttctctactgaggcgctggtgtatccgcagccggacggcagcgtatgcgcttcgcgcagtacggcggaagggccaaagcgcatggactgtgccgccggctttggtgcggccaccatggtgaccgccacctttggttttgttgcgggccgcgggcgtttttccttccaccgctgtcagcagcaccgccagcaatccgcgcacaatgcgcccctcactgtcgccgtaaaaatgcagcgtgccgtcggcccgctgctggctgctgagccagacgcggttttcgcagccggagagctcaatgtccgccgttttcagcgcttccggcagcgccggcagctggcggctgagctgaatcagctggcggtagcgatcttcccactgatgaaaatgggcaaatttctccgtcaggctggcttcggtaatcaggtcaccaaacggatggggggcaagcagggctga

SEQ ID NO: 38463 - DNA, 363 bp, Glycine max
  Peptide Sequence Number=SeqID_130148
atgaagcagataagaaaagccacatgcctaagatcattggcgactagaccagttggggtagagaaacccctggtccatgtggatcttacaacaggaaaagcttacgatccccacaaaaagaaattaagaacatatttggggattgtcactcaagataaggtagatgtgacatacgataattgtaaacaaggccctactgcgcagaaggatttgatatggggaggatattcagccaacaagaacaatgttgatgacactgcttgtgaaaagtacaacattagcaaggaaaagtggacccaattttgtcagagtcgtagagaccctttgtgtgaggatgtgcgaaaaaaggcacatgccatttag

SEQ ID NO: 38464 - DNA, 625 bp, Glycine max
  Peptide Sequence Number=SeqID_130149
atgttggtgcgcatgatccgcactcgtctctttgcagcggcacgggtgaaatcttgccctggtatgcatagtagctgtgtgatagcctccctctctggttgtgctcgcacagttggcccttcctccaatatcagggggaccttaaattcttttaaggtggtggatgtcgagcacactgaaaagaggacacgtagccctctaaaggtgagggcgtgcagccctctgctggcgaggacgtgtagtcctttcaaggtgagggcgtgtagccctctgacagtgagggtaactagtaccaaggtgagggcgtgtagccctctcaaggcgaggacatgtagtcctctgaaggtgagggcttgcagccctctgaaggcgaggacgtgtagtcctctgaaggtgacggcgtgcagccctctgaaggtgaggacatgtagccctctcaaggcgaggacatgtagccctctgaaggtgagggcgtgtagccctctcaaggcgaggacatgtagtcctctgaaggtgagggcgtgcagccctctgatggcaaggacatgtagtcctctcaacggtgaggtacccaaggtgagggcgtgtagccctctcaaggcgaggacatgtagtcctcttgaag

SEQ ID NO: 38465 - DNA, 261 bp, Glycine max
  Peptide Sequence Number=SeqID_130150
atgaaacataaagaacatgaatctggggatcccacggtcatgtggctccgcatgccaccggtctcttgggacacggtaacaaaaagtggggtggtcgacaaaagcagggcttttgctcctacgtatcctcaatttgtgatgaggaactcagacctacgtagttcttgccaactcatttcatttctaaacgaccatttagaggaaacactgggtccaacaaagataggagaaaatcactcaaagtgtatcaatctcacacag

SEQ ID NO: 38466 - DNA, 752 bp, Glycine max
  Peptide Sequence Number=SeqID_130151
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccacttgcgcttgatataagaaacttgcatgttgaggataattcaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 38467 - DNA, 420 bp, Glycine max
  Peptide Sequence Number=SeqID_130152
atgatcctgaactcatttatgcagaagtactattacttgatcctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 38468 - DNA, 873 bp, Glycine max
  Peptide Sequence Number=SeqID_130153
atgtcccgtggaccgccgccccccacaaggtacatctcgcgcctatgggccgctataactatccaagaagacactcgaaactggaaggataaacaaacccacccggtggactgccgagctacaagtcccacgacacaggagcgggattctctaaaaagccaaggtcgcgggtggccaagagggcccacttggagacttgggatctcagcaggaaatgcgaagatccaaagtcttctcttacagactgggccttcgcgctctttttcggcttgtgggttgggaggttcccctcataattattctttgtgtctttcgggcctcgaatccgggtatacgttgcacatgatggatccagcaggaggtcagcctgctgccaatcctgcagcggagcaaccctcaaacgtgccttcaggcgcatcgacctcgggctggagaagtttcgaagaaggtgttttgttagaatcttcaaacgaatccagcgaagcgagcgtgaatcagcagcctgtgattcccgaacttgaacctccgcttctcgatgacaacacccggcgagcagagctcgctgttcgattgagggcgaattggtgggggatcgcttataacgagcgaatcctcgactccttcgtccggagtcaacttgcaatcgaaaggcacatagaggccgcacttgtggcggacggatattcccctcaagtagtctttgaaagaagacatatgatttgtggctttcttttctatccggaggggcatgcgctgagtgaaaacgattacgcgggttatctgaccaaaattgccaattttggtacaaggcaaagcattccctatcagcgggtgatccgaaccgtccataactctcatccctttttagattag

SEQ ID NO: 38469 - DNA, 363 bp, Glycine max
  Peptide Sequence Number=SeqID_130154
atgagggacggcaagaggtcttcgtacgtcattgggatcggggtgaattctggagttggccttgggggaaagttcctcatcgcgttagaaccggcgccaaagtgggcgttgccggccgggcgagtcggggttggagccggagcttggggggcctccctctggatgggtgcgggcgctctaggctgtacgggtgctgaattagaagagtccccggcgcgagctgagaagcacagttgctccgatcctcctagcattggtacttgtggaggagacgtaatcgaacttccctctcttcaaaccaacttcgattctctccccggcgaataccaagtccgcgaagcgggagggcatgtagcccactaa

SEQ ID NO: 38470 - DNA, 207 bp, Glycine max
  Peptide Sequence Number=SeqID_130155
atgagtgacaaagaaaatgcttgtgcattgctggttatgggaaagcttggaggggttgatgggggcccagtgctaagaggaacgaggataagggctacgtcagagtacgtgagctcagctgaaggtgggcaattggggatggtgggttcatgtttgatttgtggatgtgggagagttgatttgcaccatcgcccgatcgccacctag

SEQ ID NO: 38471 - DNA, 177 bp, Glycine max
  Peptide Sequence Number=SeqID_130156
atggagctagaacggctgatcaaaaggctctcagaaagtggcattgatgatggacgattttgtaaacataagcacttgacaatgaaggaaagctggagttgctgcacatggatgtccaacgattatgtcaaggggaataagatcgggctgctactgaatgcacgaaggcaagactga

SEQ ID NO: 38472 - DNA, 663 bp, Glycine max
  Peptide Sequence Number=SeqID_130157
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatttctgtataacctagtgcgccaacgagctcgacaggatatcctaatggattgcgttatagctatattggctctgaggattgactcattcggtaatgcagccatcgattcgtcgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgagaaaaaaggctgcaccggtgcgtcagcagaatatgtgatacaggatatattccgcttcctcgctcactga

SEQ ID NO: 38473 - DNA, 354 bp, Glycine max
  Peptide Sequence Number=SeqID_130158
atgtggatcattgcttgtaaaggactttacaaggttgaaaagaaatctcaagaaccgcatgtcgcttggggactggatgtaggcacgggttgttgccgaaccagaaattccatccataggtcacctatcttcaatggtgagggttaccactattggaaaacccgtatgcagattttcattgaagccatagatttaaacatttgggaagcaatagaaataggaccttacatacctactgtagtagatgtaagcactgcaccacaacacaaaaacctagagacaagtggactgaagaagatagaagaagaatccagtatgatcttaaagcccaaaacattattacttcagccttag

SEQ ID NO: 38474 - DNA, 60 bp, Glycine max
  Peptide Sequence Number=SeqID_130159
atggctttcaccttttcggggtccacccttatccctttctggcttacggatgaaacccag

SEQ ID NO: 38475 - DNA, 408 bp, Glycine max
  Peptide Sequence Number=SeqID_130160
atgggatcgagtcaggcgtcttcgcttaaaaagaggttctatcaagtcaaggtcaagagcctaggagtcaccagtctgaaagagttagggcagtttatgggtcaactccagcgacaagcttttcgcaaagcttatggtaaaatctgggacctagccatggcagaggtctccacagaggccattgcctccctcgcccaatattatgaccagttgttgaggtgcttcacctttggggacttccagttatcacccatggtggaagagtttgaagagatcttgggatgccctctaggaggaaggaaaccatacatcttctcaggattttatccctctttagctagaatttctaagatagtccgaatctcgacgcgggaattagaccacagaaagcaagtcgaaaatggggtg

SEQ ID NO: 38476 - DNA, 315 bp, Glycine max
  Peptide Sequence Number=SeqID_130161
atggaggaaggtgacgataaccctcctagggtgattcttaaccatgtattttgggcatttaatccatgcattaaaggcttcaaatattgcaagacacttgtgcaagtagatgagacatttttaactggcaaatatcatgacaggggaaccggtttgctagcagctttacaatccgaacgcgttggttggaatggaccagatgtttcgtctgtgtattgcattcgccacattgcatcaaatttcaacaaacagtttaaaaatattgacttaaaaaaacaagtcatcaatatggggtatgagatgaggaaaccatga

SEQ ID NO: 38477 - DNA, 652 bp, Glycine max
  Peptide Sequence Number=SeqID_130162
aggactacacgtcctcgcctttagagggctacacgccctcaccttcagaggactacacgtcctcaccatcagagggtcacgtaccctcacctttagaggacaacacgtcctcgccttcagaggactacatgtcctcgccttcagaggacaacatgtcctcgccagcagaggcccacacaccctcaccttcagaggactacatgtcctcaccttcagaggactacgcgtcctcaccttcagagggctgcacgccctcaccttcaaaaggctgtacaccctcaccttaagaagactacacgtcattgccttcagagggcttcacgccctcaccttcagagaactacacatcctcaccttccgaaggttgcacgccctcacctttagaggactacacgtcctcaccttcagagggttgcacgcccttgccttcagaggactacacatcctcgccttcagagggctgcacgccctcgccttcagaggactacacgtcctcgccttcagaggactacatgtcctccccttcagaggactacgtgtcctcaccttcaaaggactacacatcctcagcttcagaggactacatgtcctcacctttaaagggctgcacgcctttgccttcagaggactgcacgtcctcaccttcagacgg

SEQ ID NO: 38478 - DNA, 309 bp, Glycine max
  Peptide Sequence Number=SeqID_130163
atggctccattgccgtcactccaaaatggtcaagatggaccctcgggtactagtaccctggtctttagaggactacacgtcctcgccaacagagggctgcacggcctcaccttcagaggactgcgtgtcctcactttcagaggactgcatgtcctcaccttcagagggctacacgccctcgccatcagaggactgcatgccctcaccttcagagggctacacgccctcgccatcagaggactgcatgtcctcaccttcagaggactgcatgtcctcaccttcgtagggctacaccgccctcacctttag

SEQ ID NO: 38479 - DNA, 474 bp, Glycine max
  Peptide Sequence Number=SeqID_130164
atgggagaactaaagtactttctgggattacaaatcaagcaactcaagaagtgcaaaacacatgtctacaccgataatggagttagagcactaattgttaacttagataaagagaatctggaagctcagtctatcccctcgactaaacattattggtgtatgatcggggatattctgattctgattttgccggatctaaaactgatagaaaaagtacaagtggaacttgtcaatttattggatcggctcttgtctcatggcatagtaagaaacaaaacagggatttatctactgctgaagcggagtatatgctccggtagttgcaagattgaagccattagaatgctattagcatatgcatccataatgaattttaagctctatcaaatggatgttaaaagtgcttttctaaatggtttaattcaagaagaagtatatcgcttgaacaacctccaggttttgaatcccggataa

SEQ ID NO: 38480 - DNA, 399 bp, Glycine max
  Peptide Sequence Number=SeqID_130165
atggcggcgcagctaatccgtgatcgagtagagatggagtgcctagagggagcttgggagaccctcgaaggcaacacgaggtgccgatttcggggcaccattcgattcacggctacatctttgcgcacggtagagtggatactacccacgcctacaccatatcgtctagcggagcccgtccaagtgatcgaggtaacgtcatccgaggaagaccctgaggaggatcttgcggagctacctcctgagcctgctgtggatgcccttgactttctagagggtgatgaagatccacttctcgaggtggattctcccgaggaagtcatgtcgacatctgaggcagactctacggaggatagtagcctgggggagatggcgatcagcggaggctcttcatcctag

SEQ ID NO: 38481 - DNA, 818 bp, Glycine max
  Peptide Sequence Number=SeqID_130166
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgagcatgctcacgagccaacaacgcatgaaatgataagcagcgcatggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 38482 - DNA, 1335 bp, Glycine max
  Peptide Sequence Number=SeqID_130167
atggggacaaatcaaaacggcaaaagattttatcaagtcaaggttaaaagtctagatgtcattagcctcaaggaattaggacgattgatgagacctctccaaaggcaagccttccgcaaagtgtacggaaagattctagatttggccacagcggaggtatttacggaagctgtcgtatccctcgcccaatactatgaccagctgttgaggtgtttcacgtttggggacttccaaatggtcccaactattgaagagtttgaggaaatattaggatgccctctaggggggaggaaaccgtatctcttctccggttttcttccttccttgagcaagattgcggctgtggttggggattcagcaaaggagttggatcgcacgaagcaaactcggaacggcgtagtgggcttgcctcagaaatacttggaagatattttagccttgctgatttttggggttgtcctcttcccgaacgtcgacggtttggtagacttagccgccattgatgctttcctcgcatatcaccatagcaaggaaagtccagtggtggctatcttggcagatttgtttgacacctttgaccggaggtgtgagaaaaacagtgcgcggattgtctgttgtttacccgctctctgtgtatggttgattccacacctgttccgacaagacacgagacacccgtgtccgcttcaaagctatcgctcgtgcgccgaaaaaggaagagtcgattgggaccaacatttggctgggatagggggcagcacgatcaattggtttcctcgttggaaggaaggcaaggaaggagttcttttctcgtgtggggactatcccaatgttccactgatagggactaggggttgtattaattataatcccgcactcgccataagacagctagggtatcccatgaggggagcgccaaccgaagaaagtctctcgcctttccttatgagggatctaggcgcgcaaggtctcaaggttatacaaagaatccacaaggcatggaggagtccgttgaggaaagacaaagagcttagaggcatccgaaacggcgtcaccggaggttatcatggatggctaagaattcacacgcgggggttagattggctctccaagttgaaagttatcgacgaggagaacttcgaagctccggaggaagatgaagaagtccgagctctaaaattagagttaggaaaggcaagactcgccaaggagaggttcaagtcagctgctacacacatccggaaggagtgcaccgagttacaagaggaaaacacggccactgcaaaagcccttgaacaagaaaccaaaagggcccgcaaggaggaatatggctga

SEQ ID NO: 38483 - DNA, 468 bp, Glycine max
  Peptide Sequence Number=SeqID_130168
atggctcaaccaatcatgcgctcaaccagagaaggatggcttagccaattaggcgacatttggcttagtgcgcctcttcttcgctcagccgatgcgctcaaagccttcaatgagttgaaactcatacaattacccccaatagctcctcccagactagggctggacaaaaccaagcattgtagataccatcgcagccatggccacaatactggagactgttgggcccttaaggacaaaatggagaaacttattcaggtcggatacctagcccaattcatgaagaaacctgatgacaatccaacaagaggaaggcgtgagacgattgttgcaaaagtcgagatgccagcagaagaggggacaaaatggataaaagaggcagacaaaggtgtcactagaaaaggcgtgaacatcaacctcagcaagagcaagaaaatgagcctgcctagcggattttcctatgaggggtag

SEQ ID NO: 38484 - DNA, 148 bp, Glycine max
  Peptide Sequence Number=SeqID_130169
atggaggagttgattaacaaaacaaaactctctcccaaaataatcccaatgccatcacgtcggctcgatggctcctcaacagaatctcacttcctgcaccctactgctatcattctgctcccacgaacaagtttcgcgatcatcacag

SEQ ID NO: 38485 - DNA, 422 bp, Glycine max
  Peptide Sequence Number=SeqID_130170
aagtttctgttgaagccattgcatcccttgctcaatattatgaccaaccgctaaggtgcttcacgtttggggactttcagttagtaccgatcgtagaaaagtttgaagggatcttaggatgcccgctaggaggaaggaagctgtatctgttttctgggttatacccttccatggcaagagtaacgaaggtggtcaagatctcgatgcaagaattgaaccaagtgaaacaaaatagaaatggggtggtcgaaataccaaagaaacacttggaagagaaagcgaaggctttggcggatcaaggggagtggacttcattcattgatgttttagaacttttggtgttcaacgcttctcattccaaatatggatgggctagtggatcaagtggcaatcgatgcttctcttgcttatcaccacagtaa

SEQ ID NO: 38486 - DNA, 453 bp, Glycine max
  Peptide Sequence Number=SeqID_130171
atggttatgggggatcccatcaagcagactctccttccctgttggaatatttgtctctttgctaaagcatgtttgcattttagtggagaaaacaccgagactttttcaagtctcacaagttatccagaactacgtaggtctgagttcctcattggaggatacgtaggagcaagagcctcgcttttgtcgaccgcaccgctttttgttaccatgatccaagagctggtagcccgcggagacaccttacggttatccgcacctcgtcatttagtgaccccaagtgtgattgatgagcagaggccaatgtggtcatctgcgccttttccggagatgtcagcattttccgatggagacttttcaagtctcacaagttatccagaactacataggtctgagttcctcattggaggatacgtaggagcaagagccttgcttttgtcggccgcaccataa

SEQ ID NO: 38487 - DNA, 369 bp, Glycine max
  Peptide Sequence Number=SeqID_130172
atggctctgaggaagctttcctcaaagagatctaggaagaacgccgcggccgcagggactagtgccgctcccgagtttgatagccatcgtttcaggagcgttgagcaccagcaacatttcgaagccatcaagggatggttcttccaccgagagagacgcgtccagctcagggacgacgagtacacagatttccaagaggagatagctcgccggcgttggacttcgctggtcactcccatggccaagtttgatccagatatagttctcgagttttatgccaatgcttggcctacagaggagggcgtacgggatatgcggtcatgggtaaggggtcagtggattcctttcgatgcagatgccctcagttag

SEQ ID NO: 38488 - DNA, 546 bp, Glycine max
  Peptide Sequence Number=SeqID_130173
atgaaaagagaaaaacatgcctcctatagtagtcatcactcttgcaaaagcctaagtgaagaacttcgtgactattacgaaggaaggcataggtcacatcttagacctcactcccatagaagagaaaaggaaagaaagcctcaagaggctaacattaaactctcatacttccatgggaaggataataagtctacttcaaaatcttatggctctcactcttatccaaagaaagaccaaggtcaaggcatcttaggggtgacaccttctaagcccaaagatgataaggggaagacaatagaaaagcaagcccctaaggctagtatgcaagagaaaactagctctataaagtgctttaaatatcttggaagaggacacattacttctcaatgccccaccacaaaaaccatgattatgaggggccaagacatttatagtagcaagatgaggctactacttcacctttctctagtgaaagtgaaaaagcaaaaagggaagaatttagtgaagaaatctaccccaagaagaaggacaaccattagtggttaa

SEQ ID NO: 38489 - DNA, 240 bp, Glycine max
  Peptide Sequence Number=SeqID_130174
atggcagcttgcagtggctatcggtggttgtgggtggtggacaagaagcttggggcattgaggaagggttttggaagaaagaaggagaaaggaatggaaaagaagcttttctcacacaccaaaagacatattgtagatcgtaacgatcaggtcgtagaaatctgtcctatgaacctccagaccaaatttcgagaagatctaacaattaacgattgcagaagggcgcttttaccaaggtag

SEQ ID NO: 38490 - DNA, 525 bp, Glycine max
  Peptide Sequence Number=SeqID_130175
atgccaccgcttatcagactattcacatctgcaggagatttcatggttcgtaaggctcttctcgccgcgctgctgctggcggcagctcaggcgcatgctgactatcagtgcagcgtcaatccaaaggatgatgtgatcatcaaaccccagagcgtgcaggtggtgggcagcaacggcaaccttgaaatcacgccgcagggcgatgtgcagttcaacggcaagtcggtgagcgtcgataacgccacgcgccagcaggcgattgactaccagaacgcgctgcgtcgcgatctgccgtgggtcgacagcggcgcaaccacccgtctggagcgcggccgcgtggcgctggataaagtgatcgtcgagaaactcggctcggacagtaatgtgcgcaatcgcctgaccacgctgaacggccagctgaagcagcagatgaaccgcatcatcgagcatcgccgccagcggcagcaatccgctgcaggcgctgatgggcaacctcggcgggctacagcagtcgattcagactga

SEQ ID NO: 38491 - DNA, 777 bp, Glycine max
  Peptide Sequence Number=SeqID_130176
atgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataaaggccccgaagggcccgttcccaatccgtcccccgaccggcacgcgacgacccgctctcgccgcggaagcagctcgagcagtccaccgacagccgacgggttcgggactgggaccccccgtgcccagccctcagagccaatccttttcccgaggttacggatccattttgccgacttcccttgcctacattgttccatcgaccagaggctgttcaccttggagacctgatgcggttatgagtacgaccgggcgtgggaggcactcggtcctccggattttcaagggccgccgggggcgcaccggacaccacgcgacgtgcggtgctcttccagccgctggaccctacctccggctgagccgtttccagggtgggcaggctgttaaacagaaaagataa

SEQ ID NO: 38492 - DNA, 1008 bp, Glycine max
  Peptide Sequence Number=SeqID_130177
gaatcaaggaattcaacatccaacccatacaaataattcgtggtcaagcttctgtccctgagaaactgggtccgagaagacaacagggagtgaagatttatgaaaaccctagccttgcaacaagtcctagggaagtagatacggagatggacaagaaaatccgcagtatcgtgagtagcattttgaaagacgcctctgttcctgatgctggtgaagatgttccaacatcttccaccccgaatgtgtctgtgccggatgttgagaaagatgttccaacatcttccgggccaaatgctgaagccctcccttcacccagtgaagaggaatcaacagaagaagaggatcaagcctcagaggagactcctgcaccacgggcaccagaaactgctccaggtgacctcattgacctggaagaagtcgaatctgatgaagaacccattgccaacaggttggcacctggcattgcagaaaggttacaaggcagaaagggaaaaacccccattaagaggtctggacgaatcaagactatggcccagaagaagagcactccagtcactcctaccacatccagaagaagcaaggaactgggaagagctgccatggattgcaaggagatcgtggatctcatcaaggctgctggactgctgaagactgtcagcaagttgggagattgctatgaaggcttagtcagggaattcattgtcaacattccctctgacatatcaaacagaaaaagtgatgattatcaaagagtgtttgtcagaggaaagtgtgttagattctcccctgctgtgattaacaaatatctgggcagacctactgatggagtgatagatattgatgtttctgagcatcaaattgccaaggaaatcactgccaaacgagtccagcattggccaaagaaagggaagctttcagcagggaagctaagtgtgaagtatgcaattctgcacaggattggagctgcaaactgggttcccaccaatcatacttccactgttgccacag

SEQ ID NO: 38493 - DNA, 603 bp, Glycine max
  Peptide Sequence Number=SeqID_130178
atgagcattcacgtggctcagttaatcgctgatgccatctatctatttgcgggtatggcacctaccaggcaccctctggacccggataagtccaacagggccctgggatttcccgccttgatcacaggactctgccagtcgttcggagtccccgtcgcacctagcaaggtgatttggccgcccatcacccgagcttttattgagaagtattgcacacagagacaggcccaaggggatgctccgcaggccgcagacgcgccgccacctcatcaggctggtctagccggatcgtttgatacggagcagtatttgcggcatttggttcgccagcaggcggccaaccaccgggctcatgtacagacccatgattgtctttaccagatgagtctcagcctgcagagccagggttttacttcttttctgtgccctactccggaccagttcagggcagaggtcacatggcctggagattggcctgaggcccgggcaggagaggcgccagcagaggcaccagcagaggctcccgacgaggcagatgaggcccgcgaggacgaggaaatgaccgatttacttgatttcttaggagggagcggggccacatga

SEQ ID NO: 38494 - DNA, 251 bp, Glycine max
  Peptide Sequence Number=SeqID_130179
gcccacttgggccctccggaatattcctccagaaggcggttgcttctggaggaagcaaccctgctcgcctgggcgagctgggcggcaaccacctcccctattttgctataaataggggaggaagtgaagaaggaagggccgaggcgcttccgaaacgtttccgtaacgttttccgtgaggaatctcgcaaaggtttcaaccgttcttcgacgttcttcattcgttcttcatcgttcttcgatcttcaacgg

SEQ ID NO: 38495 - DNA, 291 bp, Glycine max
  Peptide Sequence Number=SeqID_130180
atgatgcaatcctaccccgcaagggcattggatagaaaactccaagtagattgggccagagatgcaagagcaggccctagggttcttatgagccttagggtagatttcgggcccatggctaagtacgagcccacttatcttgtaaatattgataagatttcagagctccttttgagcacaaaatttcgtgctcttctctccctctcccttcattcatctccttcttcctccaagctcttatccatggcctcctatggtggtgagcttcttctagactcatcttctccttga

SEQ ID NO: 38496 - DNA, 697 bp, Glycine max
  Peptide Sequence Number=SeqID_130181
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacaggaa

SEQ ID NO: 38497 - DNA, 330 bp, Glycine max
  Peptide Sequence Number=SeqID_130182
atgaccggaaggctacttaccggttcattggctcttgaaagccgcatcctttactatcttattattcgtattttacttctaagatcttcaaaccttactcagagatctttcttgatcggtgctgctgtggttgcatcctttggttaccgcaaagagcgtgatggctcttgggtaaaaaagggtactcaaccaaatgatgatgaaggacaattaccagttgaaggggactcttctctccttcaaagtttgatgctttggaacaacaagtggacatgtgattcgatgcaatggactcaaggatcacaaaggttgaagaagatgccaccataa

SEQ ID NO: 38498 - DNA, 876 bp, Glycine max
  Peptide Sequence Number=SeqID_130183
atgaaagataagagggataaggaagaaaaactagaaaaccaaaagaaaaagaaggatagtaaggccttgtcttcaaaggccaaggggaaggaaaaagaggaaaaggattcctccaagaagattgttaagaaggaaaatcattttgcaacaaaatgtgatatcaaaagagcactccttcttaaaaaatctttctaccttctcctatcaagggaaacatcccttagcaccgccatacctcttgagcttgaggttattcctcaagtaaaggagttgttggatgagggtttggttcgcaagagcttaaatccttgtgctttgttggtgcctaaaatagatattattaggcaccaaatccctatgataggtggtatgatgaatgtgttgagtggtgcaacactctttagtaaaatcactcatgcaaccaacatcttcatgatttgtgtacatagggactcattaggtaggaataatcaacatgaaaataaagaaaaaggtatgtttgattccattactttccttgactttttaaatagtgatcaaggacttcccagggaccctaagggaataaaggtcattcctgagtgtcttactccaccatgtataagggaaatttggggcttcaatgacttaacaaacttttacaaaagaggtcacattgcctctcaatgccccacaaagaaaaccatgattttgagcggtcaagacatttatagtagtcaagaggagactacttcttccccttcctctagtggaagtgaagatgaagtaaggggtgaagagtctagtgaggaagtctacccccatgaagaaggtggcctcctaatggttagaaggctccttggaggtcaatcttgtgatctatctcaatcccaatga

SEQ ID NO: 38499 - DNA, 104 bp, Glycine max
  Peptide Sequence Number=SeqID_130184
ggaattggaatgaggaatggtgtcatcccttgaagaatttgagtcaagaagaaagggggccaaccaccttaagagctattggactaagaagcactctaaattga

SEQ ID NO: 38500 - DNA, 251 bp, Glycine max
  Peptide Sequence Number=SeqID_130185
tagcatgtgatgtaagctccattggagcttgtaggcctaggatattctttatcaatggattcctttgcttcttggaagatgaatggcagcggaatgacgaaaggaagagagagaggagacaccacttcaaggagaagatgagtctagaagaagctcaccaccataggaggccatggataagagcttggaggaagaaggagaggaagagaagagcacgaaattttgtgctctatatgagctttgaaatctga

SEQ ID NO: 38501 - DNA, 450 bp, Glycine max
  Peptide Sequence Number=SeqID_130186
atgggggtgggtcggaataccgaagaaaaatattttggaagggagtcctctttccaaatgtggatgggttggtggacctggcagcgatcgacgtttttctcgcctatcataaccacaaggaaagtccggttgtcgctatgcttgccgacctatacgccaccttcgcccgaagatgtgaagaaagcaatgcaaggattgtttgctgtactccagctctctatgtggggctggtttcacacctttttctccaagaaggtaggcccgtctatccgatacaaggttaccgctcgtgcgtcgaaaaaggaaaggcgaattgggaccaactcttggctagcatgggggggcgtctgttatttggttccctcgctagaaggaaggaagaatcaggattctatcttcgtgcgaaggatgtccaaatgttcccttgatgggaacaaggggttgtattaa

SEQ ID NO: 38502 - DNA, 69 bp, Glycine max
  Peptide Sequence Number=SeqID_130187
atggaagataagcttgcttgtggggctgctatggaggctggatctttgagcttcaatgaggtcctttaa

SEQ ID NO: 38503 - DNA, 819 bp, Glycine max
  Peptide Sequence Number=SeqID_130188
caaagagagatcaacagaggaagatgatcaagccgtagaggagactcctgcaccacgggcaccagaacctgctccaggtgacctcattgacctagaagaggtagaatctgatgaggaacccattgccaacaaattggcacctggcattgcagaacgattacaatgccgaaaaggaaaaacccccattaagaggtcaggacgaatcaagactatggcacagaagaagagcactccgatcactcctaccacatccagacggagcaaagttgcaatcccttccaagaagaggaaagaaatttcctcatctgactctgatgatgatgtcgaactagatgttcccgacatcaagaggaccaagacatcagggaagaaggtgcctggtaatgtccctgatgcaccattggacaacatctcattccactccattggcaatgctgaaaggtggaaattcgtgtatcaacgcagacttgccttggaaagagaactgggaagagctgccttggattgcaaggagatcatggacctcatcacggctgctggactgctgaagactgtcaccaaagtgtttgtcagaggaaaatgtgttagattctcccctgctgtgatcaacaaatacctgggcagaccaacagatggagtggtggacattactgtttctgagcatcaaattgccaaggaaatcactgccaaacaaatccagcattggccaaagaaagggaagctgtctgcagggaagctaagtgtgaaatatgcaatcctgcacaggattggagctgcaaactgggtacccacctatcatacttccaactgttgccacag

SEQ ID NO: 38504 - DNA, 225 bp, Glycine max
  Peptide Sequence Number=SeqID_130189
gatactcagattcggattttgctggatcaaatacagatagtgtcgcaacgtgcccttcgcgggcaagcgagggcgaggctcacgggtgcgctttccaaaggaggaaagatgcgcggagttgccaccaacgaaggtattagcatctctcacgtcgacaaaagcgaggcttttgctcctacgtaccctcctttggagaggaaatcagacctacgtagttctttctga

SEQ ID NO: 38505 - DNA, 48 bp, Glycine max
  Peptide Sequence Number=SeqID_130190
atggagaattgcactaagcaatcactaagcatagctccaaactcgaag

SEQ ID NO: 38506 - DNA, 462 bp, Glycine max
  Peptide Sequence Number=SeqID_130191
atgaagctttgcttctacataaaggagttgttggatgagggtttggttcgccagagcttaaatccttgtgctttgttggtgcctaaaataggtattattaggcaccaaatccctatgataggtggtatgatgaatatgttgagtggtgcaacactcttttgtaaaatcactcatgcatccaacatcttcatggtttgtgtacatagggactcattaggtagtaataatcaacatgaaaataaagaaaaaggtatgttttattccattactttccttaactttttaaatagtgatcaagggcttcccatggaccctaagagaataaaggtcattcctgagtggcctactccaccaagtgttgaggaaaaaagcccagagtttcatgaacctcaggatttgaggtcaaatccttttcaaggggaagggaatgatacaatcctaccacgcaagggcattggatag

SEQ ID NO: 38507 - DNA, 279 bp, Glycine max
  Peptide Sequence Number=SeqID_130192
atggatgtcaagagtgccttcctaaatggtctaatccaagaggagcaatcaggcccacatgggccttccagattcttcctccagaaggctgttgcttctggaggaagcaaccttgcgcacctgagcgagctgggtggcaagctcctcccctattttgctataaatagggggaggagtgaagagggaaggggttcagcgttcttggcacttcttattctctcgaaattgctgaggaaaattgtttccgtgaagaaaatccaagccgaggcgcttccgtaa

SEQ ID NO: 38508 - DNA, 201 bp, Glycine max
  Peptide Sequence Number=SeqID_130193
atggcaagcggactggaatgcaaaagatggaaaatgagcgttaatatctcaagagagaactgttttagagaagtgattcctctaggcatcaactctcaagaggaagaagttgttggagctgctgagtatcaagggttagatcacttccaacgaaataatccacatgctttcaatggaggatataaccctgttggcgcttag

SEQ ID NO: 38509 - DNA, 645 bp, Glycine max
  Peptide Sequence Number=SeqID_130194
atggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagccgaaatgggagcagcctaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggggtgaaatgccactcgaacccagagctagctggttctccccgaaatgcgttgaggcgcagcagttgactagacatctagggggtcaaggtcggccagtgaagacgatgggggataagcttcatcgtcgagagggaaaacagcccggatcaccagctaaggccccctaa

SEQ ID NO: 38510 - DNA, 231 bp, Glycine max
  Peptide Sequence Number=SeqID_130195
atggcgctgtcgcaacatgcccttttgcgggcgtgcgaggcgagggtcacgggtgtgctttccaaaggaggaaagatgcgcggagtcgccaccaacgtttatttgtggaaaatgtcggaaaaaccgaaggaaaccggtcgaaacgaaaattctaagttcgggagttgtcgacaaaagcggggctcttgctcctacgtaccctccatcgaagaggaaatcagacctacgtag

SEQ ID NO: 38511 - DNA, 549 bp, Glycine max
  Peptide Sequence Number=SeqID_130196
atggccacaatgatggaggccatgatgagcatgaagaagataatggaagccaatgcggttgcagttgccgctaccagcactgttgctaaggtgaacccgatgctcccatctgatctcagccaaatgaataatccaacctcagatatggtaggcaaagatttgggacggccccatgatgtgcaaattcaaaacaagcacgccttcccgccatatggcttgcctcccaactatacaccacccaatgtggtgtacactcccaatgaggatgtcaataactccgttctcatactcattgagagccgacaacctcatcatgtacatgtctctcaacccatgggggagatacatgaaattccccaccacaatctagccgacttcgagccttgcctcggatatgccactgaagggcaagcagttggtggtatacccctgcaaaacactttggaggggcctcaattttgcccccaaccacaacccttctatggaaaaatggtgggttacacaccttcaagctttgcagatttggtcttcaccggcaaaaggatcaaa

SEQ ID NO: 38512 - DNA, 504 bp, Glycine max
  Peptide Sequence Number=SeqID_130197
atgctggtggacttgttgatggtgtctccagagtctgctagggctgagacagtccagtgtcgcgaaccgtacgtacgcctacaatgggtacgtgatatatatcagcgacgatgccaggcaggtcattggacagctgtggctcgtgcatatcttcttcacctactgggttgcactctgtttgctaacaagagtgcaaccaatgtccatgttgtctacttggaggtccttcgtgaccttagtatgacagagaggtacgcttggggagtggctactttggttcatatgtacgaccagctgaacgatgcatccatgagccacagtcgacagcttgacggttacatcacactactgcagtgctggatttacgagcactttccctcggttgtggagtccaccgctgaccaggactacgacgaggcttctccgcgtgcgtgcaggtggattgcgacaaagaagaccgtgaagagaattcgcacgccgtcgtacagggagcgcctggactga

SEQ ID NO: 38513 - DNA, 1250 bp, Glycine max
  Peptide Sequence Number=SeqID_130198
aggagaatagattgggaccagctcttggccgggataggaggtagaacaatcagttggtcctcccgatggaaggaaggaaaagaaggagtccttttctcatgtggaagatacccaaacattccgctggtaggaacgaggggttgtattaattacaatcccgcgctcgctataagacaactagggtaccccatgaggggagcaccgacggaagaaagcatgtctcctttccttgtgagggatctcggcgcacaaaattccaagactatacaaaaaatccataaggcatgggaaaccccgttaaggaaagatcaagagcttagaggcattcgtaatggcatcattggtgggtaccacgaatggctgaaagttcgcatacgaggtttagattggctcgccaagttaaaagtcgtcagcgaagagaattttgaagcaccggaagaggacgaagaaatccaagctctcaaaagcgagttaggaaaggcaaaactcgccaaggagaagttcaagttggctgctacacacgttcggaaggagtgtgccgggttacgggaagagaatgcaattaccgcaagagcccttgaacaagagaccaagagggctcgcaaggaagagtatggccggaacaaattttgcggagctctatggggtagcaataatgaactcaagttgcgaagggaagaaagggaccagtcgcgagcacatagcatgctcatggagaagaacgcggccactgccgccgctgtcagttcggctgccgaagcagacccgactctcttggcaactacgcaccatcctccctcaaacatagtaggacggggaagggacacactggggcacgatggcagccctcacctgggatacaaccgagcggcttacccttatggattgccgcccaactattcaccacccatcttgcaagaagatgcgggccacattgcttctcccgtccatgaaaaagagcctcctcagcagcccgacgaagtccataaagaccctcaagattatgctcggagggatgtcgagttttatcccccgatccccgaagggccggcactaggcatgttgccccaacccaacatcgcagcatcgccaatagttttgtctatggaagggccgcccccggcaactgaagaaaggaggaagctcgatctcctcgaggaaagattgagggctgtggaaggatttggggactatccgtttgcagacatgacggatctttgcttagtacccgatgttgttattcccccgaa

SEQ ID NO: 38514 - DNA, 321 bp, Glycine max
  Peptide Sequence Number=SeqID_130199
atgggtgaagaatcatggtcattggaacacaaccatatgcataaagaactggaaagctggtcgaaagagtatatcaacctacttggtggtatagagagatttaagaaattaaagtgttccctacttgttgatgaattatctatggtgcatatgggatatgtcattgtttcacgatacaatgtgatcattgtttctctttcaaaacaacaaagcatgacatttttttcttttagaagtcagccatcaccagattcttctgtgcatcgcgtaatatgcattggtcatctgtatgagaatcattttgtacaagtaattgcataa

SEQ ID NO: 38515 - DNA, 348 bp, Glycine max
  Peptide Sequence Number=SeqID_130200
atggctcatggccgtcaagcgcttaccttcaataaggttgagttggtcatagccctccacagccccgtttatctttggccgatagggggtggagttatgatgctggatcttgaaatccccgaacatttcttgcatcattttgttattcagattggtgccattgtcagtaatgattttcctaaggagttcgtattgacaaatcaactccttctttatgaatctgaccaccacattcctcgtgacattggtataagaagccactttgacccatttggtgaaataatctatcgccacgagaacgaagcgatgaccattcgaagctttgggttcgatgtggtggaacattga

SEQ ID NO: 38516 - DNA, 522 bp, Glycine max
  Peptide Sequence Number=SeqID_130201
atggacttgaaagaaaattgtacttatgtcatgcacaattttaaagtgctaaaaaacaatggtcagtacagagtctgtgatcaccaatttaaattggtgtttattggggttactgttataagggagtgtgttctagaggacatcccttttagaaaatacatgtttgctggatttgcggatgttgtggctggccagtttgaacctgggctattggttgatgttattggtgttgtggaggaggttgtctttcgccaagtttcaggaaaaggtagaagggtagtccttaaactaaaggacttgagccagcaatcgctatcttgcactttgtgggatgattattgcttgcagtttttgaagttcttagatgattatgaaggtgatggcccaattatagttctattgagccattgtaggatcaaggaagcgcagggatcttatcccgcatcgatcaacaattctttcaaggcttcaaagttaattattaaccagcccgtgatcgagattcaagaattcaatgaatag

SEQ ID NO: 38517 - DNA, 246 bp, Glycine max
  Peptide Sequence Number=SeqID_130202
atggtgcccatgttcgatacgttggatgttgtgtatgttcgtggggggtgcattgagcttgtcggatggcccattcgtggggagctagagtggttaaagaatttaagcatttatgagggaatgcttaggcgctttaattggtccatggtcattgcacttgatggtgcccacattcatacgtcgtatgtggtgtatgttcatggggggtgcattgaccttgtcggatggcccattcgtggggactag

SEQ ID NO: 38518 - DNA, 219 bp, Glycine max
  Peptide Sequence Number=SeqID_130203
attcaaaggactaaccgcctgagaattctttgtcttaacacattggagggtacatcctttgtggtacaagtagaggatacgtctacttgggttgttgaactaagaataagagaggagaacaagggaaggtacatcccttgtggatctttggcttgtaaaggattttacaaggttgaaagaaatctcaagaaccacaggttgcttggggactggatgtag

SEQ ID NO: 38519 - DNA, 377 bp, Glycine max
  Peptide Sequence Number=SeqID_130204
ggggttacgagcaccctgtaggactgatagaggcccgtaaccagagctggaaaccccagggccctgttggacttttccgggtccactgggtgtctcttggggggagattggcattgcggtcgctgggcagaatgttgctaagtagcaatgtcatctatatctgtgtaagagtggtcatgttagtgcgcatgatccgcactcgtctctttgcagtggcacggatgaaatcttgcccccgtatgcatagtacctgtgtgatagcctccctctctggttgtgctcgcgcagttggccctcctccaatatcagggggtggcccaggaaccgttaaaaggaaactactgtgccccttaaccagaagtgcaagtctcggttaa

SEQ ID NO: 38520 - DNA, 264 bp, Glycine max
  Peptide Sequence Number=SeqID_130205
atggagctcatcgagaacatgacggctagcgatcaagcaatccttcacgatcgcacttatgttcccataaaaagaagcctcttagagctcagcacgcaggacgcgactttggcacaaaacaagctgttgactaggcaaatagaagcccttactgaaaccctcagcaagctgcctcaacaattacaagcgaaggatgccccacatgaggagggacacatgagcctggacaatgtacaagccaacaagacccctctcgagaagtaa

SEQ ID NO: 38521 - DNA, 189 bp, Glycine max
  Peptide Sequence Number=SeqID_130206
atggtgatttttagccatggaattgcagcgaaagataaaggagaagaggagaagcttcaccaccaagagagtggcttggataagaagcttaaagaggaagcttcaatggaggaagagaataccagagagagagggggaggaggggggggcgaggtgtgggaattgaaggagattagagagagaagttga

SEQ ID NO: 38522 - DNA, 259 bp, Glycine max
  Peptide Sequence Number=SeqID_130207
atggagtatgctatgcagttcttgatggggttgaacgaatccttctctactatcagaggtcaaattttatccatggatccctttccctcgataactaaggatcgttgcttcaagttgcatggttatcctccaaattatcagaggactagtttttcctcagaagtcaagaaacatttttcatcttctgaaccaccacacaaggttgctcaacaagtatctgttgatatgtctcactcaccatcttcctctggtgactcag

SEQ ID NO: 38523 - DNA, 132 bp, Glycine max
  Peptide Sequence Number=SeqID_130208
atggaagtgcttcttagtccaatagctcttaaggtggttttccccttgcttcttgactcaaaattcttcaaagatatggcacccatcctcctttccaattccctgtatggcaactcacaagcaaggaaataa

SEQ ID NO: 38524 - DNA, 1014 bp, Glycine max
  Peptide Sequence Number=SeqID_130209
atggcggaaccatcgaagaagcgaaagggcacttcgagtcagagtcaacggcattccgggccacaggaaacgccaattccttcctccattccctctggatcgttgttttcatcagaggaacagcgtatacggtacacaaacctcttttcctctcgttccattatagaccaaaaattcatagatatggatttcttcccaaatgagagttttgaatgctttcaagcatttgaaaactcaaatcttattccattcatgtctctgaaattaccagtttattctgatctagtcaaagccttttattctaatttagaaatcaatgaaggtaccctaatgtctgaattttatgggattaagatggtcattgacctatccctatttaatgatttaaccaaattgcctagtgaaggtgtgccttttgagggtacagtgattgatgattggaaattcgatttttctgtgcatgatgcccgccggttggtttgcaccaaccaagcggatatgaccggaaggcttattgccggttcattggcttttcaaagccgcatccttcattaccttattgttcgcatcttgcttccgagatcttcaaaccttgctcaggtttctgaagaagatctcattgtcatgtgggtctttcataaaggtttacaaattgattgggcacatcttgttagatatcgcaagcataaggcattgcgattgaatgctccattgccttaccctcatcttgttacccttttccttcaacacttcaacatccctcttgattctgaaccttatgttccaatcaagagatctttccttataggcgcttcagtcatagcatcttttggctatcaaaaggagcatgatggctcttgggtgaagaaaggtactcgacatgttggtgaagaaggacatgatggagaggattcatctctcctttcaaagataatggacaggtttgatggtcttcaacctttgttggtgaaaggtttgacactttggaattacagtggatatgtgcttcaatga

SEQ ID NO: 38525 - DNA, 252 bp, Glycine max
  Peptide Sequence Number=SeqID_130210
atgaggcttcactgttatcaagcaagtcggagacttagcatgaccatagattcacctctgcttcctatgttcccatggactcggggtcgacaaaagtggggcttttgctcctacatatcctcaattgtgatgaggaacttagatctacgtagttctttggaaaatcgacgaacaatgaagaacgaacgaagaacagtgaagaacgttcatggaattggtcacagaaacgtcacggaagcgcctcagccttga

SEQ ID NO: 38526 - DNA, 333 bp, Glycine max
  Peptide Sequence Number=SeqID_130211
atggttgaagcagagagttcacaaaatttacaaagcacgcaagattctactgattggacaaatgatatatattcaaaagtcaaaggacctgaaaaaagaggacgtgtgcgttgtcttggcaagcttccacatcaagcaagttcatctcaaagctcttatacaaacaatagaattcaaaagttggagaatttgcttggaaaccttgtagctgtgcttaaagtacgatttgcagaagatccacaaattaatcaagtcttagaagctatagatcaagaggtacctacaaatgattctaccggtaaagatcatcaaactacaaacaatcttagctag

SEQ ID NO: 38527 - DNA, 435 bp, Glycine max
  Peptide Sequence Number=SeqID_130212
atgaatccggtttatggtatcctagaaattccacatgcacttctcccttaccctcaattgataactttgtttctgcgtcattttcaaattccgcttgatgatgaaccatttgttcaagtcaagcgttcctttgcaattggtgctggtgcagtgacttcctttggataccgtaaggatcggaatggtcaatggctgaagaaagacgcactccctcctcaagatgagcgtactccttctcctcctcctcagcgagatgattcagccctcatgactgaagttctttccgagttacggggtcttcattcttatgttggtgaacgtttcgactcactggatactcgttttgccagaatggatattcgcctcacacagcttgaagatgtgggttacattcgtcagagtttcgatcttccaccaccacctccaccttcttag

SEQ ID NO: 38528 - DNA, 306 bp, Glycine max
  Peptide Sequence Number=SeqID_130213
atgggtgccaagtacctcgaagtggtcaaacgagggtcgtatcccaacaaacggatggcgcagaatgaccataatttgtctctacgtgcctttggacacaatcgagcctgggtggcaaggcacataatgaccataatttgtctctgtgtgccaccggacacgatcgcctctggatggtggaaaggtgtggggaatgaccataatttgtctccgcccacctctcgacttattgtccctgaattacaaagggcacagaatgaccataatttgtctctgcgcgtttatcactcaacttgcgaaatctga

SEQ ID NO: 38529 - DNA, 342 bp, Glycine max
  Peptide Sequence Number=SeqID_130214
atgtcggccattgtgttttctattcaatccctgaataatatttggatgatgtccattaggaaatgtgcgatcggcgccatccgtgccggtgatgaggacatgaccaagagcaagggaaaggatccacttgaaggacttggaggacctattgatgaggacatgaccaagagcaagggcaaggatccacttgaaggacttggaggacctatgacaagggctagagcaaggaaagccaaggaagctcttcaacaagtgctgtccatactatttgaatacaagcccaagtttcaaggagaaaagtccaaggttgtgagttgtatcatggcccaaatggaggactaa

SEQ ID NO: 38530 - DNA, 149 bp, Glycine max
  Peptide Sequence Number=SeqID_130215
gtattccgattggtgtcaatcccaaaagaaaggtggtgtgggatcctataattagcaaatttcaggataggctgaacaggtggaagatgggtagggctaaccaaatcctgtctcggaagatgcttgggttgaggatgggattcccttga

SEQ ID NO: 38531 - DNA, 246 bp, Glycine max
  Peptide Sequence Number=SeqID_130216
atgaaaaataaaaggctacaacgcgaagggttttcctctaagctcagacataatatcaaaattcccaacggtgataatgctcgtaattgggttgcgaacgtggtgttcaaatttcacaatgatctaacggtgaatgagcccgagatcgtcatttttctaagacaggtttggtgtgctacgggaaaaagaaagggttttgagaggagaatgggaaaaacaaaaatgaggccaaagagaggcatctga

SEQ ID NO: 38532 - DNA, 291 bp, Glycine max
  Peptide Sequence Number=SeqID_130217
atggagtcaggtgacatgcgggggtatcgtatggttacccgcacctttcgtcaaccagggtcaaacgagcccgttgacgcgcagagactaacgtcgtcttctgcaccttttgccatccagggacagcgagtcaggtggcaagaggagataccttatggtcatccgcacctttcgtcaaccgaggggaacgaattcgacggtatcaggatgatgttggtcgcggggacgatcaagttcgatggtgtagggaagtttcgtggttgtcccgctttatcgctttcaaaatgctga

SEQ ID NO: 38533 - DNA, 247 bp, Glycine max
  Peptide Sequence Number=SeqID_130218
tattgttctttcgcttacgaattttgatgactcctttaatgagcagatcatggttagaatacgaggtttgggtcgagctttaggaaggattatcagaagagccctcgggagagaagtcaactgtgatgtagatgatgctcctcagcggcgaaggcccacagcatccgcacgtaggcaatgggaagttgcacttgttgctgaggatgttgacaatatggatcatgccgataaggaagtccatgaatag

SEQ ID NO: 38534 - DNA, 195 bp, Glycine max
  Peptide Sequence Number=SeqID_130219
atggatgaatactttagggaacatgagatggagttgcaaagactaaatcaacatgaagaaaatgataagaagaagaagggaattgctcttaaagtatcatcttcaatccaagaagaaagtgatatggaagattcaattgacttggatgatgatgaaaaacttagtctttgtcaaaagattcaacaaatttcttag

SEQ ID NO: 38535 - DNA, 325 bp, Glycine max
  Peptide Sequence Number=SeqID_130220
atggaagggaaagcatttgtttggcaaaggcattacacggctcataacagcaataaaaggaaatcttggcagcagattcttcaggatatggcttcaagatttgacatggggaattatgatgatcccatatcagaattatctaaaccacgccaagaagttagggtagatgttactaaagaaatggctatcaactttttcttgggaggattacatgcttcatttgaaaaattagtctgtattcataaccctaggtctctacaagatgcaatgcgattagctagattgcaagatgaggtcctacaagaattagaaagaaaattggcag

SEQ ID NO: 38536 - DNA, 394 bp, Glycine max
  Peptide Sequence Number=SeqID_130221
tgcagtggaaatcttatacagtgatctgggctgttttatccgacatcgtggttgatagtttgcttgcacaattttttggcagtgccacgaaacgtcttaaagaaagcgacattgtctgcgactcaaccaacggttttggctctgctatggctatcctagatattactggcttgaacaacaatgacctcaacaaaccttttaggtttgaagggtatcatttcaaacgttggcaacaaaagatgatgttttctatgagaaaagttgcctatgttttgaacactgatattctggtggtacctgaagatgctgagaaggaagtgaaggataaaatgactatggaattagctctttggaatgaaaatgattacctatgcaataatttcattctgaatgg

SEQ ID NO: 38537 - DNA, 960 bp, Glycine max
  Peptide Sequence Number=SeqID_130222
atgcagcgcacggcgatccagggcagcccggcgatgctggcggccatcggcggcgaatgggtgcgcggcgcgccggtcgccgagcatccggtgcatccgttccggaaatacttcgagcagctgcagctgggcgacagcctgttgaccgcgcgccgcaccgtgaccgaagcggatatcgtcaacttcgcctgcctgagcggcgaccatttctacgcgcacatggacaagatcggcgccgccgactcgctgttcggcgagcgggtggcgcacggttactttgtggtatccgccgcggccgggctgtttgtcgacgccgccgtcgggccggtgatcgccaactacggcatggaaaatctgcgctttatcgagccggtgaagatcggcgataccattcaggtgcggttgacctgcaaaaagaaaatccgcaagccgcagaaaaccgccgaagatcgcccgcacggcgtggtggtgtgggatgtgcaggtattgaatcagcaacagcagccggtggcgctggggacttcgaagcgtgatgcgcgtttgccgccgccggcccccggcggcggcaaatcattcagatcagcggctgaccgcgcagctgttcaagcactttcagcggtgaacgctgcggatcctgcatcttattcaccggcagcaggaagagaagcaaatccagctgctgcccggcgggaacgtcagcgccagctgcggcccccgttgctgataatcgccgtcggccttcatggcgtcatgcaactgcagcatcaggtggtcataatggctgcggcgggttttggtgatgcgcacctggtgctgcagccaactgccgaaggcggagtagcgagcgagacgcggcataaagcgtgccgccagctcagggcacggctcgccgacccgccattggcgatgctcgccgtgcgggttgatgttggtgaaatgcgcagaatgcgttcgccgtag

SEQ ID NO: 38538 - DNA, 142 bp, Glycine max
  Peptide Sequence Number=SeqID_130223
atgaccactaatttgtctctgcgtgccatcaacacaactgtgcctgaatggaaaaggaatgaccataatttgtctctgcgtgccatcgacacaactgtgtctgaatggcaaaaagacacaactgtgcctgaatggcaaaaag

SEQ ID NO: 38539 - DNA, 512 bp, Glycine max
  Peptide Sequence Number=SeqID_130224
ttgccgctactagcgctgtcgctaaggtgaacccgatgctcccatctggcctcaagcaaatgaatcatccaacctcaaatatggtaggcaaagatttgggaagtacggacgaccccatgatgtgcaaattcaaaacgagcacgccttcccatcctatggcttgcctcccaactatacaccacccaatgtggcatacactctcaatgaaaatctcaataactccactccgatactcattgagaaccaataaacctcatcaggcacatatctctcaaaccatgggggagacacatgaaattccccaccacaatctagctgacttcgagccttggctcggatatgccactgaagggcaagcagttggtggtataccctttgaaaacactttggagggccctcagttttcgcccacaaccacaaccattgcattttgcggtggggaagagtccctcctgctatggccgaaaaagggaaaggacggatcatctaaaggaaaggctcagggccattga

SEQ ID NO: 38540 - DNA, 153 bp, Glycine max
  Peptide Sequence Number=SeqID_130225
atgtttgcttacagtcctttcgctaagcgcaagcctcgcgctaagcgcatctctgttcatgcgctaagctgtgagtctcaagcgcttagcgcccaacccttgcatctgaggttgatttggtctgctaagctggcgaaggttgagctaagctaa

SEQ ID NO: 38541 - DNA, 294 bp, Glycine max
  Peptide Sequence Number=SeqID_130226
atgaaacttgccaaatacaggctaaaggcccaagtggagaaggacgaaggcccaagtggagaaggacaaagcccccaaacttatcaaggtaatccttgtggcgtctaccctgacttatcttccttcactggaagtggcgtctacccagacttatcttccttcaccggaagtggcgtctaccctgacttatcttccttcaccggaagtggcgtcatccaaaccttcgtagcctgtatcaaacgatccgctcctactcaggttcacatcatctggtatcagagcttcagctcttga

SEQ ID NO: 38542 - DNA, 510 bp, Glycine max
  Peptide Sequence Number=SeqID_130227
atgaggcttcattgtcatcaagcgagtcggagacccatcatgaccacagatcgacctccattccttatggcttacatagacctagtccccagtggagtcaccaactgtcgcgacttgcacaccggcgggggcacgacgcgaggctcacggctgcattttctaaagaaggagaaaagtgcggagtcaccaccaatgtttattcaaggaaaacgtcagaaaaaccaaaaaatggaaaaggtcaagggtctgcgtatttcgaaaatgagggttcggaagctgtttacacacagggaagggtgtttccctcgcttctacatatccttgggtgcgatgaggaactcagacctacgtagttctttaagaactgaagctgtcgcaacgtgcccttcacgggcgagcgaaggcgaggctcacgggtgcgctttccaaaggaggaaagatacgcggagtcgccaccaacgtttatttgtggaaaacgtcagaaaaaccgaaggaaaccagtcaaaatga

SEQ ID NO: 38543 - DNA, 234 bp, Glycine max
  Peptide Sequence Number=SeqID_130228
atgcccgtttgcgggcgagcgaggcgagggtcacgggtgcgctttccaagggaggaaagatgcgcagagtcaccaccaacttttatttgtggaaaacgtcgaaaaaaccgaaggaaaccggtcaaaaagaaaattccaagttcgggagttgtatttacgtttgaggaaggtcgacaaaagtggggctcttgctcctacgtgccctccatcgaagaggaaatcagacctacgtag

SEQ ID NO: 38544 - DNA, 78 bp, Glycine max
  Peptide Sequence Number=SeqID_130229
atggggattttcgcgaagatcttcagccgttcttcgacgttcttcgttcgttcgtcatcgttcttcgatcttcaacgg

SEQ ID NO: 38545 - DNA, 262 bp, Glycine max
  Peptide Sequence Number=SeqID_130230
tgctttaaaaggtcttgatgatgctccacagcctaaatcaaaggctcctactaggtggattgtcgtcaagtgtaatagacaaaaaggaagtactgagtgcggctattatgtcatgcactggatgtcgaccaccattttaggaagtttcaagaataactgggaagtgtatattaacgatcctagatcattggagccagagagactaaaggcactgcggatccagtgggcacattattatctccgagttagagctgagagctag

SEQ ID NO: 38546 - DNA, 510 bp, Glycine max
  Peptide Sequence Number=SeqID_130231
atgtggggcatcccttttatccttgaaccaaaccaaaccctgacatgtatcatgtctagccattctacaagccttgagccaaaatcccgactcaccataaaccttgacccaggtgagaatgttaaaccttaccctcggaagcaaaaaaaaaagaaggaaaggaaatttccaatcaaagagaaagcaaaaaaggaaggaaaggaaattcccaatcaaagagaaagcaaaaaaggaaggaaaggaaattcccaatcaaagagtgggaggaagagaaaaaagaaaagaaaggaaatttctaatcaaagagtgggagaaagagaaaaaagaaaagaaaggaaattcccaatcaaagagtgggagaaagaaaaaagaaaagaaagaaaattcccaaccaaagaatgggagaaagtaaaaaagaaggaagctcctggtcaaagaaaccagaagaaatgtgcagagaggtctttggaccagacaatatctgaacagtacagaattgtcatcaaatga

SEQ ID NO: 38547 - DNA, 573 bp, Glycine max
  Peptide Sequence Number=SeqID_130232
atggagccacttcaaaactggggtgacgtacgtgaagtatacatcgttaaaaggctcaacaaggatggcaggagatacgggttcatgcggttcaagggagtctcggatgcaaaaggattggagaaaaagaaccccattaggaggaagtaccccgacgaagcaagtaagccctgcgggataactactggtgctcttcggagatcatatgtggacgtgatgactaaggggggggggtgccaaggagacaaaagggcagacgaggcacaaacaccaactattctgatcaacccagatgaaggtggggaatattggtgtaacgaaacctgggtgggcatgctaaagaaggtgatggaggtggaaaccttagaggatcgtatcacttgggagttaggatataacgtccgcactaagttcctcggagacgacatggttcttctccctgggatgtccgatgacaaagctcaactcctcattcaatcagagacggaaagcgatgattctctcttttactcactggagaagtggacgccgaaatgtagacccaataacagggttgtttgtgggatcctctag

SEQ ID NO: 38548 - DNA, 334 bp, Glycine max
  Peptide Sequence Number=SeqID_130233
atggccgactttcgtctctgttcgaccagtcggtctcacagtcaggcaggcttataccattacgctcacgagcagaatcttagcttgagcctaccttcgcacacctccgattggtcgttctgtgtcatcacctcccacctatcctacacattcgatcaaggttgtcaatgtgaagctatagttaaggtgcacggggtcttaccgtctagccgtcgctacttatgcgacaaggaatttcgctaccttaggacagttagagttactgccgccgtttaccggggcttccattcaaagcttataacacttctccttccgaccttccagcaccgggcag

SEQ ID NO: 38549 - DNA, 387 bp, Glycine max
  Peptide Sequence Number=SeqID_130234
atgggtaacgtagaggaggcgcaagagcagatgaaggccgacatggaggccatgaaagagcaaatggccacaatgatggaggccacaatgagcatgaagaagataatagaagccaatacggttgcagttgccgctaccaacgctgttgctaaggcaaagatttgggaagtaggggcggcccccatgatgtgcaaattcaaaacgagcacgccttcctgccatatggcttgcctctcaactatacgccacccaatgtggcgtacactcccaataagaatgtcaataactccactcctatacccattgagagccaacaaccccaaactgatcatgcacatgtctcttaaaccgttggggagacacatgaaattacccaccacaatctag

SEQ ID NO: 38550 - DNA, 561 bp, Glycine max
  Peptide Sequence Number=SeqID_130235
atggcgcctaccaggcaccctctggacccagataagtccaacaggaccctgggatttcccgccttgatcacaggactctgccagtcgttcggagtccccgtcgcacctagcaaggtgattcggccgcccatcacccgagcttttattgagaagtattgcacacggagacaggctcagggggatgctccgcaggccgcagacacgccgccacctcatcagactggcccagctagatcatttgatacggagcagtatttgcggcatttggttcgccagcaggcggccaaccaccgggcgcatgtacagacccatgattgtctttaccagttgagcctcagcctacagagccagggttttacttcttttccgtgccctactccggaccagttcagggcagaggtcgcatggcttggagattggcctgaggctcgggcaggagaggcgccagcagaggcgccagtagaggcaccagtagaggctcccgatgaggcagatgaggcccgcgaggacgaggagatgaccgatttaaatgatttcttaggagggagcggcgccacatga

SEQ ID NO: 38551 - DNA, 240 bp, Glycine max
  Peptide Sequence Number=SeqID_130236
atgggaggtcaatttgctttgttaatagggcagaaacatttatcaggctggaggggtaaacaagtgaatgtgcaacgggatgggttgaggttgagtatattttggattctatatccaaatgatgcaaagccccaagctgttcactcaacagaggcaatggagcctcataggggggcacatcagagaatggagttcttgcttatagtaatgctaccacgaataagaatccaaggaatgtaa

SEQ ID NO: 38552 - DNA, 318 bp, Glycine max
  Peptide Sequence Number=SeqID_130237
atgggtaaggaggagtgtaaggaggtaagtgactcctccaagaggtattatgaggcatcgaatccctatgataggtgtgatcaagggttcccactgaaccctaagagaataaaggtcattcctaagtggcccattccaccaagtataagaaaaatttggggcttccatgacttagcaaacttttacaaaaggtttgtcccatatttttctatacttgtagcaccactcattgagttggtgttcatcgaaggagcccagagtatgaagaacctcaagattagaggtcaaatcctttccaaggtggagggaatgaagtaa

SEQ ID NO: 38553 - DNA, 204 bp, Glycine max
  Peptide Sequence Number=SeqID_130238
atggttctggcatctcaagtgatgcaagctccattggagcttcggaatgaagaaaggaagagagagaggagacgccacttcaaggagaagatgagtctagaagaagctcaccaccataggaggccatggataagagcttggaggaagaaggagatgaatgaagggagaggaagagaagagcacgaaattttgtgctctaaataa

SEQ ID NO: 38554 - DNA, 282 bp, Glycine max
  Peptide Sequence Number=SeqID_130239
atgtctgagcacggaagtggatccttctcagcaaccacagaggatggaagtgagtttagtgagaacaagacaaatgaaggagttttgaaaataagtgatgaaaaagtagttgaaaaagagcaaaaaaatgaagtattagctaaagaggaagagcaggaaataagtaaagtggagaagcagaaattgacagcatctaacaaaggcaaggttgtactagatcattcgccaattcaacatcttccttatccaaacgctccatcaaaaaaggataaggaaaagtag

SEQ ID NO: 38555 - DNA, 480 bp, Glycine max
  Peptide Sequence Number=SeqID_130240
atggcgttgatcgtgggtgcccgcacggcgtcaggccgtcgcaatattggtaaatctgttgagttatttggcctttgccagcctggcctgcgcttcgttaacccggttaacggcgtaatgacacaattacccgccacggcagatcgcgcactttggctggtgacgggtgatgtctacgcctttgacaatcagcatggctttgcgtttgttcgcgccgaacatctgatgccgctcaacccggatgaagcaccgcagattctcggtgaactcaccgaacctttcatggaacacctcccggttaaaacgacgctgcgcattgcgctggttggcgactacaatcccgctgttattgcgcatcaggcgatcccgctggccattgacgatgccgctgccgtccttgacctcaccgccgattacgactggcttgccaccacggagctcaccagcccggaagatctggtgggctacgatgccatctga

SEQ ID NO: 38556 - DNA, 293 bp, Glycine max
  Peptide Sequence Number=SeqID_130241
atgggtcaggatcaacagatgttggctgtgagactaaaaaagtctcgatcggaagatgctgacatctctggaactggtgcggataaccgtaaggcgtctttgcatgctatcgaactctcgggtcgctggatagcaaaagtgtgtgggcagataaccatcgggtgtctccgcatgccactggacttatgggtcacgatagcaaaaggtggggtggtcgacaaaagcggggcttttgctcctatatatcctcaatttgtgatgaggagctcagacctacgtagttcttgcaagcg

SEQ ID NO: 38557 - DNA, 821 bp, Glycine max
  Peptide Sequence Number=SeqID_130242
atggctaaattcgatccggagatagtcatggaattctatgccaatgcctggcctaccgaggagggagctcgggatatgcgctcatgggtgcggggccaatggatccccttcgatgcagatgccctcagccaattcttaggccgcccgctgatcttggaggaaggtcagcattgtgaatacaaacaaaggaggagccaggtttccggctttaacgaggatgccatcgctcagcttttgtgcataccggggcaagatttcgcctggaccgctgcagggagacgggtgcagatcatgcgcagtagcatgaccaccctgacccagatatggatgatgttgctactcaataacatcctgcccagtgaccacaactccgatctccctctaccaaagtgtcagttggtgtatgccatcctggcacagatgagaagggcacctacgaggcaccatgtggacccagaaaagtccaacagggcattgggatttccagcactgatcacgggcctctgccaattttacagagtctcggtcgcccccagcaaggtcatccgatcgcctatcaccagagccttcattgagaagtactgcattcccaggctggcgcagggtaaggcaccacaacagcctggggatgatcggcagccaaccataggggttaggtgtggctgcatgagactttctactagtacacgcgctaccgttgaggctgcagtagcatggccgggggattggcccgaggatcagacaggacccaccagtgcacctagaggtgaggacgaggctgaggatgatcaggacatggcagacctaatagatttcctctt

SEQ ID NO: 38558 - DNA, 117 bp, Glycine max
  Peptide Sequence Number=SeqID_130243
atgtctgaaatggccacgagaaagctcgccacaaagagatccaggaaggacaccattggagaaggctctagcgctgcccagccagcaaacacggattacgacagccgccgattctag

SEQ ID NO: 38559 - DNA, 276 bp, Glycine max
  Peptide Sequence Number=SeqID_130244
atgttgattgatgttggaaatgcattggcatgtgcatgttgtgtatgttcgtggggggcgaagtgcactgaccttccaaggtctttggcacttgctttgggccatgttcatacgttggatgttgtgtatgttcatggggggcgaagtgcactgaccttccagggtctttggcacttgctttgggccatgtttatatgtcgtatggagtgtatgtcatggggggtaagtgcactgaccttgttggatggcccaggcgtgggtgacaagcgtggttag

SEQ ID NO: 38560 - DNA, 801 bp, Glycine max
  Peptide Sequence Number=SeqID_130245
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcttccgtaatgttacggaaccttacggattacgtaatcatcccctttttggcgttcggaatgttacggaacctcacggattgcgcaaagaagggatggttacgtatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 38561 - DNA, 220 bp, Glycine max
  Peptide Sequence Number=SeqID_130246
atgaggatcaaaaggtcttttaaggttgtaatggggccaaggacaaggcttgtagtgagcttcaaaacaaggaaagggaaacaaggctcaaaaagggctatcaaaggaattaattcaaggacgcatcaacaagaatcaagccaaggatattgtgcaagcaatcaatggggcaaaacacaccaaatgattatgatgatggatggctcaaattctcacaaag

SEQ ID NO: 38562 - DNA, 174 bp, Glycine max
  Peptide Sequence Number=SeqID_130247
atgtcgcggaactttacagattacctaacgatgggtgttaagtacctcgaggcggtcaagcgaaggttgcatgccaccaaacaatggttcccagacgaaattagggtacaggtagttatcctcatagctaggttccctgaccctaactatggtgttaaaatggtaaatttataa

SEQ ID NO: 38563 - DNA, 309 bp, Glycine max
  Peptide Sequence Number=SeqID_130248
atggaaaaagaaaaacatgtctcctatagtagtcatgactcttgcaagagcctaagtgaagaacttagtgactattatagaggaaggcataggtcacatcctagacctcactcccataggagagaaaaggaaagaaatcctcatgaggcaaacattaacctcccatacttccatgggaaggacaatgttgagcaactctttgcttgccatcatacaagtaaggaaaggaaggttcctttggctacccttagcttccaagggtatgcactctattggtggacttcctttgttaggggtgggatcctctag

SEQ ID NO: 38564 - DNA, 282 bp, Glycine max
  Peptide Sequence Number=SeqID_130249
atgccctcgccttccgaggactacacggcgtcgcacctagaggactacacgtcctcccctttagaggactacacgtccttgcctttaaagggctacacgccctcgcctttagaggactacacgtcctccccttcagaggactacacgtcctccccttcagaggactacatgtcctcacctttagaggactacacgtcctcaccttccgaggactacatgtcctcgccgtcggagggctgcacgccctccccttctgagggatgcatgccccttccttcatag

SEQ ID NO: 38565 - DNA, 522 bp, Glycine max
  Peptide Sequence Number=SeqID_130250
atggtctcccgaggtggagacgaaagggatggatgtttgtttcacctcggggagtcgcatgacatggaaacctgtcccgtggtggaagaattgcttcagcggctcatggattgcgggcagcttgaagtgtccataggagggaaggaagaaccacaaatttgcatgcagtcggaagagaagaagattcctctaacccccaaggccctagtgatatgttttactaggaaggggatcggctccacacccatatacccccgaacggcacccaagccaacaccatttgcatatcaaagtaataaggccgttccgtggaagtatacctctctcgtgtccagcgaaagaattacaaccaaagttgactccctatcagctaaggtgtcgcaacctacccttcggcgggagggcgacgcgagactcgcgggatgcgtgttccacgaaaggaatacgcgcggagtcgccaccaacgtttattcgaggaaaacgtcgaaaaaaccggaaaagacgcgatctacgaacttttaa

SEQ ID NO: 38566 - DNA, 252 bp, Glycine max
  Peptide Sequence Number=SeqID_130251
atgattcctacaagttcaatgactatgaaattttgtggagagttagaaattagcattataaaactggggaaaaaggattcgttccaaaacatactttctatgagtgaagagttcagaattcggctatcaaaccaagtggtagtcaagttagacattagcaatataaaactgaggaaagggtttcattcccaaacatacattcctaacagtgaagagtttagaatttggcttccaaaccaagtggttttcaag

SEQ ID NO: 38567 - DNA, 597 bp, Glycine max
  Peptide Sequence Number=SeqID_130252
atggcaagagtagccaaggtaggtaagatcatggtacaagagttggaccatgtgaagcaaaataggaacgaggtagtcagaataccaaggaaacatttggagggaaagacgaagacattggcagatcaaggggaatgggcctcgtttattgatgccttcgcactattgatatttggtgtcgtcctttttccaaatatggagggattagtggacctagccgcaattgatgccttccttgcttatcaccatagcaaggaaagcccggtcattgttattttggccgatgtctatgacacgttcgaccgaagatgcgaaaagagcggcgcaagaattatttgttgtacaccgactctatatgtgtggcttgtcttgcacctttttcaccaagaaagtaagcccacctatccactgaaaggatttccaaatgttcccttgatgggaaaaaggggttgtatcaattataatcccgtcctcgccataagacaactcagctaccccatgagaggagcgccattggaggaaagcatcacgcctttcatcgcccggggttttagtgaccccaatgcgagagtacttcaaggagtccgcaaggcatga

SEQ ID NO: 38568 - DNA, 750 bp, Glycine max
  Peptide Sequence Number=SeqID_130253
atgactcgctggataaccttgtttgcgctggcagccaccgtcgcggtggcccttcccgcccgggcaaacacctggccccttcccgctcctggcagcaaggtggtcggggaaaaccgctttcatgtggttgaaaacaacggtggttccctggaagcgattgccaaaaaatataacgttggttttctggcgctgctgcaggccaatccgggcgttgacccgtacgtcccgcgcgcgggcagcgtactgaccatcccgttacaaactctgctgccggatgccccgcgggaggggatcgtgataaacctggcggagttacgtctctattattatccaccgggcaaaaaggaagtgaccgtctaccctatcgggattggccagctgggcggcgacaccctgacgccgacgatggtcaccaccgtctcggataaacgtgcgaaccccacctggaccccgacggccaacattcgtgcccgctataaagcacaggggatcgatcttcccgccgtggtgccggcaggcccggataacccgatggggcaccatgccatccgcctggcggcctacggtggcgtctatctgctgcatggcaccaatgcggactttggcattggcatgcgcgtcagctccggctgtattcgtctgcgcgatgacgacatcaaaacgctgtttaacgtcgttacgccgggaaccaaagtgaatattatcaacacgccgatcaaagtttctgaggagccaggcggcgtgcggctg

SEQ ID NO: 38569 - DNA, 275 bp, Glycine max
  Peptide Sequence Number=SeqID_130254
atggaaagaaaaacaagagagaaaagagtggaagaaataagtcaagatgaaagagacaaaataagagaggaagaaagaaggaaaatactaaaagagttaagaaaagaaaaacatgcctcctatggtagtcataactcgtgcaagagcctaagtgaagaactccgtgactattatgaaggaagacataggtcacatcttagacctcactcccataggagagaaaaggaaagaaagcctcaagaggctaacactaacctcccatactttcatgggaa

SEQ ID NO: 38570 - DNA, 621 bp, Glycine max
  Peptide Sequence Number=SeqID_130255
atgtgtcacaaatttgcatttgaggcactagataaaagtcttaaagacatcatgcaaaacaatttgccttttggagggaaaattatggtttttggtggagatttccgacagatcttgccaattgttccaaaaggagatggaaaaattggacaatataatgacggattttcagaaatcactattccagacgagtttcttataaaaaattatgatgatcctatccatgctattgttgaagccacctatcccagcttgatagataactacagtgacacaaattacttgcaaaaaagagttgttcttgcctctaaaaaagaaattgttgacaaaataacaaccttctccaagttcctttctcctatcacagacaatggctgcgcaactaccccaaatatgttttattccactatgatggcgagatacatttcattaggaagggcacacaacctcaacgaaagcgtgattctacgtttggtcgctggtgacaaaaacaccactttcaccgttcatattgacggacctgcacaccaccactctagcctaaagcccatcatttatagaaggagatacatcttcatagttgatatcacagatgatatgctacagcagaacctgcctttg

SEQ ID NO: 38571 - DNA, 372 bp, Glycine max
  Peptide Sequence Number=SeqID_130256
gatacaagtggagatgctactccaccatctccaaaaaccgcaaggctcatgccggagattattaaacttggtgatcaaatgagaagaatgagttatgacaatgaagaaaggatggagagaatgagaaaggagaatgggcaaagtttgggaagaatacataggagtaaagaagttttaagtgtaaggattgaaaatatagagcgaagaaaaaagattaggggtatgaagaggatgagagaggatggaagaatgagaggtatagggagagaagaaatcatagaagatatggaggtagacaaagaaaggaagggagtgaaggtgaagatccctactttaaaagggacttatgatccagaagtgtatcttgagtaa

SEQ ID NO: 38572 - DNA, 120 bp, Glycine max
  Peptide Sequence Number=SeqID_130257
atggctggccatatgggtagaggtgtcatagaggagcaggtatggaggaagggaccttggactgctgaagaggacaggttgcttgttgagtatgtcaggttgcatggtgggatcctctag

SEQ ID NO: 38573 - DNA, 555 bp, Glycine max
  Peptide Sequence Number=SeqID_130258
atgaagcacttcactgacaccctcatcagtgccaacatagctgaacgttgtaatttaccaagatataaagcggatactaacccaatcaacaaaaccacactcacactcaaattaattccaatccagccaaaccgctcccaaaccaatccaccgaagctgccgagcaaacttgaaccaatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 38574 - DNA, 585 bp, Glycine max
  Peptide Sequence Number=SeqID_130259
atggctcgtctgatacgctcccgctggctgtggctggcgggagcgcttctcattttatgggggctgattctggctgctgaccgcctgtggccgttgcctctgaaagaggttaaccccgcccgggtcgtggtggatgagaagggcaccccactctggcgttttgccgatagcgacggcatctggcgctatccggtgacgatcgaagaggtctccccccgttatcttgaggcgctgatccagtacgaagatcgctggttctgggatcatcctggcgtcaacccgctctctgttctgcgcgccgcctggcaggatttaacttccggaaaggttgtctctggcggcagtacgctcaccatgcaggtggcacggttgctggatccgcatccgcggactctggggggcaaaattcgtcagctctggcgggcgttgcagctggagtggcatctttccaagcgcgatattctcacgctctatcttaaccgtgcgccgtttggcggcacgctgcagggcgtgggggcggcaagctggacctatctgggaaaacccccgtcgcagctcagctactccgacgcggcgctgctcgcg

SEQ ID NO: 38575 - DNA, 630 bp, Glycine max
  Peptide Sequence Number=SeqID_130260
atggcgggattgctcattataatccgcgccacaccatactcaggtatgcaaaacaacagaacattgacagaggttatcatggctattgaacgtactttttccatcatcaaaccaaacgcggtggcaaaaaacgttattggcagcatcttcgctcgctttgaatcagcagggttcaaaattgttggcaccaaaatgctgcacctgaccgttgaacaggctcgtggtttctacgctgagcacgaaggtcgcccattctttgacggcctggttgagttcatgacctctggcccaatcgtggtttccgtactggaaggcgaaaatgcggtacagcgtcaccgcgatctgctgggtgccaccaacccggacaacgcgctggcaggtaccctgcgcgctgactacgctgacagcttcaccgagaacggtactcacggttctgactccgttgaatctgctgcgcgcgaaatcgctttcttcttcgctgaaggcgaagtgtgtccactgaatacctccgaagtcgccattcctgcggttcccaataaaaatggaaaaatcaacctgctggatctgaaccgtcagcagatgcgcgagttcttcaaagagatgggcgaaaagccgtttcgtgccgatcag

SEQ ID NO: 38576 - DNA, 393 bp, Glycine max
  Peptide Sequence Number=SeqID_130261
atggtgaaagttggaacctcttacgtgccgatcaacgtctcattttcgccaaaaagttggcccagggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcgtaaccaccacaccccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaa

SEQ ID NO: 38577 - DNA, 636 bp, Glycine max
  Peptide Sequence Number=SeqID_130262
atgacagagaggtacgcttggggaatggctgctttggtgcatatgtacgaccagctgaatgatgcatctatcagccacaaccgacagcttggcggttacatcacactgttgcagtgctggatttacgagcactttccgtcagtcgcagactccactactgatcaggactacgacgaggattctccatgtgcgtgtaggtggattgtgacgaagaagatcgtgaagagcattcgtacgccggcgtacagggagtgcctggaccgacttcagattccggatgtgtgttggatctcgtatggggattaccgattggtccgggacttccacatcagatcatgctattctggtctcttgcgctgggggcctgttgctgtttattatcgaccagagagggtcgtgcggcagtttggatacacacagaccattcctgctcctcctgtcgattcatgggtctcgtatgatgatataaacgacaggtggatgcactactcagatcatatcattccaacaggtgatgtgtgcgctgtgccaggtcagtgtgctagtgactacatggactggttcttccgcatctcgcatcctttcatgacaccaggccacgcatcagatcctttgcatgatggtcatgccccgtag

SEQ ID NO: 38578 - DNA, 444 bp, Glycine max
  Peptide Sequence Number=SeqID_130263
atggtatcaagaaaaagggccagagctgatgacatcccttcaccatctaatccagctcctccgttagcaacaataggaccggatgtccagaactcccaaaccttagtccttatgctaaagagcttattccaaggacatgttattatcatgcacaacttacgagaattggctcaccaaaggccaattataactatggagcagttccttgagcaagtagcatggcctggagctctaccttcagtggtgagacccaatgaggttgctcctcctgagcccacacctgcacgagttgaaccagtaccagctaatccacaatctccagtggtgaatccaccttctcctgagcttgaagtagttccctatctccaccttttattatcatctccgattccccatctggagaagctgctgctccccctgattcctagttggagaagctgctga

SEQ ID NO: 38579 - DNA, 192 bp, Glycine max
  Peptide Sequence Number=SeqID_130264
ggcctgggtttcgctccttttgcatgccctactcccgatcagtttagggctgaggtcgcatggcccagagattggcccgaggcccagacggaggaggcacctgtaggagctcccgacgatgcagaggaggcccgcatggatgaggagatgacagacttgctcggcttcttgggaggaagcggagccacgtga

SEQ ID NO: 38580 - DNA, 182 bp, Glycine max
  Peptide Sequence Number=SeqID_130265
gtatgaggccctatctatacggggaggtcaatctctccctgtcgcaacctacccttcggcgggagggcgacgcgggactcgcgggtgcgtcttccatgggaggaaaatgcgcggagtcgccaccaacgtttattcaaggaaaacgtcgaaaaaaccggaaaggtgtggtctacgaactttaa

SEQ ID NO: 38581 - DNA, 279 bp, Glycine max
  Peptide Sequence Number=SeqID_130266
atggagcggtatctacaacacttggttcgccagcaggtggccaaccatcgggggcaggtgcagatacatgagtgtctctaccaccggggccagggtttcgttccttttgtatgccctactccagatcagtttatggctgaggtcgcatggcccggagattggcctgaggcccaggtaggggaggcgcctgcaggatccccgggcaatgcagaggaggcctgcatggatgaggagatgactaatttgctcgatttattgggagggagcgaagccacatga

SEQ ID NO: 38582 - DNA, 630 bp, Glycine max
  Peptide Sequence Number=SeqID_130267
atggaggtatttacggaagctgttgtatccctcgcccaatactatgaccagccgttgagatgcttcacgtttggggacttccaaatggtaccgactgttgaagagtttgaggagatattaggatgccctcttgggggaagaaaaccgtaccttttctccaggtttcttccctccttgagtaagattgcagctgtggtcggagattcggcaaaagagttggatcgcatgaagcaaactcggaacggcgtagtgggcctgccgtggaaatacttggaaggcaaggcaagggatatggcaagccaagagaagtgggtctcgtttgcggatatactagctttgctgatttttggggttgtcctctttccgaacgtggacggcttggtggacttagccgcgatcgatgctttccttgcctatcaccatagcaaggagagcccaatggtggctatcttggcggacttatttgatacctttgaccgaagcgcgatcaattggtttcctcgatggaaggaaggaaaggagggagttcttttctcgggtggggactaccctaatgttccgttgatagggacgaggggttgtattaactataatcccgcacttgccataagacagctaggatacccatga

SEQ ID NO: 38583 - DNA, 396 bp, Glycine max
  Peptide Sequence Number=SeqID_130268
atgaagcaaactcggaatggcgtagtaggcctgccgcggaagtacttggaaggcaaggcaagggacatggcaagccaagagaagtggggcccgtttgcggatacactagctttgctgatttttggggttgtcttctttccgaacatggacggtttggtggacttagccgcaattgatgctttccttgcatatcaccatagcaaggaaagtccagtggtggccatcttggcggatttatttgatacctttgaccgaagggtaccccatgaggggagcaccaacagaagaaagtctctcgcctttccttgtgagggatttgggcgtgcaaagtctcaaggttatacaaagagtccacaaggcgtggagaagtccgttgaggaaagacaaggagcttag

SEQ ID NO: 38584 - DNA, 830 bp, Glycine max
  Peptide Sequence Number=SeqID_130269
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattaatatatataatagatatggttttttccttattatcgaccctgaggcaagaatccaggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 38585 - DNA, 231 bp, Glycine max
  Peptide Sequence Number=SeqID_130270
atggataacgaagaaggagtgcaaaaacagatgaaggtcgacctatcggccttaaaagatcaaatggcttctatcacggagaccatgctaaagattcaaaaaactatagaagataatgctacggcggctgcttccaatacagctagggaagcggaaccggtgctacagcccgtaataaacttgggccgagacagaaatgcgatgggtttcaatcggcggtataatccttaa

SEQ ID NO: 38586 - DNA, 825 bp, Glycine max
  Peptide Sequence Number=SeqID_130271
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgtaaatgtttctactttcttaactttgaatccctactaatgtggcaaactgctgtttcatcccgttcaaggctaccattatgggtcccggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacaggggaa

SEQ ID NO: 38587 - DNA, 324 bp, Glycine max
  Peptide Sequence Number=SeqID_130272
atggaggatgagtgctctgaggccactatcccagagccatttactacagaggaggaggcagacgacacacagacgacacaggtagctgctgccactcctgagagatctcttgaggccattttagagccctcaacaccatcagtggatccatcttcaccccaacacgcaacaaacccttccactcctgtcttagagatacctgagggccagaccacaccagtcctgactctggatacttctcctccagctactccagtgcttcatctgacagacgaggaggatgtgcagacacaggacactcaagaccagtcacatgaattttga

SEQ ID NO: 38588 - DNA, 564 bp, Glycine max
  Peptide Sequence Number=SeqID_130273
atgcaatgcaagaagtgcatactgttcttccataagagattaaaggatgaagatgttgtacgtgatatcttctggtgtcatcctgatgcaatgaagttatgcaatgcatgtttcacatcgacaagaatgtcaagtgtttgggatgccatgaacaacatgatcatgcagcaacacactgaaattaaggcatcctttgatacaagtacacatgcggctggacatgtttttaaaattaccttatacaagaggctacttggtatgatatcaaggtatgctttaaatcaaattgctactgagtatgagcatgtacattatgctaacaaaaacccttctcgttgtggatgtgtcatgagaactactcgcgatcttccatgtgcatgtgaactatccaaatatgttctcggtaccatactgtcataccctaatttcgtccagggattattatttgatgacatacaacctttgattggccgcttcgagatacttggcaccctttgttgcacaatatgtgaagtcccgagacgtgccgaaaatcaaaaggaagcaggcttatgcgatccgtga

SEQ ID NO: 38589 - DNA, 294 bp, Glycine max
  Peptide Sequence Number=SeqID_130274
atgtcattgcctagcgctattcatgtgtcctccaacttcgagtgtggagccccgcgaatgtcattgcctagcgctgttcatgagttcaccaccttcgagtctggagccccgcgaatgtcgttgcctagcgctgttcgccaattctccattctcccctttttttcggagccctatgaatgtcattgcctagcgctattcatgtttcctccaccttcaagtctagagccccgcgaatatcattgcctagcgctgttcgccaattctccattctccccttttttcggagccccatga

SEQ ID NO: 38590 - DNA, 120 bp, Glycine max
  Peptide Sequence Number=SeqID_130275
atggatccagaacacatcccatttcttttgcctgcgccacattgcacaaaactttcttcgcggttatgcatacaccgagaagatgcactagcaacatcttggggatattcgtgcgaataa

SEQ ID NO: 38591 - DNA, 336 bp, Glycine max
  Peptide Sequence Number=SeqID_130276
atggttatgtttcccctaaaaaaaaggcaggttagctcgcctgggcgagctgagctcgcctgggcgagcaatccctgcaccaaaatattaaaaacgagggagggaaacatttttgcactcaaaaacttccccccccctcattctaaaagagcaaggcttacgggactcacggtttttgctcccctaagccacctttggttgcattttgctttcatttttggtactcctactcactccaacaagcctatgttgcatcctgaagcaatggggcatgccacattgcccccactctcttgctattcatgcctaaacatgtgcccaccaagtgctcggtga

SEQ ID NO: 38592 - DNA, 156 bp, Glycine max
  Peptide Sequence Number=SeqID_130277
atgaaccctaagagaataaaggtcattcctgagtggcccgctcgaccaagtgttaagggaaggagcccagagtatcaagaacctcaggatttgaggacaaatccttttcaagggggagggaatgatgcaatcctactccgcaagggcattggatag

SEQ ID NO: 38593 - DNA, 198 bp, Glycine max
  Peptide Sequence Number=SeqID_130278
aagaggaacgggacggtaagccttgctatttcgacatcaagcgatatgtcgtaagaaaagaatacccgccagagattgctgacaatgataagaggacattgagaagggaggcgaatcacatgatcgaggaagtccatgagggctcgtttggaacgcacgccaacgagcatgctatggccaggaagatcctaagagcag

SEQ ID NO: 38594 - DNA, 562 bp, Glycine max
  Peptide Sequence Number=SeqID_130279
aattggagaggcaaaaccttcacaaatgtctcgccaaccttcaggaaggaagcatagatgtggcagtggttaaggaattctatgccaatttctatagtccagcagataaagctcctaaatgtgctagaataagaggccatttaatcaagatagatgcagacaacttaaatgagttcctccagactccagtactaaggtgtgatcctagagagatggaggctagtctgtgcattccgggcaaaggctttattctaaacacggagggccaaccatggaagctcctcagaaaagatcttaccaccctagctcaaacatggagcatcttctcatactcaaacctagctcctacctcccgcacttcagatttgaacacagacagagctaggtcggtctatggcttaatcacaaggatggacatgaacattggcggtttgatctctggacaaatgaccatgatggctcagcctaactcttctcgcttaggcttcccagctctaatcacaaccttgtgtagatcgaggggagtgggatctgatgcccttacctcctatgaaaaccaaag

SEQ ID NO: 38595 - DNA, 559 bp, Glycine max
  Peptide Sequence Number=SeqID_130280
atggtggaagaatttgaagagatcctaggatgccctctaggggggaggaaaccatacctcttcacaggggtctatccctcaatagctagaatttccaagatagtccaaatctcggcgcaggaattagaccacaggaaagcaagtcggaaatggggtggttggaataccgagaaaatatttggaggcaaaagcaagaatcttgcgatcgacgcttttctcgcctatcatgaccacaaggaaagcccggttgtcgctatgctagccgacctatatgacacctttgaccgaagatgtgagaagagcagtacgaggattgtttgttgtacaccagctctttatgtatggttagtttcgcacctttttcgccaagaggtgaggcatgcttgcccgctagaaagccaccgttcatgcacagagaaaggaggggcaaattgggaccaactcttagcgagcaaagaaggagcatctgtcaactggttccctcgatggaaggaaggaagaaccagagttcttatttcatgcgaaggatttccaaatgttcccttgatggggacgaggg

SEQ ID NO: 38596 - DNA, 156 bp, Glycine max
  Peptide Sequence Number=SeqID_130281
atgagagcagcagcccccaagcctcccttgttgagtttttgcttcccttttcacgctttaattcactccccgcaagggatggccctaggcctacgttgcattttgaagcaatgggtcatgccacattgcccccattctcttgctattcatgcctaa

SEQ ID NO: 38597 - DNA, 552 bp, Glycine max
  Peptide Sequence Number=SeqID_130282
aaagtgtttgtcagaggaaagtgtgttagattctcccctgctgtgatcaacaaatacctggacagaccaacagatggagtggtggatattactgtctctgagcatcaaattgccaaggaaatcactgccaaacaagtccagcattggccaaagaaagggaagctgtctgcagggaagctaagtgtgaaatatgcaatcctgcacaggattggagctgcaaactgggtacccactaatcatacatccactgttgccacagggaaagccgctgcttcaggtgctgtgtccaaggatgccttgatagttgaactcaaggacacatgcaaggtgctggaagcaaccatcaaagccaccacagaaaagaagatggagctagaacggctgatcaaaaggctctcagaaagtggcattgatgatggagaagcagccgaggaagaagaagcagctgagcaagaagaagaagaagctgaggaagaagaagaagaagccgatgacgaagatgcagcagaggatacagaatccgatgatgatgattctgaagccaccccatga

SEQ ID NO: 38598 - DNA, 98 bp, Glycine max
  Peptide Sequence Number=SeqID_130283
atggtgtttttccctaaaaaaccaaacgtgaggagtgggtgtccgccatcgccttggccttggctaacaatcggggaagttcctgactcccgttcaag

SEQ ID NO: 38599 - DNA, 433 bp, Glycine max
  Peptide Sequence Number=SeqID_130284
cctccacagccccgttcatctttggccgataggaggtggagttatgatgttggatcttgaaatccccgcacatttcctgcatcattttgttattcagattggtgccattgtcagaaatgatcttcctagggagtccgtatcgacaaatcagttccttctttatgaatctgaccaccacactcctcgtgacattggtataagaagccacttcgacccatttggtgaaataatctatcgccacgagaatgaagcgatgaccgttcgaagctttgggttcgatggccccaatgacatctatcccccacatggaaaaaggccaaggggcggacatgacgttcagaggatggggcggaacattgacattgtctgcgtacgcttgacatttattgatggaagcttgcttgtggggcttctatggaggctggatctttga

SEQ ID NO: 38600 - DNA, 552 bp, Glycine max
  Peptide Sequence Number=SeqID_130285
ggtgcaccttttgagggcatcattgttgatgactggaagtttgattactccagtcataatgctcgccacatggtctgcattgaccaggcggatatgaccggcagactacttgccgggtcattgacatttgattatcgtatcatgcactatatcattaccggtcgtccaatcgactgggcccatttgattcgttaccgcatgcataaggcattatggtctagtgcacctctaccttaccctcagcttatgactttatttcttcaacattttgaaattcccttgaattttgagccctttgtgcaagttaaacattcatttgctattggtgccggtgcggatgcacaacctccgcaagatgaacgtgctccctctcctccgcctcaacaagatgactccttagccctcatgcatgaagttctttcgaagttacgaggcctccgcacctatgttggtgagcgctttaattccttgggtggtcgtatcgatgccattgatgcttgctttgcaggcatggatacctacatcactcagcttgaggaggatataagttat

SEQ ID NO: 38601 - DNA, 417 bp, Glycine max
  Peptide Sequence Number=SeqID_130286
atgaccggccctctcgatgagtcaatctcttgctttctcataagggtggacccttgggtactagtacctattacctttagagggctccacgccttcgacttcagaggactgcatgtcctcgccttaagagggctgcacgtcctcgcctttagagggctgcataccctcgccttcagaggactacacgtcatcaccttaagagggctggacgccctcgcctttagaggactgcacatcctcgccttcagaggactgcacgtcctcgccttaagagggctggacgtccttgccttcagagggctgcatcccctcgccttcagatggttacacgccctcacattcagaggactgcatgtcctcgccttcagatggctacatgccctagcgttcagaggaatacacgtcctggccccttaa

SEQ ID NO: 38602 - DNA, 423 bp, Glycine max
  Peptide Sequence Number=SeqID_130287
atggaaactatatcaaaacgctttgagcagctcgatgtttgtggtaaaatacatttgaagtcaaagctgcgagaaattgcttatcctgatatgaacttcatgtgtcctcatccagaaaaggtgaagaccaaaggtgctctaaaacaaccgctaaccaaacaacaaaactggtccgaagagtacatcaacctggttggtggcatagagagatttgaggaattgaagcgttctctacttgttgacgacttatctaaggttaccatggacaagtgggtgaatattacggatatgggatacgtcattgcttcacgatacaacgtcatcattgtttctctttcacaaaaacaaagcatgatattttttcctcttagaagtcagccgccgccagattcttctgtgcatcgtgtaatatgcactggtcat

SEQ ID NO: 38603 - DNA, 764 bp, Glycine max
  Peptide Sequence Number=SeqID_130288
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggcttagtgagccctgctcgcttagccattgtgctgtgtaagctaagcgagcacgctaagcgaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 38604 - DNA, 494 bp, Glycine max
  Peptide Sequence Number=SeqID_130289
atggctcaattgatttctgatgtccatctattgtttgcagggatcgcgcccacaagacgcccagtggacccgaagaagtccaacagggccctggggtttccagctctggttatgggcctctgtcagtcctacagggtgcctgtccccccagtgagggatcgcgcccacaagacacctagtggacccgaagaagtccaacagggccctggggtttccagctctggttacgggcctctgccagtcctacagggtgcccattccccccagcgaggtcatgccatcgaatcgcacccacaaagacacccagtggacccggagaagtccaacagggccttggggtttccagctttggttacgggcctctgtagtcctacagggtgcccattccccccggcaagggatcgcgcccgcatgacacccagtgaacccgaagaagtccaacagggcaggcgtaggacgaaacaccacagcagcctggggatggccggcagcgg

SEQ ID NO: 38605 - DNA, 492 bp, Glycine max
  Peptide Sequence Number=SeqID_130290
atgaaactggccaaatacaggctaaaggcccaagtggagaaggacgaaggcccaagtggagaaggacaaagcccccgagtggagaaggataaaggcccaagtggagaaggacgaaaacccaagtggagaaggacaaagcccccaagtaatccttgtggcgtctacccagacttatcttccttcattggaagtggcgtctacccagacttatcttccttaaccggaagtggcgtctacccagacttatcttccttcattggaagtggcgtctaccctgacttatcttccttcaccggaagtggcgtctaccctgacttatcttccttcaccggaagtggcgtcatccaaaccttcgtagtctgtatcaaacgatccgctcctagtcagattcacatcatctggtatcgtagcctgtatcaaatgatccgccccgtaagattcacatcatctggtatcagagctttggctcttgatacagactttgtgtcgtaa

SEQ ID NO: 38606 - DNA, 872 bp, Glycine max
  Peptide Sequence Number=SeqID_130291
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggatttgaaaaaggtggcggaagccaataaaccctcgatataccaaaccaacaagtatgcgcattggaaaggaatgtattcggaccaacctggtgagtcagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 38607 - DNA, 723 bp, Glycine max
  Peptide Sequence Number=SeqID_130292
atggggacaaatcaaactggcaaaaggttttatcaagtcaagaataagggcatagatatcaccagcattaaggagttggggcggttgatgggacctctccaaatgcaagccttccgcaaggcgtacggaaagatcttagatttgaccatatcagagatatccacagaagccattgcatcactcacccaatactatgaacagcccttgagatgcttcacatttggagacttccaattagtactgaccgttgaagaatttgaggagattctaggatgtcctcttgggggaaggaaaccgtatcttttctccgggtttcttccctccttgagcaaaattgcaattatggtaagggattcggcgagaggattggaccgcataaagcaaactcgaaacggcatagtgggcctaccacgaaagtacttagaaggcaaggcgagggatatggtgaatcaagaggagtgggtctcgtttatggatgtattagcattgctaatctttggggttgtcctctttcccaacgtggatggtttggtggacctagccgtaatcgatgctttccttgcatatcaccatagcaaagagagcccggtggtagctgtcttggcggacttatttgacacattatatttgaccgaaggtgcgaaaagagtagtgcacggatcatctgttgtttacccgctctttgtgtatggttggtttcgcacttattccaacaagacataa

SEQ ID NO: 38608 - DNA, 408 bp, Glycine max
  Peptide Sequence Number=SeqID_130293
atggagtggtggcatatggaaacgagcagtttccatcttctagttggagaggtcaccatcaccttcgatgatgtggtgtctttgcttcatctgcccatcataggcgcattccacagctttgacacaattcatgtcgacaaagtagtgttgatgttagtggagttacttgaagtcactggagatgaagctagagctgagacagtacggtgtcatggggcatacgtacacctatcgtggctacgagagatttatcatagtaaatgtgaggccgaacactggactgtagcaactcgagagtgcaacacatgtgcatgtggtgttcttggacgtctttcgagacctcagtcagagtggaagctacgcatgggtgtagaagcaagcttcatgatgatgaatcaagttgattaa

SEQ ID NO: 38609 - DNA, 282 bp, Glycine max
  Peptide Sequence Number=SeqID_130294
atgttcataatcatctaccaatataaggagatgatgaacctggctgccacttatgggcagatgctggaagatgaatgggcaaaggtattggctctgcaaattgaaagggaagcgagagagaggatgatagagttgttgcacagggaagctatgaaatggatgaatagattcactctcactttgaatgagagtcaagagtttcgaaggttgttatccagagccaaggcagtgactgacatgtactcggctcccgacaaagttcacagtcttttcgattactag

SEQ ID NO: 38610 - DNA, 628 bp, Glycine max
  Peptide Sequence Number=SeqID_130295
aggaggtgcaagagtagatgaaggccgacatggaggccatgaaagagcaaatggccacaatgatggaggccatgatgagcatgaagaagataatagaagccaatgggttgcaattgccactactagcgctgttgctgaggtgaacccgatgcccccatctggcctcaaccaaatgaatcatccaacctcagatatggtaggcaaagatttgggaagtaccggcgacccccattatgtgcaaattcaaaacaagcacgccttcccgcaatatggcttgcctcccaactatacaccacccaatgtggcgtacactcctagtgagaatgtcaataactccactcccatactcattgagagccgacaaccccaaactgatcatgcacatgtctctcaaactatgggggagacacataaaattccccaccacaatctagccgacttcaagccttgcctcggatatgccactgaagggcaagtagttggttgtatactcctgcaaaacactttggaaggccctcaattttgcccccaactacaacccttgcattccacagcaggtaaaatccctcctattatggaaggaataggaaaagttggatcatctagaggaaaggatcatggtcgttga

SEQ ID NO: 38611 - DNA, 535 bp, Glycine max
  Peptide Sequence Number=SeqID_130296
atgtccaaatcttgtggatttgggatgaccggccctctcgatgagtcgatctcttgctttctcataagggtggacccttgggtacttgtacctatcacttttagagtactacacgtccttgccaacagagggctgcacgccctcaccttcagaggactacatgtcctcgccttgagagggctacacgccctcaccttggttaccctaaccgttgagaggactacacgtcctcgccttgagaggactacacgtcctcaccatcagagggctgcacgccctcacctccagaggactacatgtcctcgccttgagagggctacacgccctcaccttgggtaccagttaccctcaccgttgagaggactacacgtcctcgccttgagaggactacacgtcctcaccatcagagggctgcacgccctcacctccagaggactacatgtcctcgccttgagagggctacacgccctcaccttgggtactagttaccctcaccgtcagaggactacacgtcctcgccttgagaggactacac

SEQ ID NO: 38612 - DNA, 585 bp, Glycine max
  Peptide Sequence Number=SeqID_130297
ggggagcagttaatgcagttgaatccgataggccccacaggtctaaacctttaagagatgtggcaacccctaggaggtttatctttgaggccctacaaaagggaggtgtaattccccatagtgggtgtaaggaggattcctgtctgctacatttcggcgagatgcatgacatggagacgtgtttggaagtagaggaattgttacagcaaatgatagaccaagcccaaacccttggtgatatatacttcactaaaagtgcagcctcgcaaaagcccgggcaccccttaatggccaaacctgttcctttcccgtatcaaaatagtcacgcggtcccgtggagatatacacctccggggaagaaggaagaagaagtcactgacgtcagttcgctgtcagctaaagtaacaaatatcacggggctgagtggtgtgacccgtagtggtcgtgtgttcgcacctccggacctaccagtccaacccgccgacgtcaaaggaaaaggaaaagtggtggaggaacaagatggcgaagcaccccacgcttcgaataaagatattccagcaaaggggcccccagagaaaaaggatg

SEQ ID NO: 38613 - DNA, 567 bp, Glycine max
  Peptide Sequence Number=SeqID_130298
atggaagggttagtggacctagcagcgattgatgctttcctcgcctttcatcatggcaaggaaatcccggtcgtcgccattttggccatgcatgacacgttcgaccgaagatgtgatgaaagcaatgcaaggattgtgcactgtactccagctctctatgtgtggctgggaaaggcgaattgggaccaactcttggctagcatggataggcgtctgttaactggttccctcgctagaaggaaggaagaatcaggattctatcttcatcttggctaccccatgagaggagtgccatcagacgaaagcatcacgcctttcatcgcacggggtttcagtgaccacaacgcgagggacagagagcttaggggaagcagtaatgggatcatcggcggctatcataagtggctgagagtccggacacaaggattggattggctcccaaatctaaagactgtgagagacgatgaggttaaagcttcggaagaaagtgatgaggtacaagccctaaaggcagagcttgaaagagcccgagtagtcaaagagaagttcaagtccatagccatcaaa

SEQ ID NO: 38614 - DNA, 150 bp, Glycine max
  Peptide Sequence Number=SeqID_130299
atggggctccgaataaaagtggagaatggagaattggcgaatagcgcaaggcaatcaattcgcagggctccagactcgaagcgcgaggcaatcaattctccgggctccagactcgaaggtggaggacacatgaacagcgctaggcaataa

SEQ ID NO: 38615 - DNA, 516 bp, Glycine max
  Peptide Sequence Number=SeqID_130300
atgactgggcctctcgatgagtcgatctcttgctttctcataagggtgaacccttgggtactagtacctatcgcctttagaggactacaagtcctcaccttcagagggctgcacgccctagcctttgtagggctacacgccctcaccttcagagggttgcacgccctcgcctttgtagggctacacaccctcgcctttagaggactacacgtcctcaccttcagagggctagacgccctcgcctttgtagggctacacgccctcacctttagagggttgcacgccctcaccttcagaggactacacgccctcaccttcagaggactacacgccctcgccttcagaggactacatttcctcgtcatcagagggccgctcgcccttgcattcagaggactacacgtccttgccatcagaggactacgtgtccttgccattagaggactacacatcgtcaccttaagaggattgcatgtcctcaccttcagaggactgctcgcccttgcctacagatga

SEQ ID NO: 38616 - DNA, 342 bp, Glycine max
  Peptide Sequence Number=SeqID_130301
atgtatgtaaatccagccaaggagatgtgtgtgatgaaatggccccgaggaagcttgccctcaaagaggtccaggaaggacaaggcagccgaaggaactagttccgctccggagtatgatagtcaccgctttaggagtgctgtacaccagcagcgcttcgaggccatcaagggatggtcgtttctccgggagcgacgcgtccagctcaggaacgatgagtatactgatttccaggaggaaatagggcgccggcggtgggcaccactggttactcctatggccaagtttgatccagaaatagtccttgagttttatgccaatgcttggccaacagaggagggg

SEQ ID NO: 38617 - DNA, 381 bp, Glycine max
  Peptide Sequence Number=SeqID_130302
atggattcatgcgctaggagtggtcccttcggcgcttcaccagaaattgaagttcgcacttggtggactcttggtgatagtgttgggcgaagaggatatgttggtaagctgcccctcctcagcaccatatgtagaggcagcggaggaatcattggaaacagctttccaatccttcgaggtggcacggttatgagcccggaatgggtctgggcaaggacagccacgggaatgccgatgtggttgacattaggggtaacccgtacaaacatgggttggggtatgaacccgggaaacctggaagaaggaatgcaccatcaagactccgggcagatagggcatggcccggtcatgttagccagtgtttcacaagtgtcgggataa

SEQ ID NO: 38618 - DNA, 252 bp, Glycine max
  Peptide Sequence Number=SeqID_130303
atggccgaacttggagttgagaagctccttgatatcttccctgacactcttcaactcatcaggatcagtgtgtatctaccctgtgaaacaccaattggggtgaaagaactaagagaaaaggaactgaaacagctaagggacaaaggagataggtttgcaaggccaacactgggtggtcaacacaacccttaccccacacgttgccgcactggacgaccaccatctaccgttggtcagtttcactcatcatag

SEQ ID NO: 38619 - DNA, 201 bp, Glycine max
  Peptide Sequence Number=SeqID_130304
atggcgctaagcctatttaggcatggatttgttcttaatgatgaagaagtgccctggaagctcccgaggaaggacttgatcaccttagcccagacatggagtggcgaggttagtctatgggttggttatgaagatggatatggacgtgggctcactcatatcacaccagatctcacagatggcccaatccaactcctctag

SEQ ID NO: 38620 - DNA, 336 bp, Glycine max
  Peptide Sequence Number=SeqID_130305
atgcttagtgcacctttgggtgctcagtgcaacttcctctctattggaattgggcttagcgcacctctgggcgctcagcgcaacttcctctctgttggaattgcgcttagcgcgctatgcgcgcttagcgagagaccaaaagttattgttttaaaaattccaacggcattacatgcaaatgcccttctgccatatccccatctggctactctgtttttgaagcatttcaaagtccctcttactaatgaaccatctgtcaaggttaagtattcatttacaataggagccgctgcagatgcttcttttggttataagaaagatcttgatggacaatag

SEQ ID NO: 38621 - DNA, 872 bp, Glycine max
  Peptide Sequence Number=SeqID_130306
atggtgaaagttggaacctcttacgtgccgatcaacgtctcattttcgccaaaagttggcccagggcttcccggtatcaacagggacaccaggatttatttattctgcgaagtgatcttccgtcacagtggcttctgtttctatcagctgtccctcctgtttcagctactgacggggtggtgcgtaacggcaaaagcaccgccggacatcagcgctggcaagtgtagcggtcccgctgcgcgtaaccaccacaccccgccgcgcttaatgcgccgctacagggcgcgtcccattcgccattcaggctgcgcaactgttgggaagggcgatcgtcacgacgttgtaaaacgacggccagtgaattgtaatacgactcactatagggcgaattggagctccaccgcggtggcggccgctctagaactagtggatcccccgggctgcaggaattcgatcctagatcgagctttgcctgctcctgcgtgtccgttttacggcgatagtcgaaaggctaaaccgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 38622 - DNA, 382 bp, Glycine max
  Peptide Sequence Number=SeqID_130307
atgacgagaggcaatccatctgacttacaaccctttgatcctgagatagataggacatttcatagattagttaggcatcattttataccttttgatcatcctgagcattccattactggtgaatctgtgcattctgttattggtgattttaaacatcctgattttgagcattataattttgagcattctgattctgagcattctgattttgaacactctgagaacatggcacaacctccaccccgtgagagaactctaagagaaatggctgcacctgatttcacctacgaaagcttgtgcatccaataccttgatgaggatgtcccatatgttcttaaaactggactgattcatttgcttccaaagtttcatggccttgcag

SEQ ID NO: 38623 - DNA, 813 bp, Glycine max
  Peptide Sequence Number=SeqID_130308
gtggcacagcgatttgtggcagttgcggtcgatcagcacggtgctgccggccggcgccgaatacatgctgacgatcttgttggcggtggaggtgccgttggtgaccagatagctctgctcagcgttgaaggtgcgcgcgatatactcttcggcctccaggtgcggcccggtgtgatccagcagcgaaccgagctcggtaaccgaaatcgagatgtcggccttcagggtattggcgccgaaaaagtcatagaacaggcagcccaccgggcttttttgaaacgcggtgccggccatgtggcccggcgtgcagaaggtgtacttcccttcgcgcacatagttgaacagcgccttggtcagcggcggcgtaatggtatcgatgtattctgcggtgtactgctggatgcgctgcgcgatatcgtccgccgcattcaggccatactcgaagaaatagagcaccatgcgcatttcatgcaggctgacgtcgaaggtggaatgggtattgataaaggcgtacagcggcaggtattcattcagctcgttgatttcgctgcacagctccaggctgtagtcgtcccagtcgaagatcaccccgcaaatgcgggcattggcttcgatcagcttcagcagatcaccgctgtttttggggtacaccagctggaatcccatggcggccaacgccgcgtggagctcgcggatcggctcatctttgtagtagacgcccgtcgggcccatgatggcgatgatattcatcggcagctcctgtcagttaacggccaagtctctataacaccacgaaaatccggcggtgtgtag

SEQ ID NO: 38624 - DNA, 315 bp, Glycine max
  Peptide Sequence Number=SeqID_130309
atggcttccaactcccaacaattcagtgcaagaaatgatgctattgtccttagaggagtccatgaggtggccacagattcatcttcatctactgaaaataaaaagcttgaaggaaaacttgatgccttggtcaacctagtaactcaacttgccatgaatcagaaatctgcatttgcacctgttgcaagagtccgtggttggaggaatcatccaaatttgagatgggcaagtcctccacaacaacaacagcctgtccctcctttccagaatgttgctggtccaagcaagccatatgttcctcctccaatgcaatag

SEQ ID NO: 38625 - DNA, 663 bp, Glycine max
  Peptide Sequence Number=SeqID_130310
gtagctgtgtctccgccaaaaccacctccgaagccccatccggaggtcgatgatccgctgtatctgatgacattgaccatccaagagcttttcttgaggccttatcaggttagatgggatgccaccgtgttcggggttgttaatccagatttccccctgtacataaagcacgaagacctcttcgaaattgcacacggtggtcaatgtctcagcatatcagtgttacagttgtggattcaacatctcactgaaacatgtatgcgagcggggaattctgatatctatgaattcctcgagcaacagtccattcagaggtctgggcaatcgcagtttgaatctgaaagttacataaagagttggatgcatagttcacaacgcgatgtgtatcttggagcctacctaaatggatggtggtcatcctgcccaaggacacttagttgtctggttttgttcatgcataacaggccagacaactaccttaaggagattattaatagtgctatcaagggtcttgatgatgctccacaacctaaatcaaaggctcctgctaggtggattgtcgtcaagtgcaatagacaaaaaggaactattgagtgcggctactatgtgatgcactggatgtccaccatcattttaggaacttttagaaataattgggaagcg

SEQ ID NO: 38626 - DNA, 189 bp, Glycine max
  Peptide Sequence Number=SeqID_130311
atggaggaggagaagaagaaggagaaaatggtggaggatgacaaacaacagttgaaaaagaatgagagacaagaagagaagaaaaagaccaagagtgagctggctagagaaaagagaaaagatgcaagtccaagtaaaggggaggaggtgccatatccattggtaccaacaaagaaagacaaggaatga

SEQ ID NO: 38627 - DNA, 540 bp, Glycine max
  Peptide Sequence Number=SeqID_130312
atgagtcatcattcatctagtgttaatggcaagggtactagtcataaagaccctttatctagaatcttagatgagttgagttccctcaagttatggaaagaaaaacaagagagaaaagaaaaaggaaaaaaaagagtggaagaaataagtcaagatgaaagaaagaaaataagagaggaagaaagaagaaaaataatgaaagaaaagaaaagagaaaaacatgcctcctatagtagtcataactcttgcaaaagcctaagtgaagaacttcgtgactattacgaaggaaggcatagggtagagcaacaacttaaaaagaagtctacttcaaaatcttatggctctcactcttatccaaagaaagaccaaggtcaaggcatcttaggggtgacaccttctaagcccaaagatgataaggggaagacaatagaaaagcaagcccctaaggctagtatgcaagagaaaactagctctataaaatgctttaaatgtcttggaagaggacacattacttctcaatgccccaccacaaaaccatga

SEQ ID NO: 38628 - DNA, 867 bp, Glycine max
  Peptide Sequence Number=SeqID_130313
atgctgattggcgtgcatgcgcttaagcaacggccgggacaatatacttatgccggtgcggcgagattgcatgagagggccttgattcaggccatgcaaaacctgttgcaaacactggtgccagattcgggattggtgggaattaatagcctggatgcgatttggcacaacgggcagttgcatgtgctggaaatcaacccgaggttaagtgccagcatgcgcctgtatgcagatttgccattgatccaggcgcatattgccagctgtcagcatgatacgatgcccgcatttcagctcaacagtaagcatgccagccattgcattgcctatgcgcgccaggccataaacgatgcgcaactggactttcccgattgggtagaggacaggccaaacggtcatgccgccattgccgccggacaaccggtatgcagtctgtatgctgaagggcactcggacagtgaggtgcggcaggcattgcagcacaaaaaaacacaattagagaaactatggggaaccgtgcaacaatatagtgcgccgctggtagctcacctggtcgccaatgcacctgcattgggctgtcttgtgagcactcatgaaagtggtgccaccattgtcgatgccgggattcaaacacctggcggcctcgaagccgggcgcatcattgccgaaatctgcatgggcgggctggggagtgtcgcattacagcaagtaccgcagtttgcgcattggccattaagtgtcgtcgtgacggccaagcaaccggtgattgcctgcctgggcagccaatacgcaggctgggccttgtcgcatgaaaagtttttctcacttggcagcggtccggcccgtgctatcgcacagcgtgaagag

SEQ ID NO: 38629 - DNA, 2098 bp, Glycine max
  Peptide Sequence Number=SeqID_130314
gccaacatgatgaacagcggcggcagcatcgaggcggcggcggtcatgttgatcagcgtgttcatcaaatcctgcacgctgctggaacccagcgttgggatcagcatcagcgggatgacgatgaagaactggatccaggcggcgcgcgtcggcacgccgtgccgattcaaacgaatggttttctcgccgaaaatgcccttcgggatctcggtgaagaaaatcttcaccggcgccgccgtccacatcagcagcgagccgaacatggcggtgaaggagacgatgccgacaaagcggttcatcagcaccgtcggcaggccgaagtgcgccgacaggccttcgaacacctgcaccgtgccgccggtgaaatgcaggtcagcgcggtggacgaacacgttgatcagcagcgaagacaccgaatacagcacgccgatgaacagcccggaaacgatgatcaccttcacgaaggcgcggctgccgcctttcacatcgttcacgtacaccgccacagactccgccccgcccgccgcctggaagatccaggcggtaatgccgaggaacgcccagttgaagttcggcgtcatcgcctgcacgttgatcgggtcggccggttcgatgccgcccagcaccgccgcgcccgccagaacgatgtaggaaaacgtcagcagcagcatcagcgacgaggtcaccgaggtcatcggccccagcagttttgcgccgctgttggagatgtaggtcgagaaggcgaacaggaagatgctgatgatcgccgtggtcagcggggtaaacacgtagtcatagcccaggaacgcgtaagaagcgtaggcgatgacgcgcggcagcagcgcggtgaagaagaacaggttcacgaaccaataggtgtaggcggtgataaacgcccagcgcccgccgagcgcgcttttcacccaggcataaacgccggcctcggagttgcggttgagcgagacgaactcggcgatgatcaggcaaaagggaatgaagtaaatgatggtcgccaccaggaacaccggcgacgaggcgaccccgagctgaatattgttgttaatcacgttgttgaaactgaacactgccgcaaacgtcatccgacagcaggccaaacttgccgatgcctggtggttttcgaagatcgccacgttgcctttgccgacccggcgtctctcgccttcgccgctgaaaaactcgcggtcggtttcgtcctgatagggcgctaccgtcgtcagcgcccgtttgtcggcgacctcgacggtctcttccccctcaaggtaatagtgcacatcgaagtagcggcggttgccctccagccaaccgtgctggcggccggcgccgacgctcagccgatacgtcagcgagtcgccgatcgaatggcacacgttcgggctgatgcgatcgacattggcgatcgcctccatgcagcgcagccacttcttgccgctcgtgaaaccgtagctgaacggcgccagatagacccggtgggtatccagcacttcggagccccaggagttggagccgaggccgaggatctggtcgtccaggttcagcgtcaggcagtcgctcggtgccagctcgttgatgtgctgggcctggtgcagcatctcggcgctgtagggccacaggctgaaattgatcggccgccgcggctggatgaagatccccttgcccgccgcgtcctgcaaactcagccagcgcacgtcctgccgattgccgttgtcctgcgggaacggatagtgttcgaacagcgcgtcggcgcgctgccggtagtggccaatcaggttggcccggcagctgtcacggtagttctcgcccggcccgcggccgtagtattccacctgctcgaagcggcggctgatgccgaaatcgaggccgattttcgggataatctggcggaaatcgccgtaaggctcaccggccagatccaggctgacgtagccctgcggggagatgcgccagcggtaggtgcagcgcatgccgaagtcgaacaccggcggcgcgatcaggctatgtacctcgatcagcagatcctcgccctgccattgccgattgaggcggcggaagtgctgctgcatgatggggaagtgatgcg

SEQ ID NO: 38630 - DNA, 174 bp, Glycine max
  Peptide Sequence Number=SeqID_130315
atgcgtgctagagctagagtaatcagtgaaatagaggaggtacaagaacagatcaaggctgacatggaggccttgaaagagcaaatggtcacaatgatggaggccatgatgagcataaaggagataatggaggtcaatgcggttccaatagccgctaccagcaccattgttgag

SEQ ID NO: 38631 - DNA, 222 bp, Glycine max
  Peptide Sequence Number=SeqID_130316
atgaagcacttcactgacaccctcatcagtgccaacatagaaacagctatgaccatgattacgccaagctcgaaattaaccctcactaaaggggaacaaaagctggtaccgggccccccctcgaggtcgacggtatcgataagcttgatggggagaaactatgcgtttttgggatttgcgtgctccttggttagaacctctaagagggtccgaatggtttag

SEQ ID NO: 38632 - DNA, 276 bp, Glycine max
  Peptide Sequence Number=SeqID_130317
atggtgaaagttggaacctcttacgtgccgatcaacgtctcattttcgccaaaagttggcccagggcgttcccgtcaacagacaattgccagcgatttattaattcatcatcgaagcttgatcgataccgtcacaggtattttcgggcaaagtgcgtcgggtgatgctccaagctttactgatttagtgtatgatggtgtttttgaggtgctccagtggcttctgtttctatcagctgtccttcctgttcagctactgacggggtggtgccgctaa

SEQ ID NO: 38633 - DNA, 369 bp, Glycine max
  Peptide Sequence Number=SeqID_130318
atgtattgtcggaagatgggggcatacgcaaaagatgaggaattgttgatacattccttccaagaaagtcttactggggtagttgttaccggtgaaaggatcgatgtgggtctgaaaaaaggcaaatttagtcatcctgcttggacgaatgagaaaactagagcaaatgaagagggtggggatgaaggagaagcccgtgctgtgactgccattcctatacagccaagtttcccaccaacccaacaatgtcattactcagccaataaccaaccttctccttacccaccgcccagtcatccacaaaggccatccctaaaatcaaccacaaagcctacctaccgcacttccaatgacaaacaccacctttag

SEQ ID NO: 38634 - DNA, 427 bp, Glycine max
  Peptide Sequence Number=SeqID_130319
atgattatgagggggcaagacatttatagtagccaagatgagactactacttcaccttcctctagtgaaagtgaagaagcaaaacaggaagaatctattaaagagatctacccccaagaagaaggacaacttttaatggttaaggaggagtgtaagaaggcaagtgtctcctccaagaggttagctaagaaggaaagacattttgaaataaagacaaatattaaagaaatttcccctcttagacaacctccacattttctcctttgtaaaaagacacttgttagcattgccacacctcttaggcttgagtttattcctcaagtaaaggagttgttggatgagggtttggttcgcaagagcttaaatccttgtgctttgttggtgcccaaaataggtattattaggcaccaaatccctatgataggtg

SEQ ID NO: 38635 - DNA, 555 bp, Glycine max
  Peptide Sequence Number=SeqID_130320
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcgggttttcccagtcacgacgttgtaaaacgacggccagtgaattgtaatacgactcactatagggcgaattggagctccaccgcggtggcggccgctctagaactagtggatcccccgggctgcaggaattcgatctgtgggtttaccggaatgagggcaaggaacacctggcctgcccagggcagagaactgcttaaaggcgttcttaaaccacaaacaatagcatgggcgatctgtgccttaaggatcaagcttatcgataccgtcgacctcgagggggggcccggtaccagcttttgttccctttag

SEQ ID NO: 38636 - DNA, 606 bp, Glycine max
  Peptide Sequence Number=SeqID_130321
cacgtcctcgccttcagagggctacacgccctcaccttcagagggctacacgccctcaccttcagaggactacacgtcctcgccttcagagggctacacaccctcgcctttagaggactacacgtccttgccttcagagggttgcacgccctcgcctttgtagggctgcacgccctttccttcataggactccacatctgcgccttcagagaattcaagttcctgggcccgcctgatattggagggcggccaactgtgcgagcacaaccagagaaggaggctatcgtgcagttactatgcataccggggcaagatttcacccagcgaccacaatgtcgatctccccctacggaagtatcagttggtctgtaccgtcatgacataggtaaggatcacacccacaagacacccagtggacccggagaagtccaacagggccctggggttttcagctctggttataggcctcttgatcgcgcccgcaagacacccagtggacccggagaagtccaacagggtcctggggtttccagctttgattacgggcctttgtcagttctgcggagtgcccgtcgcccccatcaaggtcatcaagcccccgattaa

SEQ ID NO: 38637 - DNA, 471 bp, Glycine max
  Peptide Sequence Number=SeqID_130322
atggttatgggggatcccatcagcagactctccttccctggtcatgtgacgtgcacccttgtatcatccagaggcggcgggcccgatgatacgcggagataccttacggttatccgcacccttttgtcatccagaggcggcgggcccgatgacaagcagagaccaagtttggtcattctgcacccttgtatcatcccagaggtggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttattcgcaccctttcgtcatccagaggcggcgggcccgatgacaagcagagaccaagtttggtcattctgcacccttgtatcatccagaggcggcgggcccgatga

SEQ ID NO: 38638 - DNA, 153 bp, Glycine max
  Peptide Sequence Number=SeqID_130323
gctgccgtcccttggggcggacgtacgtttcctcaaataaacgttggtggcgactccgcgcgtattcctttcatggaacacgcatcccgcgagtctcgcgtcgccctcccgccgaagggtaggttgggacagttggcgactccactggggacg

SEQ ID NO: 38639 - DNA, 1014 bp, Glycine max
  Peptide Sequence Number=SeqID_130324
atgggcaccaaaacatattacatcagattatcaagaggtagcgaagctctagaggacctcccagatgtgaaccactttgctcgaggtggtgagtatgatggtgacagaaagatagaggacttgaagctcctttatagagcatatgttgtaaatgctttgtctagtggtcgcatggaaattaataagatagctgaactaaatcagttggggaatattattgggttggttaaacgtgaagctgaagccattacacttgatgttacatcaagagtatatcccaaaaaacttgtacaggctgtctcaaatgaaatttaccgcgaaaaccttcagcatttgggggatgatggggagctcagtgataaagatgctgctgctttgttgaggttgcgtataatgctctgtgtacctcaacagaccattgatgcagctcactccgatatctgtggcagttggtttgaaaaggttgtcaaggatacgattgcatcaggggttgatggatatggtgcggatatctggaaatcagtaagaaaagcagcacatggcttgcgactaaccagggatactgctatgtctattgcaagcaagaccataaggaaaatatttattaatttcatacaacgtgcacgagcagctgggaatcataaagaatctgcaaaagaactaaagaaaatgatagctttcaacaccttggttgtgactgagttggtgaatggcattaaagaggagtcagatgatgagtcaactgaagaacctggaaaggaggagacaagggttccatttggtgcccaaatcattacaaagaaggatgattcagaatatgttctgctaaatcagcttggcgggattcttggtctgagtagtaaagaaatagtgaaagtacataaaaatctggcagagcaggcttttaggcaacaagctgaggtaattttagcagatggacagttgacaaaggccagggtggagcagcttaataacctgcagaaccaagttggcttacctgaagaatattcttag

SEQ ID NO: 38640 - DNA, 402 bp, Glycine max
  Peptide Sequence Number=SeqID_130325
atggtgcatgggtttgatcacatggccatgaggagggtgttgattgtggtgtgtgtcggcaacaaggttggatggaggtcacgtggagcatatttggtggggcttgctcgtggatctggtggcgacctatggtgcgatgacgtgatgggtgacgacgacgcgcgacaatggtgtcagcgtgacgcatgtggaggagagagagataagagccaatcaattgggtttgttgtgctaaggagagagaggcacaatgtaacaaatgcaacatcaagaggcaatgaaggaggaataagtggggcccaaacaaggggacatgtggcagaattaggaggagagaggcgtagcacaaggctcaaaataaccaactccaagctagccgagtatgtgtggtcccggaagtag

SEQ ID NO: 38641 - DNA, 795 bp, Glycine max
  Peptide Sequence Number=SeqID_130326
atgaagtgttttctcgatgcccaggtggcctcccaatggagtagtatggaactcaatgaggagcatgggcaagaacgcatggccagagggaagccaaattcttttgcaataaaagatgaggtcgcgctggatcatttagtctgggaaggtgaaatagggcatggtcaaagtgagacaatgtggggttggaagaaagaggcaggacagagcatcggcggcggcgttgccggagcctggacaactcccatggcggtaactgaggcaccagtctcaagtgtgaaagggagaatgaaattgggtggtgctaacaccagagcttctgttaaagcgcgcttcaactggtcaaaagcgacttgggcttccttggaccaatggaattggtcttttcgaagtagtgagcgcattggaaaggccaaatggcatcaccttatattcgtagtagtgagtcctaaaagcaattttaggaatatcatcttcagccatgcggatttggtggaagccttgactaagcgtggggtggtagagtggtgtgttcctgaaatacgtgggttaaacggagaagaagactggaaagttttgggggttgatgatgatccagggagttgttgggaaaccgacgacacgaggctacatgaaattgtgagggctgccaccgtccaccaatattgtgactctgtggttcatcgagtggagatgacggaaggaggttgtggcgtctgtgtcagcctcgatggaaaaggaggtgtcgacatcatcatcagcgatcaaaagacggtttttagggaatcgtcttag

SEQ ID NO: 38642 - DNA, 801 bp, Glycine max
  Peptide Sequence Number=SeqID_130327
atgatgaatctgaatgaggaatgggtcataggtttgaatgtagcgtacatcctttgtggtacaagtagagcgtacatctacttgggttgtgatactgagaacaagagagggtacatctcttatggatcagttcaagtggagcgtacatccacttggttgttcaaagagaacaagggagggtacatcccttgtggatctttgcttgtaaaggattttacaaggttattggaaatctcaagaatcggtggttgcttggggactggatgtaggcacgggccacttgatccaacaagtggtatcgaagcaggtttcttgagaaaagtttcacaacttcaagattcatggcctcctcaaattctctgtttcctgaaggaaactccatccataggccacccatctttaatggtaactgccattcctgaaagtaaagatctttcttctatgtatcttgccactctttttggaaaactgcaggaacatgaaatggaacttcaacgtctcaaccaaaatgaagagaccgacaaaaggaaaagaagcatagcactcaaagcctcctcctcaatgcaagaagaagaagaaaaagaagaatctgatgatgaagaggacttctctctctttgcacactgcccaacatatgaatcatggccagagaagaatgagaagaaaagccatgaagaaataagatccaagaaggcgtatattacttgggatgacaacgactcatcggatggttcgaagaaggagatcaaccttctatccaagaactatgagagcgatgagaacatctctcaagaagattaa

SEQ ID NO: 38643 - DNA, 204 bp, Glycine max
  Peptide Sequence Number=SeqID_130328
atgtggactaatagaaaaagatgtatgtttcatagtgagcatggtctcatgagctttggaaatccatcaaagaagatgaaagaaatgcccaggactgacagtgagggatttatgtgcagggctaacttcaatgtcgactctcagtcaatgttcaaagtgatgccatgtgttggaagtgaagctaactgggccacatggagctaa

SEQ ID NO: 38644 - DNA, 1580 bp, Glycine max
  Peptide Sequence Number=SeqID_130329
gcagaggtagacaggatgagcatgatgcagttgatgttccccgaaggcgtaggtctactgcatcagcctgtaggcaatgggtacatattgcggttgatgagggtattcctcaggtgactgaggatgttcctcagatgactgaggatatccctcatatggctaacgatgttcctcagatgagtaaagatgcacctcagatgactgtggacgtagatgcgactgttgcagaggacttaggtcgtgatggtgctgaggggtcacatgctgatgagggattccctggtgggccacatgacccatcagtgctgacttcatttgcagagcatgttgcacatgccatttggactggacaggagcgtcctgagcagttggtgtcgcacgggaggaaggtggcattaattgggaggctagtgcttgagattgaagggctggttgctgccacaggattaagtccattgatcgggtgttcaattgtaaccgacgatcctggacttatatccgcatttgtggagaggtggcacagggagaccagcaccttccaccttccagtaggagagttgataatcacactggatgatgtgtcgtcactcctctatctgcctaccagtggtgccttccacaacttcgaggctctttctgtggacgaggcagtacttttgctgatggagttgcttgaggcacgacgatggattgtagtagctcgtgcttatctcctacacctggtcggttgcactcttttttctaacaagagtgcaacaaatgttcatgtggtgcatctagaggcttttcgcgacttgggtcagagtgggggctatgcctggggagctaccgcgctggttcatatgtatgaccagttagatgaaacttctaggaccacgacacgacagattgggaggtaccttactttattacagtgctggatctatgagtacttttcgagtgtgcatcagtgcgtcaccgatgatgcgtatgaggagacgtccccacgtgcctcccggtggctgacgacgaaggcacatatgaagggaattataggagcgtcataccgggcacgttgtgatgctttgacggtcatagacgtgtgctggttgccttatagtgaccatcgagggatgggtcctatggtggtcacagttcaaccggagagggtgctatgccagtttcggtacattcagagcatccctccgccgcctgttagcgcttcgttgtcatatgatgatatggatgacaggtggatgcatttctcagaccacgtagcagctgtgggtgacatttgtgtaatgcctaggcagtacagacatccaccttccccagaccatgaggactacatccagccggacatcccagaggttccaatgacatttgacccccctcaacatgatgattacgaaggctatgaagcgatcgcagaaagtttggagcgtgtgctcaaccttaggatggtcactgcaggcacagagttacagatatcatgcaagattgcctcaggatcgccagggggggtgctagcgcagatggaagtgttagggcttgacaaagacggcgcacagagcattgatgatgttttttatgttttgtag

SEQ ID NO: 38645 - DNA, 405 bp, Glycine max
  Peptide Sequence Number=SeqID_130330
atgtcgagcggagaccacgtgcatgctgagggacctctgatggggtcccttgacggtcattcattgactgcacagggttatacgacagtttggccaagggatcctcctagagttccgctgattcaacaatatgacatatttgttgaaccagatgtgtctcagcaatcggtggcggcagcggcacctgatgaagcagaagttgatgtgcatagtcctcgacatgcagtggatggttatgtagcaattgctgataaattggagaggctactgaacatgaggatcctgaccgaaggaacaaaagtctatattgttgttgaaaaatgtctgagcatcgcaagaagctacattggccaaccaattgtaggtcacagttcgaggcgtaggcgacatatggacgatcattga

SEQ ID NO: 38646 - DNA, 252 bp, Glycine max
  Peptide Sequence Number=SeqID_130331
atgcctgtggaaagagtattggttatgacccctactctaatacctacaaccaagggtggagatatcactcaaacttctcttggaaagagcagagagataagaggcaaggaggagaggagaccaaccttgcaagacatggcgatggagcacatagataagagtgatgagaggttcaaatccttgaaatccatcatgtcaaaccttctcactcttttgtctcaaagaactcctggcacttccttcccaaagtga

SEQ ID NO: 38647 - DNA, 114 bp, Glycine max
  Peptide Sequence Number=SeqID_130332
atggtgattttccaccatggagatgcagcggaagataaaggagatgagggaatggttgtgatgatttctatgatggacttggaaataaaaattgaacaaagaagacaacaatga

SEQ ID NO: 38648 - DNA, 336 bp, Glycine max
  Peptide Sequence Number=SeqID_130333
atgaccctttcatcatggcagaacaagctaaacaggcccatggctactacacctgcctcgcctcctcttcctcctcctgcagtagcatcagcgtctccgtctaccttgaagctgacacacaaagccacacaactacaatccttggccactagaccacctgagacaaagagactagtggtccacatcgatcctgcgaccgggaaggccaacagtccccacaagaagaaattaagaacatatttggggattgtcgctcgtgataaggtcgacgtgacatacgagacttggaaggaagtccctactgctcagaaggatttgatatgggaggatatttaa

SEQ ID NO: 38649 - DNA, 375 bp, Glycine max
  Peptide Sequence Number=SeqID_130334
atggcgccaccaccattggcgcttccgcgtaggagctgtcgcgtggccttggagacgccagtagcaccagtgcgttgcccttctgcttacgtggcgagggagacgcaaggagcactggcgcgttctgcatgggagagtgaaggcaccagtcaaactggcgtgttacctttgcagcaaggacaacagctttggcagaccaggagcagctttggcaggcaggagcagtacacgatgaattcggttataacagtgttgtatttcaatggaagggtatatgaagataatgatgatgtaatatttgaaggcagtaaaaaagcgattcagattaaatgtggatttagtttcaatgctttgaaggaaaaaattggagataag

SEQ ID NO: 38650 - DNA, 168 bp, Glycine max
  Peptide Sequence Number=SeqID_130335
atgagggggtcagggaaagaggagtcaccgagggaggaggtgttgtcgaggggggggttccgttgtggtgggtgtgttgttgaggaaggaatttcatcacgagttgagagaagggagaagaaagggggtgcaagattcaagttggcgagtgtaggattcaagtcctga

SEQ ID NO: 38651 - DNA, 531 bp, Glycine max
  Peptide Sequence Number=SeqID_130336
atgggcttgataagcgggaaccaatttggcccgttagggaataatgagaactctaacagagtcaaaaacaacacacacaatgcgactccttcttcaattcacatgaaacaacaaaaaagcacaacaccgaagcaatccttagtaaggaaaacaagaaaggcatcctcatcaaagaaggcgaaagctaacaatactaaatgtgagcctattgtcaatgaggtcagtctgaagaaggagttgtttgagcatattattgttggcaaggattttggactattttcaaatgtagagcctcttcactatgcaacatatgatggaatgactactactatagacattccaatgtggcttccaatgacttttaggtctccaccaaagatgattttggatgaggttcactcacttgtagctatctacatcttcggtaggaacaaggatgacaaagatagtgggaaggaaatcttggtaatgaccatggctaaaacatttgcagacatgaaagcattaaggagtcttgagcctaagggttag

SEQ ID NO: 38652 - DNA, 1482 bp, Glycine max
  Peptide Sequence Number=SeqID_130337
atggagccacccgcagcgaaacacggctccctgtggaacattctagttcgtctcttctccttcgccgtcctcatcttcgccgcgagattcgccatcatcgtcaccgtccgcggcggaacctgcgactccgccgatttctgcttcttctccgacaacctcactctctccgccacctcccgcatctccgacgccgaagatccgtattccggcatgaactggcgccgctccgtcgagcactacgccgccgtcttccaggacctcatcgccgagggcttcctctccccgaactcccgcgctctctgcatcgacactccctccggcgaggacgtcctcgcgctgaaagaggtcggcgtcatcgactccgtcggaatcttcaagaaaccgtcgccgccgctaatcctccacggcgacccccgccgacatccgttctccggcgacgccttcgacttcgagttttccggcaacggcggcctggagcggtcacctcggccagccgaattcgccgccgaggtctgccgcacgctccgtcccggcggcttcgcagcagtccacgcggcggtgagagatgcttacagcttcgactctttccttgaactgttcaattgctttgaactgatcagaacacgagaaatcaacagtgttgattcatctccggttcttgaaattttgatgaagaagaaaaacaaaaaccctaatttcgaaatcaaaaccctaatcagtggcaatttcgtgaaaaagtgctctgttaagggttacaaacgtgaaataattgaaaatgcagaggcattgatagaggaagagccattgaaaccttggattatactgaagaaaattgtgaagaacataaagtacttaacttctttggttgacataagctttaagaataggtatgtgtatgttgatgttggagctagaagctatggttcaagcattggaagttggtttaggaaacagtacccaaagcagaatagaacctttgaggtttatgcaattgaggctgataagtcatttcatgaagattatagggaaaagagaggggtcacattgttgccctatgcagcatgggtgaggaatgagacattgttctttgagatcaccagagacccaatcaagaatgtgatgatgagagggagaggaatggggaggatcaaccctgtgcaaacctcttctagccatatgggtgataaggacaagattcagggttttgattttgcagagtggctcatgagcactgttacaaagagggattttgtggtggtgaagatggatgtggaagggaccgagtttcatctcataccaaggttgattcagactggggctatttgtttgattgatgagctttttcttgagtgccattacaataggtggcagagatgctgccctggtcagagaagtgcaaagtatcacaagacctattctcagtgcttggatctgtttacttcacttagaaattatggagttcttgtacatcaatggtggtga

SEQ ID NO: 38653 - DNA, 1374 bp, Glycine max
  Peptide Sequence Number=SeqID_130338
atgccttctgaggatagtttaaggaagaagctaagaaagaatgccactaaacctgtagtaagcacttctaggaactttattagagctaagaaggatgaaaattcttttgagaaaaatggggcttttggcagaggaaatgagtctgagggaaagttgaagaaaagggggaattttaaaggaatgcgatcgggtgaagaagttttggagaggggaaagttgaggactttggattctggtgggaagaagaagaggatatatgctaagaaaggaggggataaaaatgtgaagttagagaatggtatggaagtatctaagaagagaactttgattaggaacggtgagaagcgagtgaaagatgtacccgttgaaggaaatgatggccaccatacaatgtgggatcatgataagacaaggaatggcggctttaaagtgaagcgatcgactcaaatgaggaaggaaaggaaggaagatgttgtgttggctattgcaaagcagaaaggcaaggcggaggatgcggggaaaattggattagttgggacagaagatcaaggaagtggttcggtgaagagaagtagagacaagaaaactgaattgagcaaagggaaaaaccaagaagttgtatctggttcaagttttgccaagaaaaaagccagagatagaacagggttggatgatgatgatgctgagatgctacatgatcgtccgaagaagaagaaaagggtgataaagattgacccacatgatatctcaaacaagagactagatgatggcattggtgttaatggaagtaaagaggagaaggagaaagaaaaggagtctgagaaagagcctaaaatgtccaagaatgcccagtattttgacttctactatggttattattcacagcttttgggcaggagacgcatgattgacttaaaaagggcaggttacaatatagatctttctgcacccttagataatattcccttctctagcagttcagaaagagagaaaattgaagaaaatgtctcatcatcatttccacctcctaatcttccagagattgcatttgctgcttatccattcacagggaaaaatacatctgaacctcctgaaaacaacaatggtggaaggtcaaatgtcgggaagtcatctcttctcaatgcactcactagacaatggggggttgtgcggacatcagacaagcccggccttacccagacaatcaacttcttcaatctgggaacaaagcattgcttagttgatttgccaggatatggatttgcttatgcaaaagaagaagtgaaagaatcttgggaggagcttaaagaggccccaggggatggagggacattgattcaattctgggactgttttattaacccgccaagatga

SEQ ID NO: 38654 - DNA, 228 bp, Glycine max
  Peptide Sequence Number=SeqID_130339
atgatgataacaaaagatgatgacaaaggtgatgacaaaaaactcaaaggtcaatcaaagaatgagttcaaaatgtttaagaatgaatcaagaacaattcaagactcaagaggaaaagttgaagaacacttaaagattcaaggatcaagtttcaagaatcaagatcaagattcaagaatcaagatcaagattcaagattcaagattcaagaatcaagagaaaacttaa

SEQ ID NO: 38655 - DNA, 1143 bp, Glycine max
  Peptide Sequence Number=SeqID_130340
atgcggaagagaaaggttgcatctgtgattgaagaagaagaaagtgtgcaaaaccatggccataataaccaaaacgaaaacgaggattgtgaaggaaatgggttctttgcttgctacctattgacctctctcagcccccgcttcaaaggccacacttacatcggattcacagtgaatccgaggcgccggatcaggcaacacaatggggaaattgggtgtggagcttggagaacgaagaagaggaggccttgggagatggttttgtgtatctatggcttcccaacaaatgtctcagctcttcagtttgaatgggcttggcagcaccctgttgaatcattggctgtaaggaaggcagctgtggaatttaaatccctctctggaattgccaacaagattaaacttgcatacacaatgctcacccttccatcctggcagagcatgaatatcactgtgaacttcttctccactaagtacatgaaacactgtgctggttgcccgagcttgccagtgcacatgaagaccaagtttggctcactggatgaacttccatgttataataaaggcattgatggtttgtcagagaatgaagatgatactattgatgaagtacaatttgatgataataatattagtactagtggttctgttccagatgtgagcgatgatttagtcactcctgattcaccccaaaatccaaatgacggggacaagattagtgaagcatttgagtggaacaaagaatctgaagcaagagaacctccactaggtaattcatttgcttcacaagagcagagccaactgtttagttctacaacgccactgacaatgaaatcatcatcaacaacttcattacaaagagctgagattattgaagaagacgattttatgagtgtgatgaataagagtgatgctgatttgagtcaaccagaaccagagcaatcaggtgctactacattggtagccaataaaaatcgagatgtcggccgcacatttgttgtgccccatgaaactgaaattatcgatttgtcaaccccctctcctagttgcagaagcgttttggataggaagaagagaagagtttcctcttctgttggtactgattttattgacttaaccaactcccccaacttcattgaattgtaa

SEQ ID NO: 38656 - DNA, 735 bp, Glycine max
  Peptide Sequence Number=SeqID_130341
atgttgaacctccttgcagctttcactcccactgaagcaagccctattgacttagttgtgcttcatcttattaagcttgtgggaagagcttcctctcttgttgcacacgtgccgcaaaagaagcttagtcgacatcctactcaaactgaaaggattttcaactcattcaacaagtttgaagatgcatacaagggcaagctcaacaaaaatgttctagagaaagctccttgctcagttggtgtcctcattgatcgtggtaatcaaaagatgttttggtgtggcttcagaatgggatcaatatatcaagtggttgtgctcttctttgatggtgcagatgatcgagaggcactttcatatgcgagacgcatgttagatcaaccttatgtacatattaccctttttcatttctcatcttcagctaagattgttggaggaacaaaatgttgtagtaatcctgatccatttgtggataaatcatggtatctagagcaaggaacgatcaagaagggatctttaagcacaaccatggcttccaatggcccttttccagcgaatctcccagttctcattggcaagaacttcagtagccactttgagaagattgcaggtgcaactattgcgaaaaaagcctgggacacgttgaacaaagcctatgttggtgtagaccaagtcaagaaagtgcgcttacaaaccctgaagagacagttgaactgctgcagatggacgagaatgacg

SEQ ID NO: 38657 - DNA, 147 bp, Glycine max
  Peptide Sequence Number=SeqID_130342
atggtgaaagggcatgcacgacatgacagtgcatatgagagtcatgcaggtgcaaatctagaggaggtggcagcgtgtgacgatggttacgaaggatgtggtggtggtgcatgtgtggctgtagaagatgggaaagggagaaaataa

SEQ ID NO: 38658 - DNA, 93 bp, Glycine max
  Peptide Sequence Number=SeqID_130343
atggagatcttcaacaactttgagttctactatctttctacctatttctcgattgttccttccttgagaaaatgtgattcaactttgatctaa

SEQ ID NO: 38659 - DNA, 1035 bp, Glycine max
  Peptide Sequence Number=SeqID_130344
atgggaaacagcttaaggtgttgtttggcttgtgttcttccatgtggagctctagacttgattcgaatagtccatttgaatggctatgtggaagagattacacgtccaatcacagcaggagaggttctcaaagcaaaccctaaccatgttctaagcaaacctagctctcaaggcgtcgttcgccggattttgatcctttcaccggagaccgagctcaagaggggcagcatctacttcttgatcccggaatcttcgctgccggagaagaaacggctagccggaaagggaagaaatgttggtggtgataatgatataaaaaagaaaccatcaacattgaaagggaacaagggtagtagtgatgatgattattcttcactatcacaagggtgcctcaataaagccactcacaaaggttctaaagagaagaaatcgtcgtgccgggatcgccggaaaggccgcatcggaatatggaggcctcatttggagagtatattggaagattacttcgagaaatgggatgcacctgaggagaaccacagagaaggacgcagaggaagattgaagttcttttcggagataataaaccaagaagcacaacaaccacaccctggagaagggaacgctccagagaagaaccctcactgtgtcgtcgtggtgttagaagaagcccgtcgaggccgcgcgacacagagtggagaagaccatgaagcggaggagccgatggtggccgagcacggtagcgtgagcaacgatagtgatggcgactacgacgatgatgatgaattggacgaggtgttcagcttcgggacgtcgtttgtggacgttgtcgctgccgattggctctcgcagaagggtgcagaaaaatatttcaagcatggatcgcatctaaaatggcctgaaggagctgtttcaagggagagcattagtgcagtgaagaaacttggtcatcttaaggatgaagtccgcaatgccacaaaatttgatctaccaaataaggatagaaaggattcccaaggaatatgctttttgggcaag

SEQ ID NO: 38660 - DNA, 309 bp, Glycine max
  Peptide Sequence Number=SeqID_130345
atggcgtccaagttcggcttagccggcggcattcccgagcgcaaggtccgcccaatatgggacgccattgattcccgccagttcaagaacgctctcaagcacgtctccacgctcctcgccaagcaccctaattccccctacgcactcgctctgaaagcgctcgtgctggagcgaatggggaagcccgacgaagcgttgtccgttgcgctcaacgcgaaggagcttctctacgccaatgaatctctgttgatggatgatctcactctcagcactttgcagattgtgtttcagcgattggatcactgttag

SEQ ID NO: 38661 - DNA, 448 bp, Glycine max
  Peptide Sequence Number=SeqID_130346
tgatgtgattcagaaaattcttccaccaaagcacaaagaccctgggagtgtgaccattcattgctcaataggtgaagtcatagtgggaaaaactctcattgacttgggagctagtatcaatctgatgtcactctccattaaaacattttatcttccagcagactttgttgtaatggatatctgtgaagataacgacattcccttaatcttgggaagaccatttatgttaactgcaagttgtgtagttgacgtaggaagaaagaaactggaaatgggctttaaagatcaaagaattgattttgatttatttgtaaaagacaagcctgtgccagaacaaaatgtttgcttgcagcctgcgctaagcgctcaaacccttgcatctcaagctgattggctcgctaagccttctatgggtgagctaagcccaattcaattcgatctggattga

SEQ ID NO: 38662 - DNA, 231 bp, Glycine max
  Peptide Sequence Number=SeqID_130347
atgaattgttccacatccttgcggatacctggccatatgaaattctcactaatccttgccatggtcttggttacccccatatgtccccctactggagaaaaatggaattcagccaataatgtggaaatgaaaggggaagtattagaattacacagtaggaggtctggaagagggctgaagaattggagcagcacgctcaacgcgaggagccaacttggaggccaggcttag

SEQ ID NO: 38663 - DNA, 579 bp, Glycine max
  Peptide Sequence Number=SeqID_130348
atgcaactgtggccccgaactactcgggagcaagccacgagtaagggttgggatcctagttctgctgacgcagggtgtactggtaaaacctctcatttagctacacccgaccctatgattgatcgcctgctgagatggactctagagatggtggctgttgtagaggtggcggcggtgcatatgcgtctggctgctgctgatggtcctgcccctgctgctgcgtccactaggtttcttggagaccagctggcacttcgacaagggaagatcaaaattatgatcgctggtgaggatgttgctgagaagcagtgtcatacaaatctatgtcagggtggtcatgctagtacgcatgatccgcacctgtctccccgccacacttcgagcaaagtcttgcctcgaaacacacagcagctggccgatgaaaaggttaaatttgaatggagatggtacttgtgtgagatgaaagaaaatgcgaaaaaaatgaaagcaaaagggcacaatggaagcttggggctgctgcaaagggtggcttccataagcttgttggaggctttgagttttgggaaagaaatggggtga

SEQ ID NO: 38664 - DNA, 435 bp, Glycine max
  Peptide Sequence Number=SeqID_130349
atgtttgcacattcgattaaaaggctgccgtcccttggggcggacgtgtggggtgctaataccttccccgtgcgtaaatacaactcccgaacctttcacttaaaagttcgtagatcgcgtcttttccggtttttccgacgttttcctcaaataaacgttggtggcgactccgcgcgtattcctttcgtggaacacgcatcccgcgagtctcgcgtcgccctcccgccgaagggtaggttgcgacagttgggtttcgactgcacaaaaaacatagctgagtacgaggcatgcgcccttgggatccaagcggcaatcaacttcaaggcttacatcaagaagttgatagaattcttcgatgacatatcctttcatcatattcctagagaggaaaatcaaatggccaacgcccttgccacactagcatccatgttttag

SEQ ID NO: 38665 - DNA, 237 bp, Glycine max
  Peptide Sequence Number=SeqID_130350
atgactggcgaggggattagtccttacattcaaactgtcctcttgaaacatcagtcatcccacgttaatcaagctttgtaccttgtgcttgaaggccacacattgctctatagaatgccccggaacaccaccttgataagcacaggttgcattgggattgtaccatcgggggaagggggattgatagaccttcccggggttcaccatgaccatctagttgctgatcaaagatggtag

SEQ ID NO: 38666 - DNA, 429 bp, Glycine max
  Peptide Sequence Number=SeqID_130351
atggcaggagctggtgacaatggtgatgtatatcatcaactggacggatctcagcacttatttctggacgcgatgactatacaaatgcaacgtttgttgaaccgtaacaaagaagagctctacagacgaatagccaaatcttccttgtttgttcttaaacctctatcccctagagaagagattcctcctggactgccaccttcaagaggcatagaacatcaagatgcacatgccaaagttgagtatgtgaaaagattgtatgaccaagtgaatgtgcaaattgcaaagaagaatgaaagctataacaagcaagccaacaagaaaaggaaggaagtggtacttgaacccggtgatgatcttggacatttgagggcaaatattttccaagaaggagggaatgatgagaatcctgaaactgaccaaatatag

SEQ ID NO: 38667 - DNA, 369 bp, Glycine max
  Peptide Sequence Number=SeqID_130352
atgacaagtaaacttcaaatgctcataactcttgctacggttgtccgtttgaggcccactatatatcaaaacgctcagaattcagaggagaatccagataagggatttgattttttttttgacacaaagtctgaaagatacaagaaacaagaacaagaacaagaacgaaacaaagacacaaacaagaacgcaacaagacgcaaacaagaacgaaacaaggacaaattacaaaaaaaaaaggataggatagaacctgtaccaagagccgaagctctgataccagataatgtgaacctgactaggagcagatcgcttgatacaggctactacggagatttggatgacgccacttccaaagagggaagataa

SEQ ID NO: 38668 - DNA, 489 bp, Glycine max
  Peptide Sequence Number=SeqID_130353
atggcggcggagcagttttataactgcaagttgttggaggaagaggttggggtttgtgtcgaggttgtaagagggaagatctttgagacaaaatgtgaagacattgtggttttggggattagaggcttcttctccctctccgcgaactgcttctcctcccttctccgcgaacagcttcttcttcttcgcaaggcaagcgcgaagctcgtcttcttcttctccgcgaacgaggataataaccctagggtagaagacgagaggagaagatgttggaaaaaatggggaaaggactcacggcggaggcttccagaagacccgttaggggttcttccggaacttccggaagaacatgttccggaaactttccagaagaagtgttcttccggaagtaaccaaacgtcttccggaagaacacttctttcggaagtctcccggaacacctctttcggatactttccggaagaagtagttcttccggatgacctttga

SEQ ID NO: 38669 - DNA, 1545 bp, Glycine max
  Peptide Sequence Number=SeqID_130354
atggctagaacacgaggtttaggtcgtgtcattggtagacttgtaggcagagatagacaagatgatcatgatgcagctgatgttcccgagaggcgtaggcctactgcctcagcccgtaggcaacgggttcatcagacgactgcggatgcacgtgatatgactgaggacattgctaacatgactaacgatgtccctgatgtggctgcggaggcacttgagatgcgtgcggacatacagggtgctgatggtgctgaggggtctgatgctgatgatgctgctgagggattccttggtgggccatgtgacccgttagtgctggcatcatttgcggaccacgttgcacatgctgtttggagtggacaggaacatccttatttgaagttagtgtcacatgggaggaaggtgacactgattgagaggtcagtgcctgagattgaaggcctggtggctgccacaagattaagtccactgattgattgttcagttattattggcgatcctggactgatatccgcattcgtggagaggtggcacgagttgctcgaggtgtctgccgaggaggccagagccgagacagcactgacacgtggggcatatgtacaacttggatgggttcgagacatttatgagacgagatgtcaggcccggcggtggattgttgcagctcgcgcttatctgctgcaccttgtcggttgcactctttttgctaataagagtgcaacatacgtgcatgtggttcaccttgacgcttttcgggacctcgctcagagcggtggttacgcttggggagttgccgcgctggttcatatgtatgaccagttagatgaggcttgtaggaccaccacccgacaacttgcggggtacttgatgctactacagtgctggatctatgagcacttccctagtgtgcaccagtgcatgacagatgatacataccaggagacgtccccacgtgcttcccggtggttgacgtcgaaggcgcacatgaagggaatcacaggagcaccttacagggcacgttgtgatggtttgaccatcacagatgtgtcctggttgctgtacatggagcatcggggggttagggcctttcaggagattgcatcattccagggtcagctgagatggggtcctatgatgtttggttacatccagagcatccttccaccgcctgttagtgctcgattgtcacgcgatgagatagatgacaggtggatgcagtttgcggagcacttactacctgcgggtcagctttgtctagtgcctgggcaggtgaccagtcgagagatgcaccagctgcagaccccgatgactacatacaaccgtccagcccccaggttccagtggcatttgacccccctctacatgtggatgattacgacggatgagacgattgcacagaggttggagcgtgtgctcaaccttcggatagtcactgcaggcacagagttatatgacattatgcaggactgcctgacgatcgcgaaagggggacccagtgctgatggaactgtcagggctcgtcagagacgccgcacggaccattga

SEQ ID NO: 38670 - DNA, 342 bp, Glycine max
  Peptide Sequence Number=SeqID_130355
atggcaattcccatgttgagggctgcaatgatttctcattccacatccaaaaagcttaacaccggtggggaagatgctttccttgtgagcaactataatgggggagttattgctgttgctgtctctggttgggctgaggaggacgtggatccatcgttgttccctcgtgaattgcttgctaatgcttccaattttgtaggagatgaggaggtgaactatgatcctcagattcttattaggaaatcacatgccgctacttcctccagaggctcagctactgtaagcatcgttgctatgctggagaagaatgggactctgaagattgctaatgttggggattga

SEQ ID NO: 38671 - DNA, 1467 bp, Glycine max
  Peptide Sequence Number=SeqID_130356
atggttccaacgacacataggcataacaatccccatggtggcactatgcatgagaaaaaacatggacaaagaaatgaccttgattccttcactaggatcaatatcaggcccgctatgatatggatcaataacaatactcctgaagggcaccctgagcaacagtcctttgtggttgcaatttttctaggggctcttgtaatgggcttcttaactgacatgtttggcatagcaattgctaatgggccagtatttttgggcctggtaattccagatgggcctcgtgtgggagcaacaattgtacaaaagaccgaaacaattatggctgatattcttctaccattctcattcattatggtgggatcatacactgatttctatgccatgagtgcttctggttggtccagcttagaaccattgattgtcatggttattactggctacgttctcaaattcttttccacttggattgttctacatttctggcgaatgcctctcagagagggactaacccttagcctcactttgagcttaagaggccatattgaacttatattgtttgtgcattggatggacaaaaatatcttacatattccagacttcacattattggttcttatgacaacaatacttcagatgcaatgtttaccatccgattctctgcttcttcagccagctatttatgtcacaagtcttgctgctgtagagctacttcgtgcgcgtgatggaggtcagcagattattgactcagttgatgttacatgtggtttaagcctgggagaatatactgctctggcatttgctggggcttttagctttgaagatggactcaagttggtcaaactgaggggtgaggccatgcaggatgccgccaatgctgctaaaagtgctatggttagtgtgataggactggactcagagaaggtccaacaattgtgtgatgcagccaatcaggaagttcctgaagctgagaaggttcagattgccaattacctgtgcccaggaaactatgctgtctctgggggattaaaaggagtagaagtgctggaatccaaggcaaagtctttcaaggctcgaatgacggtgcacctagctgttgctggtgctttccacactagttttatgaaaccagctgtgtcaaggttggaagcagcattggcaacaacagaaatcagaaccccaagaataccagtcatctccaatgtgaatgcacagccacatacagatcctgactcaataaagaagatattggcatgccaggttacctcacctgttcaatgggaaacaacagtgcagactcttctaaccaagggtctgaagaaaagctatgaactcggacccggaaaggttattgctggaatcatcaaaagaacggacaaaggttctgtttgccattttgcaatttgcagagctccaaacatcggttcatgcattccaaagcagcaaaacaaagcaaacagagaaaagtaa

SEQ ID NO: 38672 - DNA, 207 bp, Glycine max
  Peptide Sequence Number=SeqID_130357
atgactcagattgcagatgtgcggtcttgtggggtgaccttatatgtcatgttgaggattttgaatgttcaatactcaattcctgactatgttcatatatcttccgagtgtcgtcatctgctatcaaggatttttgtagctgatcctgcaaagttgatacccgtgattaagatcattgcagatgccgtctcatggctgcacaagtag

SEQ ID NO: 38673 - DNA, 510 bp, Glycine max
  Peptide Sequence Number=SeqID_130358
atgtcttcctctctcgttcttccttccactcccttcttcgcccatggaacaagaaccctccctctcactcgatctaggctttccatgaccgtctccgccggatctcagccttctctccgcgacgctctgttcgccgattacaaggcctccacttcattcctcttccccggccagggtgctcaagctgttggaatggggaaagaagctcagaatgtgcctactgctgcggttttgttcaacaaggcaaacgacgtattggggtttgatcttcttgatatatgcatcaatgggccaaaagaaaagctagattcaactgttatcagccagatgcaatgtttaccatccgattctctgcttcttcagccagctatttatgtcacaagtcttgctgctgtagagctacttcgtgcgcgtgatggaggtcagcagattattgactcagttgatgttacatgtggtttaagcctgggagaatatactgctctggcatttgctggggcttttaggtga

SEQ ID NO: 38674 - DNA, 369 bp, Glycine max
  Peptide Sequence Number=SeqID_130359
atgatttctgatgttgtattctttgaccgctcgaatacattgttctttttcatcgaaggtcatgccaacctcgagtgcatcggttggtggtgtcgttgggctgccaacaccctcgtcatcgctttagtcatcactttggtcatcgctttggtgattgatgtgatcaaagaactattgatcctcttcctcactaaaatcatccatgttttcctcatgaaactggggatgaatgatggttttgttggtcaaaagaggttgttgtatgaagacactggatcattgaggtccaggttgttgtacgataattgtagtggaggaggtagttgtagttgtggacatgagggttgtggagacgatggttgtggttga

SEQ ID NO: 38675 - DNA, 132 bp, Glycine max
  Peptide Sequence Number=SeqID_130360
atgatcaacttcgactcacagtatttggaagtcgtctctgaggctaaacacttaccgtgttctcatgtcgtggttgcttgtaaatctgtcaatgttgatcccatgaactatgtgccgctgctattcacttaa

SEQ ID NO: 38676 - DNA, 138 bp, Glycine max
  Peptide Sequence Number=SeqID_130361
atggagatgaaaggctccgtacgcgggacgtcgggatgtatgcggtttataggcgttcagaatctagacgatgtcaaatctagagaggttgagccgcagagacaaaaagatgaggagatgaaaaaacgtgaagaatga

SEQ ID NO: 38677 - DNA, 258 bp, Glycine max
  Peptide Sequence Number=SeqID_130362
atggcaaaacaagcattttgtctcagcttaattctcaaggccaaattagcaatgtggttggccactgctttagtgggagaggatgtggctttttattctttggagatcaactcattccatagtctggagttgtttggacacccatattgcagacttcctttttctcgatatatctctttacaatataagttagtgatttatgacaacgagaaacaacagattaaggtggatgagcttattatgaaatttcgagtataa

SEQ ID NO: 38678 - DNA, 252 bp, Glycine max
  Peptide Sequence Number=SeqID_130363
atgctttgtgtaatcgattacaatgatttgggtacatcctttgtggtacaagtagagggtacatctacttgggttgttgtgactgagaacaagagagggtacatctcttgtggatcagttctagtggagggtacatccactaggttgttcaaagagaacaagggagggtacatcccttgtggatctttgcttgtaaaggaatttacaaggttgaaaagaaatctcaaggaccgcaagtcgcttggggactga

SEQ ID NO: 38679 - DNA, 360 bp, Glycine max
  Peptide Sequence Number=SeqID_130364
atgggtcatcctccacgcactgacaccatccaccagcaccgcccgcaccttcagcaaaacgacgcaacgctcgtcatcaccgtagaagcagaggcggagaacgatgcggcgaacagagatctcggatgcggctctgtcgaagaagagctgacagaggaggcagcagtgccaatgggggcgatggtggtggtggcggaggcgtcgtgggttttcgccattgatcaggataactatgaactccttctctctaggtgcatcaaagaggacttggggttcaaaaatgagacgcatgaagaagttgccattaagaaggttggcaatgcatttgacaacagaatcgatgccaaaaggaccctatga

SEQ ID NO: 38680 - DNA, 195 bp, Glycine max
  Peptide Sequence Number=SeqID_130365
atgtcctcgctctcggtgaccactctccgcagcagtgacgactttacaaaaggagagttgtcgggacagaaacagaatcaaaatgtaggccatggtgaaaaaggtgacgatgttggcatggagctcgatggtgaacgtggagttgcattgggagagcttgaaccatttcccaactctagttgtggctacgtgtaa

SEQ ID NO: 38681 - DNA, 1146 bp, Glycine max
  Peptide Sequence Number=SeqID_130366
atggttccttctacatatggttctaaatataactcttgcagatatgttgctgttggtgatgagccatttcttaaaagctatggtgaacaatttcatcccttcctaattggagctgctatgaacattcaagcagctctaaaaaaagcaaaattggacagcaaagtgaaagttgtggttccatgcagctttgacagttttgagtcaggatttaacctgtcctcgggagtaaatttcaggcctgacctcaacaaaaccatgattgagctccttgcatttcttgataagcatggatcacctttctttgtgaccatttctccgttcataacccaccttcaaaccaaaaacatttcactggacttctccctcttcaaagaaactgcacgccctcataatcttagccataaaacatacaaaaacagctttgacttgagctatgatacagtggctacggtattatcaacagcgggatatcctaatatggacattgtcgtggcgaagattggttggccaacagatggagctgccaatgcaagctcataccttgcagaaaccttcattaaaggccttataaaccaccttcatagtaacttggggacaccacttaagccacacaagccaccacttgaaacatacattttgagccttcttgatgaggaccaaaggagtattacttctggaaactttgaaaggcattggggtttgttcactttcgatggccaagcaaagtaccatgtggatcttggccaaggttcaaagagcctcgtgaatgctcaaaatgttgagtatctgtcttctaagtggtgtgttgtgaacaacaataaggacttgtcaaatgcaactgccagtgctttagaggcttgtgcaaatgctgattgtactgcattgtctcctggtggatcttgctttaacatcagctggcctagtaacatatcatatgcttttaatagttactatcagcagcatgaccagagagcggaaagctgtgactttggaggtctaggtttgatcactactgttgatccatccatggatcattgcaggtttcctattgagattcgcgtctctcacgcagaatttcacaggatgtgtaatttcctgcgggtgattttacttgtaacaaccctcttggcatctttgacggtttga

SEQ ID NO: 38682 - DNA, 360 bp, Glycine max
  Peptide Sequence Number=SeqID_130367
atgcctactaccaccaccactttttcttgcttcctcttcaccttcctcatcaccacttccaccatggcttctatggttggagctgtgggggtgaactggggcaccatggcttctcacccacttccaccccacaaggtggtgaagctcttgaagtccaacagcatcaacaaagtcaagctctttgatgccaactctgatgttcttcaggccctttctggctccaacattgctgttactgtgggtgttcccaacactttgctcagaagcttgaactcttctaagaaggctgctgatagctgggtccatgataatgttacccgctacatgcctaatgggggcactgttactcgaatcgagtga

SEQ ID NO: 38683 - DNA, 345 bp, Glycine max
  Peptide Sequence Number=SeqID_130368
atgcaagcgttcgctaagcgcaacactcttgggctaagcacgaggaagaatccagaagaagatgagttgtacaggttcgctaagcgcaccgcttcagttcataagcgcctcaccaatttagctgacaacaacatcaacttagccttggtgaaggagttctatgccaatctctacagtcccgaggggccttcaccaaaacaaacagcctcaacaccttcctggagacacctgtggtactggccgagggagaatccttacccgcttactccagatattgcaggatgctcattgatatcagagagattgaggttgctttgtgtatacccggccgaaggtttgttctaa

SEQ ID NO: 38684 - DNA, 189 bp, Glycine max
  Peptide Sequence Number=SeqID_130369
atgaagaagaaagaaagcacggaggaaacctcgtgtagcaaaccaaaaatggaaaatctcagcaagtggaaaactcaacaggaaacaaaagcaaaaattggaaatgaagctggaagaagaaagaaagcaaacgaaaggagcagattgaagttggtgaggagatcacgcaaatggagaaaccttaagtga

SEQ ID NO: 38685 - DNA, 165 bp, Glycine max
  Peptide Sequence Number=SeqID_130370
atgacaggacatgcctcgcaatggataaggagaccagtcagggtcacgctgttttgcgagaatgctccaatcatgtgggatcaacacaggcttataggagcactcaaaccggatgacccccaaggcctgcactccgaagagtccgttagggcctttccctcctga

SEQ ID NO: 38686 - DNA, 234 bp, Glycine max
  Peptide Sequence Number=SeqID_130371
atgtttgtagatcgaggtagtggtagacatcacaaatggatgatcaccatgaataatggcctatcatgtgttgctgaggcctggatccattatttagttgactgtcatttgaagcctggagatgaggtcgtcttcttctacaacattgaccaacatttatgggaggtcctctataggaagcaaaccattgatccaacactaacacttggtagtgctttcctctctgcggattaa

SEQ ID NO: 38687 - DNA, 2096 bp, Glycine max
  Peptide Sequence Number=SeqID_130372
atggtgcagtcaccgcagtatcgcgagttctggcagcgtctgaatcgcggcgaaggcttcagcgataagtttttgcgcgtggcgaagcacagccgtccgatctggctggaagccaactacgtaccggtgcaggatcgccacggccgggtgattaaaatcgttaagctggcgagtgatatcaccgcgcgcatcatggatgcgcaggagcagcgcgccatgaccaccgccattgagcgctcgatggcggtgattgccttcaacctcaaaggtgaagtgctgatggccaacgataatttcttcaataccatgggctatcgcgctgatgagatcatcggtcgccatcacagcctgttctgtccgcccgaaatgcgcaccagcgaggcctatcgccgcttctggcacaagctcaatcagggtgaatatatctccggccagttcgagcgcgtcaataagcagggcaacaccgtctggctgcgcgccacctataatccgttcgccaccgacgttaccgcgcaggtggaaaagaaccagctggagcgcgaagcagcgcagcaggcatggcaaaccgcgctgcataccagcgaaagcacacaacagggtgcggcggtcattgagaacagcgtacagaatatcaatgcgctggccagcgaactgcacggtatttctggtgatatcaatgatctgagcgactcttccgatcgcatcggcgccatcgtggagagtattcgccgtattgccgaccaaaccaatctgctggcgctcaatgcggcagtggaagccgcgcgcgccggtcatcacggccgcagctttgcggtggtcgccagtgaagtgcgcaccctcgcggcaaacatcaatcgcgccaccagcgaaatcgagaatcgggtgaggcataaccatctgctggcggataaggcgcagaaaggcatcgcgtcgaacctgaagcgtgccgatcagggcgtagtgctcgcgcagcaggcgggcggtgtgattgccgaaattcgcggcagctccagtgaggtggtgcgcgccatcagccacgtcgccgatacactaaaagccccgcaactctttctcatgcagcagcctgatttccgcaccgggcttagcgccctgacgggtcgtgcccgcgcgcgttcgctgtgtattgcggtgccgttcgtcacgccagcgatggacaacacggcggtaatggcgctgtttagcgaacacaaagatttgattggcctgccggtggtggaaaacggcacgccgttcggcatgattaaccgccacatctttctgtcgcaaatgacgcgcccgttcttccgcgagctgtacgatcgtaaaagctgtatcgcctttatggacaaacaaccgctggtgatcgatgccgaaaccgaactcgatcgggtcgcgcagcaggtggtcgccagcggggataaatcagtaaccgatggctttatcgtgactgaacagggccgctatattggcatcggtctgggtatcgacctgattcgcaccgtctccgatttgcaggcgcagcagcatcagcaaattttacagagcatcgattacgcgcgggtgattcaggacgcgatgctggaccgctcgcggcagcagatggcgcagcaactgagcgactggtgcctgcactggcagccgcgcgatggcgtgggcggcgactattacgcctttcaccgcgacgagcacggctggctggcgctgattgccgactgcaccggtcacggcattcccggcgcgtttatgacggtgattctgcatgcggcgctggagcgtgcgctgcagcacaaccatcgtacgccgtctgccctgctgcaggcgcttaaccgccacatcaaacaaaccctgggccagcttaacgcctcgcagcagacttcgctgtccaacgacggctgcgatgcgattgcgctgcggctggagacggccagccatcagctgagctgggccagcgcgcgcatgcacgccgtgctgcagccggtacaggggaagccgccgcgctgcaggccgatcgcgtcggcgttggctacaccgatacaccgcacgactattgctggccgcagcagcagcgcacactgcagcccggcgatgtgctgctg

SEQ ID NO: 38688 - DNA, 2074 bp, Glycine max
  Peptide Sequence Number=SeqID_130373
cgacgatcgcttccgccagatcatcaaacaggtcggcgttgccattatcggtcagaccaattcgctggcgccggcggataagcggttctacgccacgcgcgatatcaccgccactgtggattctattccgctgatcaccgcctcgatcctcgccaaaaaattagccgaaggattagacgcgctggtgatggatgtcaaagtcggatccggggcgtttatgccaacctttgaggcctcgcagcagctggcgcaggcgattgtcggcgtcgccaacggtgcgggatgcaaaaccaccgcgctgctcaccgacatgaatcaggtgctggcatcgagcgccggtaatgcgctggaagtgcgcgaagcagtgcatttcctcaccggtgaggcgcgcaatccgcggctgctggaggtcacgctggcgctgtgtgctgagatgctgatctccggcaaactggcggcgaacgaagccgaagcgcggcaaaaactgcagcaggtgctggataatggtaaagcggctgaggtgtttgcccgcatggtggcggcgcagaacggcccgacggatttcatcgagcagatggaccgctacctgccggcaccgatgctgagcaaagcggtgtacgccgatcgtcccggcatcgtcagcgccatggacacacgggcgctgggcatggcggtggtggcgctgggcggtggccgtcagcgcgccagcgacagcattgattacagcgtgggcctcagcgacatgatcacgctgggcagtgaggtcaatgcgcagcagccgctggcggtgattcatgctgcgtcggaagcacagtggcagcaggccgctgcggcagtgaaagcggcgataacgctcagcgaccacgctccggaggccacgccggtggagacttgcatgaaacgtgcttttattatggttctcgactccttcgggattggttccagcaaagacgccgataaattcggtgatgaaggatcggatacgctcggccatatcgccgaagcgtgctttgaaggccgcgccaatgaaggccgcgaaggtccgctgcatctgcccaacatgaccgcgctcggccttggcaaagcggcggaactctctaccggccgcttcccgccgggactggatccgcaggcggaaattatcggcgcttacgccttacgccagcgaactctcttcgggcaaagatacgccgtccggccactgggaaatcgccggggtgccggtgctgagctgctggatacgctggtaaaacgcgccgatctgccgggctacctcggcaactgccactcctccggcacggtaattcttgaccagctgggcgaggagcacatgaaaagcggcaagccgattttctacacctcggcagattcggtgttccagattgcctgtcatgaagagacctttggcctcgatcgcctgtacgcgctgtgtgaaatcgcgcgtgaagagctgaccaacggcggctataacattggccgtgtgattgcgcgtccttttgtcggcgataaagccggtaacttccagcgcaccggtaaccgtcacgatctggcggtcgaaccaccggcaccgaccatgctgaaaaagctggtggatgagaagggcggcgaagtgatttcagtaggtaaaatcgctgatatctacgcggagcagggcatcacgcaaaaagttaaagccaccggtctggatgcgctgtttgacgccaccattgagcagatgaagaaggcgccggacaactcgatagtgttcaccaacttcgtcgattttgactcgacctggggccatcgccgcgatatcgccggttatgccggtgggctggagctgtttgaccgccgtctgccggagctgatggcgctggtgaaagagggcgatatcctgattctcaccgctgaccacggctgcgatccgagctggcatggcaccgagcacacgcgcgagcacatcccgattctgatctacggtccagaagtaaaaccgggctcgctgggttaccgcgataccttcgccgatatcggccagaccatcgccagctattttggcctgtccagcatggactacggcaaaagcttgcggtaa

SEQ ID NO: 38689 - DNA, 2434 bp, Glycine max
  Peptide Sequence Number=SeqID_130374
tgggttaactgatagaaggatgatatcgatgaataagactaagattgctaaaaccctgattgctgcactggccggtactgcgctgttaagcggcgcggcaatggcggctgataccagcagcagcgcgggttccaaaatcgatagttctatgaaaaaagtcgatggctttatggatgacagcggcatcaccgccaaagccaaagccgcgctggtggacgatgaagcgattaaaagtacggatatctcggtaaaaacgcagcaaggcgtcgtgacgctgagcggttttgtcacctcgcaggaccaggccgagaaggctgtggcgctggtgcagaaggtggaaggggttaaatccgtcagcgacaaactacacgttagagacagcaaacagagttcattgaaaggttatgcaggtgatgcagcaaccaccagtgaaataaaagctaaacttttagcagatgacattgtgccatcgcgcaacgtgaaggtggaaaccaccgatggcgtggtacagctgtccggggaagtggcgaatcaggcccagtccgatcgggctgagaagatcgccaaagccattgaaggcgtgaaaagcgtgaagaatgacctcaagttcgattttcactatggtaaaggagaggcttatgtttcgttggggtattatctttctggtcatcgctctgattgctgcagcattaggttttggcggtctggcggcgcctccctcagagcagcaaacactgagggacatccattgggaatacgcatcccggtgtcgctggacacctttgagccactggcactcacgccattcaaatccaaaaaaatcgcgctggtctgcgaaggcggcgggcaacgcggcatcttcacggcgggcgtactggatgaatttcagcgcgcaggctttaacccctttcagttaatgctcggcacctcagccggtgcacaaaacctctcagcctttgtctgtgctcagcccggttatgcgcggcgcgtgattacccgttacaccaccagtaaactgtttttcgatccgctgcgttttgtgcgcggtggccacctgatcgatctcgactggctggtggatatcactaaacaggagttcccgctggcgctgagcagcgccgaaagcctgtttgccaaaggcagcgaattttacatgtgcgcctgccgcagcgatgattacagcgcgcagtatttcaatcccaccaatctgacctggcatgacatcattaaggcttccagcgcgatccccggtttctaccgcagcggcgtgctgatggatggcgtgagctatctcgacggcggcatcagtgatgctattccggtgcgcgaagcggcgcggcgtggcgccgataccattgtggtgatccgtaccgtgccgtcacagatggcgtatacgccgaagtggtttaaacgcatggagcgctggctgagcgacagcgccctgcagccgatgatcaatatcctgcatcagcacgaagagagctaccgccagattcagcagtttattgaacagccgccggataatctgcgcatcattgaaatctttccgccaaagccgctggccagcatggcgctgggcagtcgtctggcgtcgctgaatcaggattatcatctgggccgccgcagcgggcgctatttcctggcgacgctgggccagtggctgagcgatgctgaaccgctggcgcgcccgattgccgtgacgccgccagccgccgtcgccaacgcgccggataaccggccggcgggcgtggaacgcatcatcgtgccgtgcgtggatgccagccgttttgccgtggtgagccagctggcgcagcagcatccggcgctgtatagcgcgctcgggctgcacccgatcaatattgcgcaacatcaggatgacgatctcgatcgccttgagcagtacctgcaaacgccggatgcaaaacgcgtggcgatgggggaaatcgggctggatctgtatatggaagcgccggattttgcgcggcaaacccggctgctggaggcccagctgaagctggcaaagcgctatgatttgccggtgatcctgcattcgcgacgtacgcacgatcagctggcgcagtatttgcgccgtcacgatgtgccgcggcgtggcgtggtgcacggctttgccggcggccagcagcaggcggagcgtttcatcgcccttggctacgcgattggtgtcggcggcaccattacctatacgcgcgccagcaaaacccgccacaccatcgccagcctgccattgcaggcgctgctgctggaaaccgatgcgcccgatatgccgctgcacggttttcagggccagccaaatcgcccggagcgcgcgcgtaatgtgtttgaagtattgtgccagctgcgcccggaaccgcccgatgagatcgccgatgcgctgtggcacaacagcctgcgtttgttcgcgctgccggattga

SEQ ID NO: 38690 - DNA, 534 bp, Glycine max
  Peptide Sequence Number=SeqID_130375
atgctggctggagccgcgacctttaacggtaccggcggtctggatcgcctgtccgaacagcaggactttttcggtgattgtggttttaccggcgtccgggtgcgagatgatcgcaaagggcaacgcgcgagcggcgcgctgcgaataaatcattccggagccagtccggcggataacggtgccaatggcgacgcatgcgcgtcgggtcacagcagggtgtgtgcgatctacattggcggcagtccggttatcccatcagcattgaggcggcatagcatacaatatttcagcaggcgggggaatctgcggcaggatgagacgatgctcgcgcagttcaggacatgtcttgtaaacactaagcgatgtctggctgagaatgcctgtccggaaccgtcaccccggcaaggacagcaaaatgaccctacagctcaacccacatacttacagcccgtcgcaccgaaacgccgccctggcgtcgcccgcgcagatgtaccgcaaacccggcgagatgctgctgatcaacgcgccggataa

SEQ ID NO: 38691 - DNA, 1562 bp, Glycine max
  Peptide Sequence Number=SeqID_130376
atgacctcacgcctgaacgaccagctcaatctcgaattcttctccgccaacctctatctgcagatgagcgcctggtgcagcgacaaaggcttcgaaggtgccgcctcgttcctgaaaatgcactcgcgcgaagaaatgcagcatatgcagaagctgttcgattacgtcagcgatgccggttcactgccggtgctgggcagcatcgccgcgccggcggtgagctggacctcgctgaatgacgtactggaagaagcgctcaagcacgagcagctgatcaccagcaaaatcaatgaactggtgcacgccgcgctgacttcgcaggattactccacctttaacttcctgcagtggtacgttgccgagcagcacgaagaagagaagctgttcaaaaccgtgctggacaaactggcgctggtgggcaacaaaggcgaaggtctgttcctggtggacaaagatctgggccgcatgaaccgccttcagtctgagctccgacggttgtggccggccaaacaggtagccctgaaacagcgtacagccctcttcgcgcagccggacaaactgctcattactctccacgccctctgcggtgatctgaatatccaggctgcggctcatgccggtaatcgcgcggatgatcgccagcgcctcgcggctatagctgagcgacgaatagccggtgccgaagtcgtcgagcgcaatctgcacgcccagcgttttcaggctctgcagcgtacggatattgccgagcgtatcatccagcagcaccgattcggtgatctccacctccagccgatgcggcgccaggccggattcgcgcagcgcgccctccaccacagataccagcgagctgttcttaaactgcagcggcgacagattgaccgagaccgactgttcggtttcccagctctgcgcctcgcggcaggcttcgtacagcgcataggcgccgagcatatggatcagcccggtctcttcggcaattggaatgaagtcattcggcatgatcaatcctttgatcggatgatgccagcgcatcagcgcctcatagccaatgatgccggtctcgttggtgatcggctgatagtagagcttcagctgccgtccggtgatcgcctcgcgcagatcgttctcgatcacccggcggctgcgcgccacattatccatctccagcgtaaagtgctcatagcggttacggccgttacgcttggcttcatacagcgccatgtcggcgcagcgcagcatatgttccggcgtattggtggcctgcgaggtcagcgcaatgccgacgctcagcccgaccgacaggttgtggccttcaacattcaccggcgggcggatcgcctcgatcaggcgctgcgccacgatcgcggcctcatcggcattccgcacgttgggcagcacgatggcaaactcatcgccgccgatgcgcgccagcgtgtcctgatcgcgcagtacgctgcgcagccgcttcgccactacccgcagcagatcgtcaccgatctgatgccccagcgcgtcgttcacgttcttgaagttatccagatcgagacacaactagagcgctg

SEQ ID NO: 38692 - DNA, 875 bp, Glycine max
  Peptide Sequence Number=SeqID_130377
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatatggactagcaaaggatttgcaccagaaagcaaagcacttttggctgccattgtagatcagatgccctcctctggaagtcctgcatacgaaagaaatttgcatctatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 38693 - DNA, 492 bp, Glycine max
  Peptide Sequence Number=SeqID_130378
atggcttcattcgctcaagcagccaaatcgctccttctcaaggaattcgtaggcgcgttctttctttccatgcgccagttcttcgcgcccaaggcgacgttgaactacccgcatgaaaagggtccggtctctccgcgcttccgtggcgagcacgcactgcgccgttatccaaacggcgaggaacgctgcatcgcctgcaagctttgcgaagcgatctgcccggcacaggccatcaccatcgaggccggtccgcgccgcaacgactgcacgcgccgcacggagcgttacgacatcgacatggtgaagtgcatctattgcggtttctgccaggaagcatgcccggtggacgccatcgcggaaggtccgaatttcgaattcgcgaccgaaacccgcgaagaactctactacgacaaggaaaagctccttgccaatggcgaccgttgggaaagcgaaatcgcgcgcaatatcgcgatggatgccccatatcgctga

SEQ ID NO: 38694 - DNA, 333 bp, Glycine max
  Peptide Sequence Number=SeqID_130379
gcccgccgcctctggatgacacaagggtgcagaaagaccaaattttgtctctgcgtgtcatcgggcccgccgcctctggatgacaaaaagggtgcggataaccgtaagggtcagtatgacaaagattatggggcggtcgacaaaagcaaggctcttgctcctacgtatcctccaatgaggaactcagacctacgtgcggataaccgtaaggtgtctccgcgggctaccagctcttgggtcatggtaacagaaagcagtgtggtcgacaaaagcgaggcttttgctcctacgtatcctccaatgaggaactcagacctacgtagttctggataa

SEQ ID NO: 38695 - DNA, 195 bp, Glycine max
  Peptide Sequence Number=SeqID_130380
atgaagaaacaacaatggaagagaagcggaaggcaaaggagaagaggagagaggaggcgccatccactagggaataagccttggaagaaggagcttcaccaccaagatgagccttggataagaagcttggagaggatgcttcaatggaggaaaagaaagagggagagaaagagagaggggggagcacgaaattga

SEQ ID NO: 38696 - DNA, 573 bp, Glycine max
  Peptide Sequence Number=SeqID_130381
atgaagagccttgttgtgtcctctcccctctacgggaatctcttcttctgcaaacgcgatataattgttggtggttatatgattaacgatgccttcaaaaccctccacttagatatcgtgggctacatgggcatcattgaggacttttatcaacagcgtacgatgaggctcgtagtttatgagcagttcaagcaacgatatccttgctggggttttattcagttgctcgactaccttaaactcgctttgttggatgaggtgaaggaactcatgggcctcttccaaagtcaccgtctttccttgaagaccttctttcttttcagcccctcttaccactggaggatctacttctttcgagggggtggctacgtctgtgggctcttggaccatgggcgctttccccttggagggcaactctgtcgggtgaggggaagcgaacacccaaccactgcgggttacgccactgaggccggtgatgttgtcaccttggctgacagggagtcaacttcggttgcaattctttctccgaatgcgggaggggtatacttccacagaacggccttattgctttga

SEQ ID NO: 38697 - DNA, 376 bp, Glycine max
  Peptide Sequence Number=SeqID_130382
atgaagggccgacatggaggccatgaaagagaaaatggccacaatgatggaggccatgatgagcatgaagaagataatggaagccaatgcggcaaagatttgggaagtacggatgaccccatgatgtgcaaattcaaaacaagcacgccttcccgccatatggcttgcctcccaaactatacaccacccaatgtggcgtacattcccaatgaggatgtcaataactccacacccatactcattaagagccaacaacctcaatctgatcatgcacatgtctctcgacccatggaggagacacatggaatgccctaccacaatctagccgacttcgagccttggctcggatatgccactgaagggcaagcagttggtg

SEQ ID NO: 38698 - DNA, 447 bp, Glycine max
  Peptide Sequence Number=SeqID_130383
atgaagaacaaaaagaatggacctcaacatcggggaaaatggtactcgacccctcctaagcaatatggtaactgccccaacaatcagaggaccgttgctgtggggtttgcggctggtagtggtagcaaacccaatactttccccactcaggtcacttgttacaaatgtggtatgccaagacaaaaggggtatattcagagagattgtccatatcccaagaaggagcaaaatgatgggggcctgaatgaccaaactggacatccgaaggccacaggaagagtctttacccttaacgatgctaaagcttcaaaatcgaaagatctaatccaagtgagtaaggatatgatgtttatctctgccaaccaagttatgacatctttaaaagaagatgctcaagtgtacatgatcttgtctaacctagaaatagagacaggtttccatgtgtga

SEQ ID NO: 38699 - DNA, 264 bp, Glycine max
  Peptide Sequence Number=SeqID_130384
atggacccaaaaagtagctgcaggggaaatccaacaaattaccgtacattcattgttcttttgaactggataattgatgttcagttttcttgtatgcaaagaagatctgctgcaggtgatttgattcccatcgatttggagattaatgccacctgtagaaggtgtaattcagagagaatcataatttttttgcaggatatagaagcagcagtgatgcaatcctacccctcaagggcattggatagaagactccacgaagattga

SEQ ID NO: 38700 - DNA, 1350 bp, Glycine max
  Peptide Sequence Number=SeqID_130385
atggtaccgactattgaagagtttgaggaaatactaggatgccctcttgggggaagaaaaccgtatcttttctccgggtttcttccctccttgagcaagattgcagctgtggtcggggattcgacaaaagagttggatcgcatgaagcaaactcgcaacggcgtagtaggcctgccacggaaatacttggaaggcaaggcaagggatatggcgagccaagagaagtggggcccgtttgcggatatactagctttgttgattttttgggttgtcctctttccgaacgtggacggtttggtggacttagccgcgattgatgctttcctcgcatatcaccattgcaaggagagtccagtggtggctatattggcggatttgtttgacacctttgactggaggtgtaagaaaaacagtgcacggattgtctgttgtttacccgctctctgtgtgtggttggtttcacacctattccaacaagacacaagacacccgtgtccgcttcaaagttatcgctcatgcgccgaaaaaggaagagtcgattgggaccaacatttggctgggatagggggcagcgcaatcaattggtttcctcgatggaaggaaggcaaggagggagtccttttctcatgtggggactaccctaacgttctgttgttagggacaaggggttgcattaactataatcccgcactcgccataagacagttagggtaccccatgaggggagcgccaacagaggagagtctctcgcctctccttgtgagggatctaggcgcgcaaagtctcaaggttatacaaagagtccacaaggcgtggagaagttcgttgaggaaagacaaggagcttaggggcatccgtaatggcgtcatcggtggttatcatggatggctaagagttcacacgcgagggttagattggttctccaagtttaaagttatcgatgaggagaacttcgaagctccggaggaagacgaagaagtccgagctctaaaattagagctagggaaggcaagactcgccaaggagaagttcaaatcagccactacacacatccggaaagagtgcaccgagttacaagaggaaaacacggccactgcaagagcccttgaacaagaaaccaaaagggcccgcaaggaggaacatggccgagagaaattccgaggagcattgtggggtagcaacaatgagctcaagctccgaagagaggaaagagaccggtcacgggtgcatggcatgatcttaaaagaagagttagctgcttgcgcaaggtccaagaggagtttggctcaacacttggaagccacggagcaaagcatgctagctatcatagggcagtacaaggaagagtga

SEQ ID NO: 38701 - DNA, 1035 bp, Glycine max
  Peptide Sequence Number=SeqID_130386
atggctacctcaccaaaagaaacttcagctcctggttcaccctctgtaccatcatctccgcaccaggaacaaccagaattcaacatccaacccatacaaataattcctggtcaagctcctgtccctgagaaactggttcccagaagacaacagggagtgaagattgctgaaaaccctagccttgcaacaagacctagggaagtagacacggagatggacaagaaaatccgcagtattgtgagttgcattttgaaagacgcctctgttcctgaagctgatgaagatgttccaacatcttccaccccgaatgtttctgtgcctgatgttgataaagatgttccaacatcttccgctccaaatgctgaagtactctcttcccccagcaaagagagatcaacagaggaagatgatcaagccacagaggagactcctgcaccacgggcaccagaacctgctccaggtgacctcattgacctagaagaggtagaatctgacgaggaacccattgccaacaaattggcacctggcattgcagaacgattacaaagccgaaaaggaaaaacccccattaagaggtcaggacgaatcaagactatggcacagaagaagagcactccaatcactccgaccacatccagacggagcaaagttgcaatcccttctaagaagaggaaagaaatttcttcatctgattctgatgatgatgtcgaactagatgtctcgacatcaaagagggccaagaaatctgggaaaaaggtgcctgaaaatgtccctgatgcaccattggacaacatctcattccactccattggcaatgctgaaaggtggaaatacgtgtatcaacgcagacttgccttggaaagagaactgggaaggaatgccttggattgcaaggagaccatggaactcatcaaggctgttggactactgaaaacagtcaccaagttgggagactgttatgaaagcctagtcagggaatttattgtcaacattccctctgacataacaacagaaagagtgatgagtatcaaaaag

SEQ ID NO: 38702 - DNA, 366 bp, Glycine max
  Peptide Sequence Number=SeqID_130387
atgatgcatgcacctgacctcaactctcagatgcaatgcggtacgtaccgtatccaataccaaggaaatagccctaagcgtgtctacatgacacctcacttaggaaaccatgcagtatttgtcgaggccacccagtcgtgcatcgtaactccccccctaggtgatcaacttggggccacaaggagttccctaccaggtgacacaccccctagtacaaagtacatactgccacagtttatactatttcccgtgtcatataagtttcccacacaagagacgtctgacaaggtcaatgcaccccccaatggacatacacaacatacgatgtacaaagtgggcaccatcaagtacaatggccatggatga

SEQ ID NO: 38703 - DNA, 360 bp, Glycine max
  Peptide Sequence Number=SeqID_130388
atgtctccctatagtagtcatgactcttgtaagagactaagtgaagaacttcatgactattatgaaggaagccataggtcacatcttagacctcactcccaaaggagaaaaaaggaaagaaagcctcaagaggctaacattaacctcccatacttccataggaaggacaatgtagaggcttacttagattgggaaataagggtagagcaacaacttaaaaggaaaggacacattacttctcaatgccccaccaagaaaaccatgattatgaggggccaagacatttatagtagccaagatgaaggaatctacccccaagaagaaggacaacctttaatggttaaggaggagtgtaaagag

SEQ ID NO: 38704 - DNA, 180 bp, Glycine max
  Peptide Sequence Number=SeqID_130389
atgcaggctcaaggttcaatcaatcaaacatccattcagctcaaaatgggtgcaagggataaatcattcatgcacacggagggatgggcttatcctcctctggcacaggctcttaggctgcagaggcctcaccccctcccgaaggagaaagctggactcctggccaagccacttggctaa

SEQ ID NO: 38705 - DNA, 204 bp, Glycine max
  Peptide Sequence Number=SeqID_130390
atgaagaaacaacaatggaggaaaaggataagaggtgagaggaggggtcatccactagggaataagccatggaaggaggagcttcaccaccaagagagtaccttggataagaagcttagaggggaagctacaatggaggaaaagaatgacagagagaaggaagggagcacaaaattgaaggagaaaaaaggggagagaagttga

SEQ ID NO: 38706 - DNA, 123 bp, Glycine max
  Peptide Sequence Number=SeqID_130391
gactcattagatgaggatgagaatattgatgaaatatctgacacagataatgaagctgcctgtttgatcgaaccacttacagttgtgcaatcgggagaaggtggaagtcagactccattctag

SEQ ID NO: 38707 - DNA, 399 bp, Glycine max
  Peptide Sequence Number=SeqID_130392
atggcaggaatgagaaagttggatcatctagaggaaaggctcagggccattgaaggaggtgaagattatgcctttgctaacctagaagagttgttcctaatacccaaacgtggtcattcccaagttcaaggtgccggactttggcaagtacaaggggactactcgctccaagaaccatctaaagatgacctaatggttgccttcattaagcagtatcagtacaattctgatatggttccggataggatgcagctacagaacatgtgcaaaaagggggatggatcattcaaagaacacgcccaaaaggtggagggatctggcggcccaggtggtacccccaataatggaaagggagacgataatcgtgatggtagacacattatcggtactctactatga

SEQ ID NO: 38708 - DNA, 435 bp, Glycine max
  Peptide Sequence Number=SeqID_130393
atggctgaaagaggaggagaaggaaatagaccaccgaggaggactttgggtgactatgcttatcaacaaggcccaaaacattacaacatcatagcaattcctcctttcagcaataaagtcgtggaattaaagccagcactgcttagtccaattggctcacatccctttgctggaatggatcatgaggatccatacacacatgtgtctagcttcatggaattatgcagtactatgggagcttctgacgaagatgttaaagctatctacctcagagcttttccattttcattaacagctggaggcactatgatgtccaagtgtccagaggaagctaatgtaatcattgactccagagtagccactgatgatcaaagtcatcatgatagagctccaacacaaagaaaaggtataatggagctgggacactcaaagtga

SEQ ID NO: 38709 - DNA, 525 bp, Glycine max
  Peptide Sequence Number=SeqID_130394
ggcgccgagcccgggcgaagcgtcgtcgtgcagatcttggtggtagtagcaaatattcaaatgagaactttgaaggccgaagagaggaaaggtttccatggaatcgggttaaaattcctgaaccgggacgtggcggctgacggcaacgttagggagtccggagacgtcggcgggggccccggaaagagttatcttttctgtttaacagcctgcccaccctggaaacggctcagccggaggaccgagtgcctcccacgcccggtcgtactcataaccgcatcaggtctccaagtcccgaacccgtcggctgtcggtggactgctcgagctgctccgcggcgagagcgggtcgtcgcgtgccggtcggggacggatgggaacggcccttcggggcctcttcccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 38710 - DNA, 318 bp, Glycine max
  Peptide Sequence Number=SeqID_130395
atggtgagcaaagtttggagctttaatgggcaacaatggtggatgagaaggggagaagaaaagcaacgtgagaagctatgccacatgtctccttttgagtggagcaaaaaggggcccactttttctcttgatgtgactcatactcagccacaaggagagaaaaatttgacttttgaaatgctaaaatcatgcctcggtttgtgtgccatttctctggttccagtccctcgcgtttctctgcacccttcggggcccgttttcgaaagtaagcaatatatatatcaaaacgctcagaatgaaaccccgagcgtgttttag

SEQ ID NO: 38711 - DNA, 324 bp, Glycine max
  Peptide Sequence Number=SeqID_130396
atggctcaacctccacctcgtgagaggactctaagggaaatgactgcacctgatttcccttatgaaagcttgtgcattcaatatcctgatgaggatgtcccatacgttcttaaaactggactgatacacttgttgcccaagtttcatggtcttgcaggtgaagaccctcatcaacatctgaaagaattctatattgcctgctccaccatgaaacctccagatgtccaagaagatcacatctttctgaaggcctttcctcattccttggagggagtggcaaaggactggctatattaccttgctccaaggtccatcacgagctag

SEQ ID NO: 38712 - DNA, 426 bp, Glycine max
  Peptide Sequence Number=SeqID_130397
atggagttcaacgggggtgggggtcacaacccactctttgaggattcacctagtgagtgtggtggtggggccgccactgttggttttccaacggtcatatttctaacggtcatattttgttgttacaaaatgcctatatatatctcttccctcctttctagaaatgacagactgagagctctggtttctttctgccaacaatttatctctttcttttcctatacaaaacttaatttttgtgagagcaagagcattggtgttcataaggttcggggatcctttcgctgcacacgatcggaaccaacgggttgtcgtatcttgggagaggagcgcaatcagaatttcttacccgtgcagtgggggcgttttctctctaaggatagcgtttacgcgctccaacccaggctatttaattctttcccttaa

SEQ ID NO: 38713 - DNA, 411 bp, Glycine max
  Peptide Sequence Number=SeqID_130398
atgttgagtcagcatcccaatatgttaaactacactgactctgtgatgaagagagaatctcctctatccctgcattacaaactgtttgaagggacacatgtcccagacattgtctcgacatctgtctcgacatcagggaaagctgctgcttcaggtgctgtgtccaaggatgctctgattgctgaactcaaggacacatgcaaggtgctggaagcaaccatcaaagccaccacagagaagaagatggagctagaactgctgatcaaaaggctctcagagagtggcattgatgatgaagaagcagctgaggaagaaggagaagcagctgaagaagaagaagaagctgctgaggaagaggaagatgcagcagaagagacagaatccgatgatgattctgaagccaccccatga

SEQ ID NO: 38714 - DNA, 231 bp, Glycine max
  Peptide Sequence Number=SeqID_130399
atgggtgccaagtacctcgaagcggtcaaccaaaggttgcatgccatcaaacagtgctccccggatgaaattagggcaatcaattcgtggggctccagactcgatggtggaggatgcatgaatgacaatcaattcatggggctccgaataagatttgatggtggaggatgcacgaacaacgctaggcaatcaattcgtggggctccggacttgatggtggaggatgcatga

SEQ ID NO: 38715 - DNA, 559 bp, Glycine max
  Peptide Sequence Number=SeqID_130400
tcaaggtgcaccttttgagggcaccattattgatgactggaaatttgattattcgagtcatgatgctcgtcgtatggtctgcaatgatcaagctgaaatgaccgcacaagcctcagaggaggatttgattcttatgtgggattttcttaccggttgtcagatcaactgggcccatttggttcggtaccgaatgcataaggcattacgggccaatgcacctctcccttatccacatttgattactctgtttctgcgtcattttcaaattccgcttgatgatgaaccatttgttcaagtcaagcgttcctttgcaattggtgctggtgcagatgcactccctcctcaagatgaacatactccttcacctcctcctcagcgcgatgattcagcactcatgaatgaagtcctctccgaattacggggtcttcattcttatgttggtgaccgtttcaactcattagatacacgctttgccggcatggacattcgcctcacacagcttgaagaggatgtaggttacattcatcagagtttcgatcttccacctccaccttcttag

SEQ ID NO: 38716 - DNA, 169 bp, Glycine max
  Peptide Sequence Number=SeqID_130401
atggagattcttgagaatcgaaggtggatgtatcagaggttggatgataataaacgttggacaaatgagtttagagaaggagtgtttgaatttgtacaatttgttactagtcaggacatgtttcaaatgcaaggagaacaaacaaggtgtccctgcaaccaaggcaaat

SEQ ID NO: 38717 - DNA, 249 bp, Glycine max
  Peptide Sequence Number=SeqID_130402
atggcagacagaggtagaggtagtggtcgtagaacatttaattatggtacaagacatgactccaaacacacttcctacagctcaagaccaaccaaatcctttgtaagggagtcaattcctactacccctgttagagatgcttcaccttcagcaccagatgattcttttacacctgagtacccaacaaatccaaattatgaacatattgttgatgaaagacctttcattcgtgcatataaaggagagtaa

SEQ ID NO: 38718 - DNA, 474 bp, Glycine max
  Peptide Sequence Number=SeqID_130403
atggagaaaactaagaaattgaagttgggagaatgggtcaatgacaagtcccgtgaacttgctgggaacgtgtacgacctaggtactttgagcaaaaggtttagttgctcaaaatcagttccatctacttctattgctcatgtgaaagaccaaatagaggaaatgcgtgagacaattaataaattgaatgctgagcttttgacaaaggcaaataaggagaagacacttgaggaaaagatgttgcagatgatggagaatcatgaccaccaaagtcaggagatgcgacaaccgatgcaacaaaaaaatgagcaaattcgtcaacaaaatgagcgaatgcaacgtatactacaacacttgcatattcagcctatcataccagctcctagtttatcacctaccatagcagatggaacagaccaccatgttaatgatactcaggttgatcgtcctcatgacatggaaaatgatcattga

SEQ ID NO: 38719 - DNA, 171 bp, Glycine max
  Peptide Sequence Number=SeqID_130404
atgttgttaccaccggtgctgcctctgattccccatctgacaggaatcaagcacacatactgtgagcatggggaatcggagtatggcacatgtgttaggagaaggtcaagtgaagctagagttatcttcaaggaattttattattttagatggcgtctatcatatttctga

SEQ ID NO: 38720 - DNA, 360 bp, Glycine max
  Peptide Sequence Number=SeqID_130405
atgttgcccacgggcgaggatggggaaggtgtagatgtaggtactagggatggtccacgtgcatcaacagaggatggagatggtgtggatgcagtcgaaggtggagatgttgtaggtgcaacatcgggaggcctaactgggatagacacagaagacggggatggggtagatgatgtcagactatctcgaggtggtaatagtctaaccattcatgtgacgggtgtcgtaacctatccttcggcgagagggcgacgcgagactcacgggtgcatcttccaaggaaggaaaacgcgtggagtcgccaccaacgtttatttgaggaaaacgttagaaaaaccaaagaaggtctacggattttaa

SEQ ID NO: 38721 - DNA, 110 bp, Glycine max
  Peptide Sequence Number=SeqID_130406
atggcaatggaatggagaaggaagaaagatgattggagattccacttcatggagaagatgagtcaagaacaagctcaaccccataggaagccatggataagagcttcaag

SEQ ID NO: 38722 - DNA, 138 bp, Glycine max
  Peptide Sequence Number=SeqID_130407
atggaagagaagagatgcagcggaaggcaaaggagaagaggcgaggggaggcaccatccactagggaataagccaaggaagaaggagcttcaccaccaagaattgccttggataagaagcttgaagaggatgctttaa

SEQ ID NO: 38723 - DNA, 213 bp, Glycine max
  Peptide Sequence Number=SeqID_130408
atgaccaaattttgtctctgcgtgtcatcggggccgccgcctccggatgacaaaagggtgcggataaccgtaagctatctccgcgtgtcatcgggcccgccgcctctggatgacaaaaagggtgcggataaccgtaagggtgcggataaccgtaagggtgcggataaccgtaaggtatctctgcgtgtcatcgggcccgccgcctctggatga

SEQ ID NO: 38724 - DNA, 285 bp, Glycine max
  Peptide Sequence Number=SeqID_130409
gtggttgtcatcgtcaaaaagggggagaatgttttgatgatatcaaaaagaatttgcttgacaaagggggagaatgtgaatcgtgcaagctttgataatgtcgagaagaaatcacatgtttgtcatcatcaaaaagggggagaatgtgaatccttgtttcaagattcactaaagaccaagctttgccttaaaacaaagtgctttcaagacatgcaaggctctggtaatcgattaccaggaagtgtaatcgattaccagaagacagggttgagaaatagctgttga

SEQ ID NO: 38725 - DNA, 473 bp, Glycine max
  Peptide Sequence Number=SeqID_130410
caccagatgcaggacaccatggtttgaaggctgatcctagtggtttctattccactaagtcagaatataggctattgatgactttcaacagacctattcctcaaaggaggattttgcagactattgaagcatgcaatgcacacaaaaaattctctatagagactaaatggggcactatgatgggcagctatccttttttagaagaacaaccaattccgcttacagggagaagtcatgtctatagctttggagtggtgctgctagaactactaacagggagaaggccagtggggaattttggggaagaaggtatagacattgttcaatgtaccaagttgcaaacaaattggagcaatgacaaggtggtgaagattcttgatgagaggctatgtcacattcccttagatgaagcaaagcaggaacaaagtgtggagagaccaaccatgagggaagtggttgaaatgcttgcataa

SEQ ID NO: 38726 - DNA, 475 bp, Glycine max
  Peptide Sequence Number=SeqID_130411
atggctccgagaaagctttccacgaaaagatctaggagggacgccgcggctgaagggaccagtgccacccccgagtttgatagccactgtttcaggagcgccgagcaccagcagcgttgcaaggccatcaaaggatggtcgttccaccgagagagacgcgtccaactcagggacaatgagtataccgactttcaggaagagatagctcgccggcgctggacgtcgctggtcactctcatggctaagtttgacccagatatagtcctagaattttatgctaatgctttgcccacagaagagggagtgcgggacatgcgatcatgggtaaggggtcagtggatttcctttgatgcagatgccctcagccaattcctgggtgacccgctggtgttagaagaaggccaggagtgtgagtttagtcagagaaggaacatggccgacgggtttgatgaagaggccattgcccatctattat

SEQ ID NO: 38727 - DNA, 171 bp, Glycine max
  Peptide Sequence Number=SeqID_130412
atggggaccatcaagggggatgagcttgccacccagctcgcccaggcgagctcagctcgccccggcgagctaggttgcttcctccagaagcaaccgccttctggaggaacatcctggaaggcccaaaacttcacgtattgtgcaacaaagggtgccaagtacctcgaagcg

SEQ ID NO: 38728 - DNA, 687 bp, Glycine max
  Peptide Sequence Number=SeqID_130413
atggctaagtttgaccctgagatagtcctggagttttatgctaacgcttggcccacaaaagagggagtgcgagacatgcgatcatgggtgagggtgttggaggaaggccaggagtgtgagtttagtcagaggaggaatagggccaatgggttcgacgaggaggccattgcccagctattatgcacaccggggcaggattttacccgaaccgctgcagggaggcgggtgtggatcatgcacaccagcatgaccaccttgacccagatctggatgacattgatgcttagcaatgtcttccctagtgatcataactccgaccttcctctgccgaagtgtcagctggtgtacgccatccagacacggatgagcgaccatgtggctcagttgattgctgacgccatctatttatttgtaggtatgccacccaccaggcaccctctagacccgaataagtctaacagggccctggggtttccggcattgatcacgggcctctgccagttattcggggttcccgtcactcctagtaaggtgatccgaccgtcgatcacccgggccttcattgagaagtattgcacgcctaggcaggcacagggtgatgcacctcaggccgtagacgcatcgccaccacctcatcaggctgatcccgctgggtcattaggcatggagcgttatctacagcacttg

SEQ ID NO: 38729 - DNA, 388 bp, Glycine max
  Peptide Sequence Number=SeqID_130414
atggatgttatggactggtgtgaggattttgcacaagtgcagaaaaatgctatgtatttactgggtgtggaaagagcagtgcagagtgagttctggatgtttgcttgtagatcccaacggtcaaaatgtaggcttatgcactatagacttccaagttctctgccttgctctgttttgcttggctgtgatagcttgtgctgtttgtatgttgttttgcttggatgttgtggaagcttgggaggattgatggaggcccggggatggtgggtttatgcgcgcattgtggatgtggaaaacttgttgtgcaccatcgcccgaccgccacctagtaccacatgtgatgggtaccccataatcctacaagcttgcgatgaggaagtgttgaagg

SEQ ID NO: 38730 - DNA, 524 bp, Glycine max
  Peptide Sequence Number=SeqID_130415
atggctgtgatatctcccgagaagatctaccaacctcctttcccaaagtggtataaccctgatgcaacttgcgcataccatgggaaaaccttgggccactttatcgaaaaatgcttggcccttaaatacaaggtccaacatttgacagatgtcggatggctgacgtttgaagaggatcggcctaatgtgaaacaaacccgctcgccaatcatggagggggagcagttaatgccgtcgagtcgggtatgcacctccaagcgaaaggaagaggccaccgacatcagctcgttgtcaaccaaggtaaccaatatcacggggctaagcggcgtgacccacagcggtcgcatgtttgcaccccccgacctgccgacacaacccgcaaacgttaaagggaaggcaaagatggtggaagaacaaaatgacaagacgaccctcactccgaacgaggatattccagtgacaaatcttccagagaaaagggatggttgtggcaagaaagaagtatcgctagaggaggcaggcga

SEQ ID NO: 38731 - DNA, 258 bp, Glycine max
  Peptide Sequence Number=SeqID_130416
atggactcatctgaagattcagaaaatgaagttgtaaacctgagtctgatggccaagaattatgaaagcgatgaagaggattccttgaagaagagttggtacatagataagggatgctctaaacatatgacgggagatgcatcgaaattcactcatatttctcccaagaaaaacgaacatgtgacttatgacgacaacaataaaggtagaattcttggagttggaaaaaataggtacgaattcatctacctccattaa

SEQ ID NO: 38732 - DNA, 327 bp, Glycine max
  Peptide Sequence Number=SeqID_130417
atggcaatagggactatcagtgaccatgcatcaccagaagaggaaaactctagacgagggaccatgcttcactgttatcaatggagttgccatctgccacaacctacctcacaacgggacggtgaaagcgaaatagataagccaaagcattcatctcctagggagaaaacgagcggagtcgccaccaatgttcattcgacgaaaatgttagaaaaaccaaaaagaggtctgcaaattttgaaaataagggtttggaagttgtttacgcatggggaaggggttgacaagggtgttgcccttgctcctatgtatcctcaagtgcgataa

SEQ ID NO: 38733 - DNA, 468 bp, Glycine max
  Peptide Sequence Number=SeqID_130418
atgatacgcggagataccttacggttatccgcacccttgtgtcatccagaggcggcgggcccgatgatacgcggaaataccttacggttacccgcacccttgtgtcatccagaggcagcgggcccgatgatatgcggagataccttacggttatccgcacccttgtgtcatccagaggcggcgggcccgatgatacgcggagataccttacggttatccgcacccttttgtcatccagaggcggcgggcccgatgacaagcagagacaaaatttggtcattctgcacccttgtgtcatccagaggcggcgggcccgatgatacgcggagataccttacggttatccgcacccttgtgtcatccagaggcggcgggcccgatgatacgcggaaatacccgagtggttatccgtataaacattcttttgctatctgtaagacagaacgcttgatagcatgcagaggctga

SEQ ID NO: 38734 - DNA, 435 bp, Glycine max
  Peptide Sequence Number=SeqID_130419
atggaatggagaaggaagagagagaggagacgccatttcaacgagaagatgagtctagaagaagctcaccaccatatgaggccatggataagagattggagaaagaaggagatgaatgatgggagagggaaagatatgaaatctgaatttctctccgggttccttgttgaaccaattatcagacttatcaaggtaatccttgtggcgtctacccggacttatcttccttcaccggaagtggcgtctatcccgacttatcttccttcaccggaagtggcgtctaacctgacttatcttccttcaccggaagtggtgtctatcctgacttatcttccttcactggaagtggcgtcatccaaaacctccgtagcctgtatcaaacgatccgctcctactcaggttcgcatcatctggtatcagagctttggctcttga

SEQ ID NO: 38735 - DNA, 111 bp, Glycine max
  Peptide Sequence Number=SeqID_130420
atgacccgctccaccaagtgtaagaaaaattttgggcttccaagacttaacaaaattttacaaaaggtgttgaggaaaaaagccaagagtttcaagaacctcgggatttga

SEQ ID NO: 38736 - DNA, 2235 bp, Glycine max
  Peptide Sequence Number=SeqID_130421
atggcggattacagccagccgggcgacttaatggtggtctctgccgcaggcagcaccactaaccagctgatcagctggctcaagctgagccagagcgatcgcttatcggcccatcaggtgcaacaggcgttacgccgttttcacagcgaactgatcgctgcactgctgcctgctgaatatgcagaaaccctgaccgcagccttcatccgcgatcttgaacgcctggcggcgctgctcgacggcgccatcaccgatgcggtgtacgccgaagtggttggccacggcgaaatctggtcggcgcgcctgatggcggcggtgctcagccagcgcgatatcgaagcggcgtggctggacgcacgcgacttcctgcgtgccgaacgtgcggcacagccgcaggtagatgaaggcaaatcctggccgctgctgcaggcgctgctggcgcagcatccgcataagcgtctggtggtgacgggttttatcagccgcagcgaagcgggcgaaaccgtactgctcggccgtaacggctctgactactcggcaacgcagattggcgcgctggcgggcgtgaaccgcgtcaccatctggagcgacgtggctggcgtttacagcgcggacccgcgcaagccggtctccaacagcgacatcgatttacagctgcgctgcagctatcagccggagcagggctcaacgcgcattgagcgcgtgctggcgtccggcaccggcgcgcgcattgtcaccagtcacgacgatgtctgcctggttgagattcagattcccgatagccacgattttgctacccagcagaaagagatcgatctgctgctgaagcgcgcgcagctgcgtccgctggcgatgggtatccatccggatcgtcgcctgctgcagctgtgttacacctcggaagtggtcaacagcgcctttaacctgctgcaggacgcggcgctgcccggtcatctgcagctgcgcgacggtctggcgctggtggcgctggtcggtgctggcgtaacgcgtaatccgctgcacagccatcgcttctggcagcagatcaaagaccagccggtcgaattcgtctggcagtcagaagatcacatcagcctggtggcggtgctgcgcgtcggaccgacccagcacctgattcagggactgcaccagtcgctgttccgcgccgagaagcgcatcggcctgattctgttcggcaaaggcaatatcggctcacgctggctggagctgttcgcgcgcgagcaggagacgctgtcggcgcgtaccgggttcgagtttgtgctggcgggcgtggcggacagtagccgcagcctgctgagctatgacggtctcgacgccagtcgggcgctggccttctttgatgatgaagccgaagcgcgcgacgaagagtcgctgttcctgtggatgcgcgcgcacccgtttgacgatctggtggtgctggacgtcaccgccagtgattcgctggcgcagcagtatcacgattttgccagccacggcttccacgtcatcagcgccaataaagtggccggcgctgccagcggccagagctggcgtcaggtacgcgatgccttcgccaaaactggtcgccactggctgtataacgcgaccgtgggtgccggattgccggtcaatcacacggtgcgcgacctgcgcgaaagcggcgacagcattctggcgatcagcggtatcttctccggcacgctgtcgtggctgttcctgcagtttgacggcacggtgccgttcagcgagctggtcgatcaggcgtggcagcagggcttaaccgagcccgacccgcgcgtcgatctctccggtcaggacgtgatgcgcaaactggtgattctggcgcgcgaagccggttacgacatcgaaccggatcaggtgcgggttgaatcgctggtgccgtcacagtgcgaaggcgaatccattgaccacttctttgaaaacgccgacgagctgaacgagcagatgctgcagcgcttcgaagccgcacaggagatgggtctggtgctgcgctacgtagcgcgtttcgatgccaacggtaaagcgcgcgtcggcgtggaagcggtgcgtccggagcatccgctggcggcgctgctgccgtgtgataacgtgtttgctattgaaagccgctggtatcgcgacaatccgctggtgatccgcgggccgggcgccggccgggatgtcaccgccggtgcgctacagtctgatatcaatcgtctcgcccaactgctgtaa

SEQ ID NO: 38737 - DNA, 318 bp, Glycine max
  Peptide Sequence Number=SeqID_130422
atggctgaatggaacggcgaatatatcagcccttacgctgaacacggtaagaagagcgagcaggttaagaagattacagtttctatcccgctgaaagtgctgaagattttaacggatgagcgtacccgccgtcaggtgaacaatctgcgtcacgccaccaacagcgaactgctgtgcgaagcctttttgcatgccttcaccgggcaaccgctgccgaatgatgttgatctgcgtaaagaacgcagcgacgagattccggaagaagcaaaacagattatgcgtgagatgggcatcgatcccgacagctgggaatactga

SEQ ID NO: 38738 - DNA, 684 bp, Glycine max
  Peptide Sequence Number=SeqID_130423
atgcccgttgttcaggttgccctgcccgttccgctgcctcgcctgtttgactacctgctgcccgccgatgcgccgcagccggtggccggcgcgcgcgtgagcgtaccgttcggcaaccggaaaatgacgggcatcgtggttagcacgcgcgccaccagcgatctcccccttgcccagctgaagcagattgatgcgttgctcgacgaccgctcgctgttctcacccgcgctgtggcgcatcctcaactgggccgccggctactatcactctccgctcggcgaagtgctcagccatgcgctgccggtgctgctgcgtcagggcaagccggcccaggaagcgccgctgtggcagtgggtagtgaacgaagccgggcgcgaagtggcgctggaaagcctgaagcgcgcgccgaaacagcagcaggcgctggcggcgttgcgtcagcggccactgtatcggcatcagatcggcgagcaggattttaccgatgccgcgctgcaggcgctgcgtgccaaaggcctgtgcgacctgcgcgaacatgcgccacagcagcacgactggcgcgccagtttcgcggtgaaaggtctatctcagcgtgctggagaatgtgctggcgcgcggcaaacaggcgctggtgctggtgccggaaattggcctgacgccgcaaaccatcgcccgtttccgtga

SEQ ID NO: 38739 - DNA, 363 bp, Glycine max
  Peptide Sequence Number=SeqID_130424
atgaaagaacaagaaaaagccgagattaaacgtctcagcgaccagctggacgcgctgaatcgcaaagaaccgcagctgctggaagcgggcgatgccgaaaagcttggcgcgctgctgaaagagaaagagacgctggtgcaggaaattgagcgtctgcgcaacgtgcgcgaagagaagctgagcaaagaagcccagcagctgaaaaagctgccgttcagccgtgaaatcaccaaaaaagagcaggcgaacatgggcgcgctgaagaaaagcgtgcgcggcctggtggtggtacacccgatgaccgcgctgggacgcgagatggggctgaaggtgatgaccggctacgcgaagcagccgttctga

SEQ ID NO: 38740 - DNA, 345 bp, Glycine max
  Peptide Sequence Number=SeqID_130425
atgcccacctttgccgccggccacagcctgctggcagagatccgtcttacctggccggagctggacgtcctgatctgtaccagcgatgaagtggcgtgcggcgccatcatggcctgtcacgcagccggcgtctcggtgcccagccagctggcgattgccagcatcggcggtggcccgctggcggcggtatgttcgccgccgctgaccagcattgtgttgccgtacgaggatatggggcgcatggccggtaaacgcctgctggcggcgctcaacggcgacgaaccgcctgccatcaatgagttgccggtgcagcttaagctgcgcgccagtacgcacaaggtgtag

SEQ ID NO: 38741 - DNA, 168 bp, Glycine max
  Peptide Sequence Number=SeqID_130426
atggcatcttcctcgtctgcaaatgaacttgcccaacttcactctactccagaaaaagatgatgacaaaaatttaaagatagcagcatatccttcttccattcccttcaagagcaatttccaacaaaaaaatggaagaggcaaagaaggagatcttggaaacatttag

SEQ ID NO: 38742 - DNA, 177 bp, Glycine max
  Peptide Sequence Number=SeqID_130427
atgggtacaccttatggaactcacagtccaagatgcaacactggcccaaaacaagctattggcccgatagatagaggccctgacggagaccctcaacaagctccctcaacaactataagtgataagtccctctcactcttcagtcatgcaaatagggggatgccacatctacggtga

SEQ ID NO: 38743 - DNA, 673 bp, Glycine max
  Peptide Sequence Number=SeqID_130428
atggccccgaagcccgtctccggggccatctttttgcatcgtcgcgacagcactgaaccgtgcacatgccgtggaccatacgttcacggatggtggacgggcctgtccggcacagtggtcttcattctgatgaaccactgcaaggactcttcgatgcgccctgtacccaccctgctcgccctctccctgctcgccgccggcgcctcgttcgccactgccgcccacgccgcagaaggcgacgaccgcttcgccctgcgcctgggtgcgatgaacatcgactcggacaataccctccgcggcaagaccaacgtggccggccaggacatcggtttctccgaggacttcaagctgggtggcaaggagtgggagccgcgcatcgacggcatgttccgcatcagcaaccgccagcgcctgctgttcaactacttcaagtacgacaaggaccgccgcgagaccctcggccaggacatttccttcggtgacggcgagctgaagtaccaggtcgccagcttggtctatgactactcggtggtcgacaccgacaccttcgacctcggcctgcagctgggtgccgagtacgccaaggtgagcaccaaggcctacgccgatctgggcaccgtctacgaaggccagttcctcaacgagaagaccgacggcgtggcgccggtggtcg

SEQ ID NO: 38744 - DNA, 134 bp, Glycine max
  Peptide Sequence Number=SeqID_130429
atgcaatcagagggactcgcactgcctcctgagcctgaggttggtccttcaactgctcgtgtcaacacaaaggagagttgtgttgatccctcaagaaacgacccatacatgagtgacttagagaaatgcgggtt

SEQ ID NO: 38745 - DNA, 599 bp, Glycine max
  Peptide Sequence Number=SeqID_130430
atgaacccgctcgccaatcatggagggggagcagttaatgccgtcgagtcgggccggctggaagtcggcgatgaggggagtgaagagcagcatacacgtatgcagtccgcagatgagagaagttttggaaggcctaagcctttggtggtatatttcaccagagactcagctcctcaaacgccccaacacccctcgatatttaaacctgttccgtttccgtaccgaaatagccacgcagttccgtggaggtatgcgcctccaagcgaaaggaaggaagaggccactaacatcagcttgttgtcagccaaggtaaccaatatcacggggctgagcggcgtgacccgcagcaatcacgtgtttgcaccccctgaccttccgacacaacccgcaaacgttaaagggaaggcaaagatggtggaagaacaaaatgacaaaacgaccctcactctgaacgaggatattccagtgaaaggtcttctggagaaaagggatggctgtggcaagaaagacgtatcgctagaggaggcaggcgagttcctccgcattattcagcaatgcgagttcaaggtcattgagcagctcaacaaaccctggccaag

SEQ ID NO: 38746 - DNA, 612 bp, Glycine max
  Peptide Sequence Number=SeqID_130431
atgactggagacaggagtcaaccatgtacaatcatcatgaaaaaggaagagctcctgatcttgaaaggaactcagtttggcaaggactattcttttgaagattatcaatgggaattagaatggcaaccttgttatcagaatgaagcagaaggattgtttaatctggatgacctgttaatgcaattcaagggtacagttgattcaatgcaacaagcatttaaaagagctgagactcagattggtaagttggtggatgaaatgattgaagttatggtcagaagagaagaagagtatgcagagattgaaacacataaagaaagtattcttcaagttaacacaatccatcatcaacttattaccaaagaagaaaaggatgaagtctccattattctagaatattcattaatgaaacacccagatatgagtgatgcctattttgaagaagaggtggagcaggagatagcattatcagcttcaaccatggtactacagttccctttggaaaaagaacttgatcatgtgacagaatgcctagcttgtgatgaagagcttgatgatccaaaagataactctgttggtcatgtggtttttgaagaattagaaaaaaaatag

SEQ ID NO: 38747 - DNA, 126 bp, Glycine max
  Peptide Sequence Number=SeqID_130432
ggacaaaagctggtaccgggccccccctcgaggtcgacggtatcgataagcttgatgaagaacatattgtagcagtagggactactagcaacaataggttttcaaagagaaaagctctagatgagg

SEQ ID NO: 38748 - DNA, 534 bp, Glycine max
  Peptide Sequence Number=SeqID_130433
atggggacaaatcaaaacggcaaaaggttttatcaagtcaaggttaaaggtctagatgtcactagcctcaaggaattaggacgattgatgggacctctccaaaggcaagccttccgcaaagtgtacgggaagattctagatttgaccgtagcggagcaagattgcagctgtgattggggattcagcaaaagagttggatcgcatgaagcaaattcggaatggaatagtgggcctgccacggaaatacttggaaggcaaggcaagggatatggcgagccaagagaagtggggccgtttgcggatattttagctttgctgatttttggggttgtcctctttccgaacgtggacggtttgatagacttagtcgccattgatgctttcctcgcatatcaccatagcaaggaaagtccagtggtagctatcttggaaaatttgttcgacacctttgaccggaggtgtgagaaaaacagtgcacggattgtctgttgtttacccgctctctgtgtgtggttgatttcacacctattctga

SEQ ID NO: 38749 - DNA, 388 bp, Glycine max
  Peptide Sequence Number=SeqID_130434
atgaaaatactaaaagagttaagaaaagaaaaacatgcctcctatagtagtcataactcttgcaagagcctaagtgaagaacttcgtgactattatgaaggaaggcatagggcacatcctagacctcactcgcattggagagaaaaggaaagaatgcctcaagaggctaacattaacctcctatacttccatgggaaggacaatgtagaggcaaacttagattgggaaataagggtagagcaacaacttaaaaggaattctacttcaaaatcttatggctctcactattatctaaagaaagacgaaggtcaaggcatcttaggggtgacaccttctaagcccaaagatgataaggggaagacaatagaaaatcaaccccttaaggcta

SEQ ID NO: 38750 - DNA, 503 bp, Glycine max
  Peptide Sequence Number=SeqID_130435
atggcgggtcaagaggaatgggccccgtttgcggatatactagctttgctgatctttggggttgtcctctttccaaacgtggacggtttggtggacctaggtgcaattgatgctttccttgcatatcaccatagcaaggagagcccggtggtagctatcttggcggacttatttgatacatttgatcgaaggtgcgagaagaacaacacacgaattgtctgctgcttacccgctctttgtgtgtggttggtttcgcacctattccaactagacataagacacccgtgtccgcttcaaagttatcgctcgtgcatcgaaaagagaagagtagattgggaccaatacttggctgggataggaggcagcacaatcaactggtttcctcgatggaaggaaggaaaagagggggttctcttctcatgtggggactacccaaacgtgtcattgatagggatgaggggttgtattaacaataatcccgcacttgccataagacagttagg

SEQ ID NO: 38751 - DNA, 108 bp, Glycine max
  Peptide Sequence Number=SeqID_130436
gtgttgaggaaaaaaattccagagtttcaagaacctcgggatttgaggtcaaatccttttcaagggggagggaatgatacaatcttatcccgcaagggcattggatag

SEQ ID NO: 38752 - DNA, 475 bp, Glycine max
  Peptide Sequence Number=SeqID_130437
acttgcactatctctggagcctgaggttggtccctcaactactcgtgtcaacacaaaggggagttgtgttgatccctcagcgattgatccagacacgggtgactcagaaaaatatgggttgtacatcgaagaaaatcttcctcgcctggaagttaaagatgcagatgctctcattcctatacccactgatgaggttattttagtggggcagacacttaacaccttccttgcttggctgacacatctcgtcaagcgtttatcagaacaagttatgtgggatgcttccctttttaagctgtttaattcagacttccccttgtacataaagcataaagatctgtctgaaatagcacacggtggtcaatgtctcagcatctttgttatacagttgtggattctatatatgattgagacaagtatgcgattggggaattctgatgtgtatggattcctcgagccacagtccatccagtga

SEQ ID NO: 38753 - DNA, 641 bp, Glycine max
  Peptide Sequence Number=SeqID_130438
aggcaagcgagcccgttgacatgcagagactaacgtcgtcttttgcacctttgtcatccagagatgacgagtccgatgacatgtggggttaccttatggttatccacaccttttgtcatccagagacggcgagtccgatgacatgcggggaggcgagcgagcccattgacacgcagagactaacgtcatcttctgcacctttgtcatccaaagacggggtaccttatggttatccgcaccttttgtcatctagagacagtgagtccgatgacatgtgggggtaccttagggcaagcgaacctgttgacatgcagagactaacgtcgtcttcagcacctttgtcatctagagacggcgagtccgatgacatgcgagtgtaccttatggttttactttcgtcatccagagacattcaagtccgacgacgtgcaagattcttctctgctaggcagggacgatcgagtttgatagcatgtggaaacgtcatggcccacttgggccttcctgagggttccaaaagaaggcggtgccttctagtggaagcaacccagctcgcctgggcgagctgggcggcaaccacctccctcttttctcctataaataagggaaggagggcagagcaaatcggttcagcccttctg

SEQ ID NO: 38754 - DNA, 792 bp, Glycine max
  Peptide Sequence Number=SeqID_130439
atgagaacggcgttgccccagttgaagttcacaccgaactccggtagccgtgtaaccggaatgggagcatctcctcccaatcttttaaaatcccacccatccggcacatctctggcggatattcttattggccgcttccacggctccattcatctcaggccggtagggcgtggaattgtgatgctggattttaaactcctcgcacatttcccccatcatcttgttattcaggttggttccgttatccgtgataatcttccttggcaaaccatatcggcagatgatctctttcttaatgaacctgaccaccacacccctcgtgacattggtgtaggaggccgcctcgacccacttggtaaaataatctatcgctacgaggatgaagcgatgaccattcgaggccttgggctcaatggccccgatgacatctatcccccacatggagaaaggccaaggggtggacatgacattcagaggatgcggtggagcattgacattgtctgtgaacgcttgacatttgtggcatttccttacatggacacaacaatcactttccatggtaagccagagtgtcatgtcgtggtttctcttatacagtatgcttccgctcatgaagaagccggccgccaaccttctcaatgtcctcttatcattgtcggcaatctctggcgggtattctttgcttacgacatatcgcttgatgtcgaaataccaaggcttaccgtcccgttcctcttctacttggcaacaatgcgcgggtttgccacgacaccaaaattcaatgtatggtag

SEQ ID NO: 38755 - DNA, 183 bp, Glycine max
  Peptide Sequence Number=SeqID_130440
atgttgtgtccgggaactccactatggtacgcacacttggcacccgggcataccacttggggtagggtggctggaggaccttcccggctcgcgtcgggggctgtattattaactggccggggagcggctggagctgtgcgttgggttggcgctctttctgctgcgggtggtccttttacttga

SEQ ID NO: 38756 - DNA, 324 bp, Glycine max
  Peptide Sequence Number=SeqID_130441
atggaaactgagaggcctttctttgatgttttgaaattaggacaaagctcttcaactcaaacgattatggctcaagaatcagctattgttcaagaacaagttgttgttcaagaagaacaacctttgaacccaacacaagaacctcttagaagatctactcgaatgcatcatgcacctgataaattaaacttaatggtgcaagatgacatgtcaaatgaggtttatcataatgatgatgaccctaagggctatgaagagcccatgagaagctcatattgcaacaaatggcaaaaagccatggaatctgaaatagaatcaatgtag

SEQ ID NO: 38757 - DNA, 731 bp, Glycine max
  misc_feature (44)..(44): n is a, c, g, or t
  Peptide Sequence Number=SeqID_130442
atggtgaaagttggaacctcttacgtgccgatcaacgtctcatnttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 38758 - DNA, 453 bp, Glycine max
  Peptide Sequence Number=SeqID_130443
cctgcccacctggaaacggctcagccggaggtagggtccagcggctggaagagcacgcaccctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgcgaaaccacagccaagggaacgggcttggcggaatcagcggggaaagaagaccctgttgagcttgactctagtccgactttcggggcactgcccctctttgtggacccaaggtcggcttcggccggtcgatccgggcggaagacattgtcag

SEQ ID NO: 38759 - DNA, 468 bp, Glycine max
  Peptide Sequence Number=SeqID_130444
atgggtgatcaagaggagacacaggaacagatgaaagtcgacatgtcggctctgaaagaacaaatggcttccatgatggaggccatgttaggaatgaggcaactcatggagaaaaacgtggtcaccgctgccgctgttagttcggctgccgaagcagacccaactctcctagctaccacgcaccatcctcccccaaacgcggtaggacgagaaaggagcacactggggcacaacagcaacccccatttgggatacaaccgggcagcttacccttatggattactgcctaattacacgccgccagtcatgcaagatgatgcaggtcatatctcttctcccatccttgaaggggagcctcctcgacaacccgacgaggtccacgaagatcatcaagagtatgcccaaagggatgtcgagttctaccccccgatcctcgtcgaggggtcggcacccaacactttgccttag

SEQ ID NO: 38760 - DNA, 147 bp, Glycine max
  Peptide Sequence Number=SeqID_130445
atggtgacccgccgaagactggagcctcaaaacatgttgacgaagacccccgaactgaggggaacgtgtcacattagaggtgaacgatcagagatgtccgataattaccacgatgaggctggtccctctttgattttagtagactaa

SEQ ID NO: 38761 - DNA, 516 bp, Glycine max
  Peptide Sequence Number=SeqID_130446
atggataggttggtggacctagcagcgatcgactcttttctcgcctatcatgaccacaaggaaagtctggttgtcgctatgctagccgacctatatgacaccttcgatcgaagatgtgagaagagcagtacgaggattgtttgctgtactccagctctttatgtatggttggtttcacacctttttcgccaagaggtgaggcatgcttgcccgctagaaagccatcgttcatgcatagagaaaggaggggcaaattgggaccaactcttagcaaacaaagaaggagcgtctgtcaactggttccctcgatggaaagaagaaacaatcgaagttcttatttcgtgcggaggatttccgaatgttcccttgatggggacgaggggttgcatcagttacaatctcgttcttgttataaggcaacttggctaccctatgagaggggcaccactagaggaggagctcgcgcctgtcatttcacgaggtttcaataagaccaacatggagacacttcagaag

SEQ ID NO: 38762 - DNA, 589 bp, Glycine max
  Peptide Sequence Number=SeqID_130447
taccctggtcttcagagcactacactcctcgccaacagagggctacacgccctcaccttaagaggactgtgtgtcctcactttcagaggactgcatgtcctcaccttcagagggctacacgccctcgccatcagaggactgcgtgtcctcaccttcagagggctacatgccctcgccatcagaggactgcatgtcctcaccttcagagggttacacgccctcgccatcagaggattgcatgtcctcaccttcgtagggctacatgccctcacctttagaggactacacgtcctcaccaacagagggctgcacgccctcaccttgagaggactacacgtccttgccaacgtagggctacacgccctcacctttagaggactacacgtcctcgccaacagagggctgcacgccctcacctttagaggactacacatcctcgccttcagaggactccatgtcctcaccttgagaggactacacgtcctcgccttgagaggactacatgtcctcaccatcagagggctgcacgtcctcacctccagaggactacacgtcctcgccttgagagggctacccgccctcgccttgg

SEQ ID NO: 38763 - DNA, 884 bp, Glycine max
  misc_feature (100)..(100): n is a, c, g, or t
  Peptide Sequence Number=SeqID_130448
atggtgaaagttggaacctcttacgtgccgatcaacgtctcattttcgccaaaagttggcccagggcttcccggtatcaacagggacaccaggatttatntattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatggaaaaaaaagtccaatggagcttacatcaagacatatggatgggtatcaacatgcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 38764 - DNA, 228 bp, Glycine max
  Peptide Sequence Number=SeqID_130449
atgtcccatgctgtcaaggacaatcgaggaaaatgggccccaaactacgaagggccttttgttgtgaagagggctttttccggaggagccctggggcaggatcatcttgagctaccttctggggtggggacaaaacatgaacagcagaaaccaaccaagatacttaggaacggatgcaactggggatggggtcacgaccgactgatcgccgccccttctctgcgctaa

SEQ ID NO: 38765 - DNA, 201 bp, Glycine max
  Peptide Sequence Number=SeqID_130450
atgaccgtgtcatacaaggattggcacgaaatgctcccattcgcattacacggttaccgaacttcagggcaggatcatcttgagctaccttctggggtggggaccaaacacggacagcagaaaccaatcaaggtacttaggaacggatgcaagtgggggtggggtcacgaccgactgatcgttgccctttctctgcgctag

SEQ ID NO: 38766 - DNA, 399 bp, Glycine max
  Peptide Sequence Number=SeqID_130451
agacggcgagtccgatgacatgcggagataccttatggttatccgatccttttgtcagctagaggcaagcgagcctgttgacacgcagagactaacgtcatcatctgcacctttgtcatccagagacggcgagcaagcgagcccgttgagacgcaagagactaccatcatcatctgcacctttgtcatccagagacgacgagtccgatgacatgcggagatatcttatggttatccgcaaattttgtcagctagaggcaagcgagcccattgacacgcagagattaacgtgccatctgcagcctttgtcatctagagacagcgagtctgatgacatgcggagataccttatggttatctgcaccttttgtcagctagaggcaagcgagcccgttgacac

SEQ ID NO: 38767 - DNA, 276 bp, Glycine max
  Peptide Sequence Number=SeqID_130452
atggatagagctagctccatccacatctgctaccccaacaccagcacctccaggcccatctacccaaggctcacagagcatagagtccatgctttaaagtctatatcaagggcagatattgatattgtagagctagcaggatggggctctacaaagacccattatgatagtggagcagtttatggagaaggtagcctggccaggagcccaaccttctcttatgagggaaggtggaggttgttcaaattcggcaagtgcatcggatcgtgcaagtag

SEQ ID NO: 38768 - DNA, 150 bp, Glycine max
  Peptide Sequence Number=SeqID_130453
atgcaagaacaaattgtaggcctaggatcttcttcatcaatggattcctttgcttcttggaaaatgaatggcaccataatggagaaggaagagagagaggagatgccacttcaaggagaagatgagtctagaagaagctcaccaccatag

SEQ ID NO: 38769 - DNA, 291 bp, Glycine max
  Peptide Sequence Number=SeqID_130454
atgctacaatgtgaagggttttcctctaagcttagatatgattttgaaattcccaacggtgagaatgttgggaattgggttgcgaacatgatactcaaattttacgacgatccaacggtgaacgggttcgaaatcgtcgtttttctgagacagcttgtaggcctaggatcttcttcatcaatggattcctttgcttcttggaagatgagtggcagcggaatggagaaggaagagagagaggagacgccacttcaaggagaagatgagtctagaaaaagctcatcaccatag

SEQ ID NO: 38770 - DNA, 417 bp, Glycine max
  Peptide Sequence Number=SeqID_130455
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatatcgaacaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 38771 - DNA, 201 bp, Glycine max
  Peptide Sequence Number=SeqID_130456
atggttaaagcacgtcaaaagggggtatggaaagcaaacgaaataaaaataaaagcacgtgaaacaaaggaaaagagggaggtggttgccgcccagctcgcccaggcgagctgggttgcttccaccagaaggcatcgccttctgttggaacaccctagaaggtgcaagtgggcctggttgctatttgcacaccccttttga

SEQ ID NO: 38772 - DNA, 852 bp, Glycine max
  Peptide Sequence Number=SeqID_130457
atgatcggccgcagcctgaccggcccgctggcccgcgcggtgaacctggccgaacggctgtccaagggccagctggaccaggagttccgtctgggtggccgtgatgagctgacccagcttggcgaggcgatggccagcgtgcggcagagcgtgcaggcggcgatcggcgcgcagctgcagatggccgaacagcatgaggcgggcgcgatccgctatcgcatggacgccagtgcgttccctggcgatttcggccgcatggtgcaggcgaccaacagcctggtcgaatcgcacgtgcaggtggaactgctgatggctgaagtgatgcagcgttacgccatcggtgacctcagccgcgacctgccggactacccgggcgagaagggcacgctgacccgcaccctggccgcggtgaagcagagcctgatggcgatcaacgcgcagatcgatgaactggcccgcgccgcgcgtgccggtgatttcagcatgcgtggcgatgccactgcgttccagttccagttcaaggcgatggtcgagcacctcaacggcatgatggccagttcgcagtccagcattgccgatgtctccgacgtgctgcgcgcgatctcgcacggcgacctgaccgcacgcatggatggcgagtacgacggtgtgttcgcccgcatgcgcgacgacgccaacaccaccactgcgcagctgactggcatcgtgcggggcatccaggtggctgccgacagcatcaacaacgcggcgcaggaactggccgccggcaacaacgacctgtcgcgccgcaccgagcagcaggccgccaatctggaagaagcggccgcatcgatggaggaactgacttccacc

SEQ ID NO: 38773 - DNA, 643 bp, Glycine max
  Peptide Sequence Number=SeqID_130458
atgtgtccaccaccacctcctaccaatgaaaattctcaaaatccaccacagtatattatgtatccaccacccccacacatgtggtatatgcatccttcatccaatgtagagccacctactagtggtagttctcaaaatccacaaatttatagtcaaccatcaactcccaccaacttaaacacgtgttataggccttctttatccaatattgtgctccctagcaatgaaattgaatcactcgtcggtgtagacggtattcaactagatgaaggagatgaaaattcaggtggaaaaaaagtcgtaccgcattctcggtcacggaagatgatccatcctctagttcaaaagtttaatgggtgctacaaacaagcagataaacataggagaagtggaagttcagagaaagatgtcttggctgatgctcatatgatttactcacaagatacagagacacccattgaagtcgaagaatatgatacgccatcaccaatgtctcgcccaattggacaaaaagcaacaaaaaggaaaagcaaagggaaagaatgtcgtaacactctcgatttatctggcatcgaaagtgtaatgaaggacaaaaatatgaacacatcaaaacttattcaattaaaggaggcacaggaaaagc

SEQ ID NO: 38774 - DNA, 739 bp, Glycine max
  Peptide Sequence Number=SeqID_130459
atggaaagaggcggccaactataccgcagcgtccggcgacggttgcggacggcgcgccgacttggggcggaaggccgcgatgacctcgggatgggtctcggcgtaggggccgccgatcagatcgatgcagtagggaatggccgcgaagatgcccgccgccagcaccgtgccgtcatcggccttcaggccttcgagggtttcgcggatcgccttgggctggcccggcaggttgacgatcagggcggcgtgcgatggccgttcgcggatgacggcgacctgccgcgacaggatcgccgtgggcacgaagcgcaggctgatctggcgcatctgttcgccgaagcccggcatttccttggtgccgaccgccagcgtggcctcgggcgtgacatcgcgccgcgccgggccggtgccgccggtggtcaggaccaggtcgcagccgcaggtgtcgaccagttcgatcagggtgtcggaaatgcgccccgcctcgtcgggaatcagccgctccacggcctgccacggcgaagccagcgccgcgcccagccattcgcgcaacgccggcaacccctggtcctggtaggcgccggccgaggcgcggtcggaaatcgacaccaggccgatgatcagttcgtcggggtggcggcgggcgatgcgggtaggggcggtcatgggcaaatgagcgtgaagtgggcggatagcgggcaaccgccgtcccggcgcaccgggaacgcggtcaatcctg

SEQ ID NO: 38775 - DNA, 216 bp, Glycine max
  Peptide Sequence Number=SeqID_130460
atggcagaaatcaaccaaggtaagacgatgaccggtcacgattggccgcgtatttttgtttcctacttacaggtacatagggacggatcgagtggggctagggtcacgaccgaccgatcgttgccccttcccagcgctaaacaagcagagaacgtcgctgcaaggcagcccaatatcctttgtggttgcagtttcttttactattgtttgttttaa

SEQ ID NO: 38776 - DNA, 54 bp, Glycine max
  Peptide Sequence Number=SeqID_130461
atggccgaccaatgggtgaccaagtccaaagccaaaggtagcaagataccttag

SEQ ID NO: 38777 - DNA, 320 bp, Glycine max
  Peptide Sequence Number=SeqID_130462
atgacagaaggcgcggaagacaatactctgagtctgacggatagtgaaagagtgtttatacggataaccacttgggtcacgatagccgaaggtggggtggtcgacaaaagtgaggcttttgctcctactctctaccaagagacgctgacatctccggaaagggtgcagatgaccacattggcctctgcttgtcaatcgaacttggggtctccgaatgatgaggtgcggataaccggaaggtgtttctgcttgctaccagactcttgggtcatgatagcaaaaggtggggtggtcgacaaaagcgatgcttttgctcctac

SEQ ID NO: 38778 - DNA, 162 bp, Glycine max
  Peptide Sequence Number=SeqID_130463
atgtcaggtggtgagaatcgtgaacgtcatgaggaagaaaggagaggaggaaatggtggtggtccaaggccaaaccgaattgaaggagtcaagcttaacattcctccctttaaaggcaaaagtgatccggaggcatatttggagtgggagctcaagatatag

SEQ ID NO: 38779 - DNA, 291 bp, Glycine max
  Peptide Sequence Number=SeqID_130464
actcatcttctccttgaagtggcgtctcctctctctcttcctttctccattccgctgccattcatcttccaagaagcaaagaaatccattgatgaagaagatcctaggcctacaagctccaatggagcttgcatcagcttttatcggttaacatggaccgttcaaaagcataaaatcaacacatcactttactgccttttgcgagaactacgtaggtctgatttcctcttcgatggaggatacgtaggagcaaaagctcccgcttttgtcgacctcgtgagatggttagag

SEQ ID NO: 38780 - DNA, 839 bp, Glycine max
  Peptide Sequence Number=SeqID_130465
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgtttagagccagcagtagcatgtgtttgactgacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 38781 - DNA, 132 bp, Glycine max
  Peptide Sequence Number=SeqID_130466
atgtgtttcgtcctttgcttcttgaagatgaatggcagcggaatggagaaagaagatgattggagacgccacttcaaggagatgagtcaagaagaagctcaccaccataggaagccatggataagagcttga

SEQ ID NO: 38782 - DNA, 240 bp, Glycine max
  Peptide Sequence Number=SeqID_130467
atgacggaagggtgtggtgaagggttttgccttgcaaaccttcccggtgatgcttttagtctatgggggaacttctttgaggcaaagaaacaaatgatggctgatgccaagtttgcggggctgcttgggtttgttggtgatttggaggggagggacgaatcaaagcgacaagggctgaatctcagtggatcgtggcagcaaggccactctgccacttacaataccccgtcgcgtatttaa

SEQ ID NO: 38783 - DNA, 414 bp, Glycine max
  Peptide Sequence Number=SeqID_130468
atggcaagaatagccaaggtagtcaaaatcttggcacaagaattggaccgagtaaagcaaaatagaaatggggtggtcaaaataccgaggaagcacttggaggagaaagcgaaggctttggcggatcaaggtgaatgggttttgttcattgacgtcttggcactattggtatttggagtcatcctttttccaaatgtggacagattagtagatctagcggcaatcgatgccttccttgcttaccaccatagtaaagaaagcccggtcgttgctgttttggccgatgcctatgacacatttgacctaagatgcgagaagagcggcgcaaggattgtctgttgcacacccgctctttatgtgtggttggtctcgcacctctttcatcatgaaagtagacctgtttgtcccctgtaa

SEQ ID NO: 38784 - DNA, 606 bp, Glycine max
  Peptide Sequence Number=SeqID_130469
atggttggtttcgcaccttttttgctaagaggtaaggcatgcttgcccgctagaaagtcaccgttcatgcacagagaaaagaggtgcaaattgggaccaactcttagcaaaacagaaggagtgtctatcaactggttccctcgatggaaagaagggaaagtcggagttcttatttcgtgcggaggatttccgaatgttcccttgacggggacgaggggttgcatcagttacaatctcgttcttgctataagacaacttggctaccctatgagaggggcaccactagaggaagagctcgcgcctgtcatttcacgaggtttcaataagaccaacatggagacacttcagaaggtccgcaaggcatgggaggtagtgcgagagaaggacaaagaacttaggggcggtaacaacgggcccatcggtggctaccgtaagtggttgagagcccacgtgcaaggtttggattggctcccaagtttgagaaacgctaaaagggaggaagttgaggcaccggaggaagacgaagaggtgcaggcccttaggacaaaactcgagcaagcccaatcagtcaaagaaaggttcaaatcgacagctcttaaaatctga

SEQ ID NO: 38785 - DNA, 449 bp, Glycine max
  Peptide Sequence Number=SeqID_130470
gactctgccagtcattcggagtccccgtcgcacctagcaaggtgattcggccgcccatcacccgagcttttattaagaagtattgcacgcagagacaggcccagggggatgctccgcaggccgcagacgtgccgccacctcatcaggctggccgagctggatcatttgatacggagcagtatttgcggcatttggttcgccagcaggcggccaaccaccgggcgcatgtacagacccatgattgtctttaccagttgagcctcagcctgcagagccagggttttacttcttttccatgccctactccggatcagttcatggcagaggttgcttggcccagagattggctggaggcaccagcagaggctcccgacgaggcagatgaggcccgcgaggacgaggagatgaccgatttacttgatttcttaggagggagcggagccacatga

SEQ ID NO: 38786 - DNA, 165 bp, Glycine max
  Peptide Sequence Number=SeqID_130471
atggttaggcttcctaatggccatacagttatgaatgataaatgttttatccaggatatgaaccagcagaagattggtacaattgagatggtggaagaactctacagactcaagatgattcctatcaagtctaagtacaagtctgattttgctgaatacctatag

SEQ ID NO: 38787 - DNA, 48 bp, Glycine max
  Peptide Sequence Number=SeqID_130472
gcttacgcgacctgtgaaattccgtaatgtggcggaaatcgaaaagag

SEQ ID NO: 38788 - DNA, 465 bp, Glycine max
  Peptide Sequence Number=SeqID_130473
atgtccatgagtacgccacgctcgaaattaaccctctctaaagggaacaaaagctggtaccgggccccccctcgaggtcgacgcccgggggatccactagttctagagcggccgccaccgcggtggagctccaattcgccctatagtgagtcgtattacaattcagtggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcaccctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtctgtatctgaacaggagggacagctga

SEQ ID NO: 38789 - DNA, 651 bp, Glycine max
  Peptide Sequence Number=SeqID_130474
atggtcattgaccaatccctattctatgacttgacccaattatctagtgaaggtgtaccatttgaaggtacactgaatgatgattggaaatttgatttctctgtgcatgatgcccgccagttggtttgcatcaaccaagcggatatgaacggaaggcttcttgccagttcattggcttttgaaagccgcatccttcattatctcattgtgcgtattttgcttccaagatcttcaaaccttgcacaagtttctgaggaagatcttattgtcatgtgggcttttcatacaggccgacaaattgattgggcacacttagtccgatatcacatgcataaggcattgcaattaaatgctccattgccatatccacacttagtcactctcttccttcaacactttaacatccctcttgatttagaaccttatgttccaatcaagagatccttcttaattggtgccgctgtgattgcatcttttggctaccgtaaagagcatgatggctctagggtaaaaaagggtgctccacccattaatgaagaaggaaacataccattaggaggggattcctctcttcttcaaagattttggacaggttcgatggtcttcaaacctttgttggcgaaaggtttgatgctttggagttacaagtag

SEQ ID NO: 38790 - DNA, 1131 bp, Glycine max
  Peptide Sequence Number=SeqID_130475
atgcccgcactgcgccagctggaagaagcctttgtcagcgcgcagaaagatccggcgtttcaggctgaatttaccgatctgctgaaaaactatgcaggccgtccaacggcgctgaccaaatgccgcaatctgaccgaaggcaccaaaaccacgctgtatctcaagcgtgaagacctgctgcacggcggcgcccataaaaccaaccaggtgctgggtcaggcgctgctcgcgaagcggatgggcaaaaccgaaatcatcgcagaaaccggcgcaggccaacatggcgtagcctctgcgctcgccagcgccctgctcggcctgaaatgccgcatctacatgggtgcgaaagacgttgagcgtcagtcgccgaacgttttccgtatgcgtttgatgggtgctgaagtgatcccggtgcacagcggctccgccacgctgaaagatgcctgtaacgaagcgctgcgcgactggtctggcagttatgagaccgcacattacatgctgggtaccgctgcgggtccgcatccgttcccgacgattgtccgcgaattccagcgtatgatcggcgaagagaccaaagcgcagatcctcgaaaaagagggtcgcctgccggatgccgttatcgcctgcgtggggggcggctctaatgctatcggcatgttcgctgattttatcgacgaaacgaacgtcggcctgattggcgtggagcctgctggccacggcatcgaaaccggcgagcacggagcgccgctgaagcatggccgcgtgggcatctactttggcatgaaagcgccgatgatgcagaccgatgaaggccagattgaagagtcgtactccatctctgccggtctggatttcccgtccgtcgggccccagcatgcattcctgaacagcaccggtcgcgcggattacgtttccattaccgatgacgaggcccttgaagcgttcaaaacgctgtgtcgcagcgaagggatcatcccggcgctggagtcttcgcatgccctggcgcacgcgctgaaaatgatgaaagaaaacccggaaaaagaacaattgctggtggtaaacctttccggtcgcggtgacaaagatatcttcaccgttcacgatattctgaaagcacgaggggaaatctga

SEQ ID NO: 38791 - DNA, 636 bp, Glycine max
  misc_feature (36)..(36): n is a, c, g, or t
  Peptide Sequence Number=SeqID_130476
ggcttcccggtatcaacagggacaccaggatttatntattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatccaatagccaggcgtggccttgcttcaaaagggacgaagctgcaacttctcaccaatcactacagagtgaacgttgcaaacactgatgggcatttttatcagtatagtgttgctcttttttatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 38792 - DNA, 1227 bp, Glycine max
  Peptide Sequence Number=SeqID_130477
atgcagggttatggcctgtcggccagccaggtgctggcggcggtgcgcgcgcagaacgtgcagttcgccgccggtgcgctgggttcggacccgtcgccggaaggccagcacttcaccgccacggtctcggccgaaggccgcttcagttcgccgcaggagttcgagaacatcatcctgcgcgccaatgctgacggttcgcgcgtgctgctgaaggacatcgcccgcgttgccttcggtgccaacaactacggcttcgacacccagtacaacggcaagccgaccggcgccttcgccatccagctgctgccgggcgccaatgccctgaacgtggccgatgcggtgcgcgccaagatggacgaactgcagcccagcttcccggccggcgtcacctggttctcgccgtacgacagcaccaccttcgtcaagatctcgatccaggaagtggtcaagacgctgttcgaggcggtgttcctggtgttcctggtgatgctgatcttcctgcagaacttccgcgccaccctgatcccgaccctggtcatcccggtggccctgctcggtaccttcctgggcatgtggatgatcggcttcacgatcaaccagctgaccctgttcgcgatggtgctggcgatcggcatcgtggtcgatgacgcgatcgtggtgatcgagaacgtcgaacgcatcatgaccgaggaaggcctggcgccgaagccggccacgcagaaggcgatgacccagatcaccggcgcggtagtggcgatcaccgtcgtgctggctgcggtgttcatcccgtccgccctgcagggcggcgccgccggtgagatctacaagcagttcgccctgaccatcgccatctcgatggcgttctcggcgttcctggccctgggcttcaccccggcgctgtgcgcgactttcctcaagccgacgcacaacgacaacccgaacatcatctaccgcaccttcaacaagtactacgacaagatcagccacacctacgtgggccacatcgcctcggcggtgcgccatgcgccgcgctggatgatcctgttcgtggtgctgaccgctctgtgcggtttcctgttcacccgcatgccgggcagcttcctgccggaagaagaccagggctatgcgctggcgatcgtgcagctgccgccgggctcgaccaaagggccagaccaacgaagtgttcgcgcagatgcgtggcatcctggaaaagcaggatggctatga

SEQ ID NO: 38793 - DNA, 315 bp, Glycine max
  Peptide Sequence Number=SeqID_130478
atgggtgaagcagaggaggtgcaagagaagatgaaggccgacatggaggccatgaaagagcaaatggccacaatgatggaggccgtgttctatgagcatgaagaagataatggaagccaatgcggttatagttgccgctactgcgctgtcgctaaggcaaagaattgggaagtacggacgaccccatgtgtgaaattcaaacgagcgccttccatcatatggcttgctcccaactatacaccacctaacaatgtggcatacactctcaatgaaaactcaataactcctactccgatactcattgagaaccaataa

SEQ ID NO: 38794 - DNA, 388 bp, Glycine max
  Peptide Sequence Number=SeqID_130479
gaatttaaaatccctgagacaggtccggggcatctggagtctgagcctcctcctcatctatcagatggaaaaacagggaaatcagagagagcaacagcttctccagataaggaatcagaaagatcagcagcttctctatttggggatttagggggagcagcagcttctctagatggggaatcgaagatgataatcaaaggtggagatgggggaactacttcaagctcaggagaagaagatggattcaccactggagattatggatcaactggcgctggttcaacccgtgcagagctttggacatccggtcctatggttgctgacagaggagctggagtggatgatgaagggatgtcatctgctctagccctttttctcgatgccatct

SEQ ID NO: 38795 - DNA, 213 bp, Glycine max
  Peptide Sequence Number=SeqID_130480
atggactcgggaaggttccaagttagtataccaggtgacagctgccccagtaagactttcttgggagaaatgtatcagcagtttctcatcttttgtgtatgccccccatcttctgacaatacatctttagatggttcttgggggcaagtagtccccttgtacttgtcaaagtccaacaccttgaacttgggaatgaccacgtttgggtactag

SEQ ID NO: 38796 - DNA, 213 bp, Glycine max
  Peptide Sequence Number=SeqID_130481
atggaagcttgcttgtggggcttctatggaggctggatctttgagcttcaatggggtcctttaatggtgattttccaccatggagatgcagcggaagacaaaggaaaggagcttggagaggatgcttcaatggaggaaaagaaagagggagagaaagagggaggggggagcacgaaattgaaggaagaaaaagggagagaagttgaactttga

SEQ ID NO: 38797 - DNA, 222 bp, Glycine max
  Peptide Sequence Number=SeqID_130482
atggcaagcgatcaggaaatacaaatgatggaaagagtgatggttggacggaatgatcgtgcaatagcggatgctctcccagccttagctcaggctatagggaatccaaataggggagaagctattggggctattgagtaccaaggggggaccgcttccaacgaaacaatcctccttctttcaatggaggatacaaccctgatggtgctcaaaattggataa

SEQ ID NO: 38798 - DNA, 300 bp, Glycine max
  Peptide Sequence Number=SeqID_130483
atggggatcgcacccacaaagacacccagtggacctgaagaagtccaacagggccctggggtttccagctctgggatcgtgcccgcaaaacactctatggacccggagaagtccaacaggggtcttggggttgccagctctaaatacgggtctctgtcagttctagggagtgcctgtcgcccccagcaaggtcatcaggcccccctaccaaccgagctttcatcaagaagtactgcgcccccaggcaggcgcagggcgaaacaccacatcagcattgggatggccggtagtgggcaatag

SEQ ID NO: 38799 - DNA, 2236 bp, Glycine max
  Peptide Sequence Number=SeqID_130484
ggtgccagagccgcggttgcatccctcaatccggaggccaaatgaagcgttttatggatgacgattttctgttgcacagcgaggtggcgcgtcgcctgtatcacgacgtggcggcgcagatgccgatctatgattaccactgccacctcaatccgcaggagattgcagaagaccggcagtttgccaacctcgggcaaatctggcttgagggcgatcactacaaatggcgcgcactgcgcgcggcgggcgtagaggaatcactgatcaccggtaacaccaccagcgattacgataaatatctcgcctgggcgcagaccgtgccaaaaacgctcggcaatccgctctatcactggacgcatctggagctgcgccggccgttcggtatcacagacacgctgtttggaccggaaaccgcaccacgcatctggcatgagtgtgcggagaagctggccacgcctgaattttccgcgcgcggtatcatgcgccagatgaacgtgcgtatggtgggcaccactgacgatccgatcgactccctgcagtaccatcgtcagatagctgaagacagcagctttgatattgaggtggcaccgagctggcgtccggaccgggtgttcaagattgaactggaaggattcaccgattacctgacccggctggaagccgccgcagatgtcagtatcgacagctttgatgcgctgcgtgtggcgttactgcgccgactggaccacttttccgcccatggctgccgtgccgccgaccacggcattgaaacgctgcgctatgctgcggtgccagccgacagcgtgctggatggcattctcgccagacgccgcagcaatgcggcgctgagcgagctggagattgcgcagttcagtaccgctgtgctggtgtggctgggcgcggaatatgcccgccgtggctgggcgatgcagttacacatcggtgcaatccgcaataacagaacgcgcatgttccgtcagctcggcccggacagcggtttcgactccatcggcgatcatcctgttgcctggccgctggcgcgcctgctggacgcgatggacacctatgaccagctgccaaaaaccattctttactgcctcaatccgcgtgacaacgaagtgctggctaccatggcgggtaactttcagggcgcagggatggcgggcaagatgcagttcggctctggctggtggttcaacgatcagcgtgacgggatgctgcggcaattagagcagctggcgcagatggggctgctcagccagttcgttggcatgctgactgattcgcggagttttctctcatatacgcggcacgaatacttccgccgcattctgtgcaatctgtttggcgagtggggtagaaaatttggcggcctaatgtctgaaccagcagaaaagagcgttatgaaaccacaagcttcagcacagcgaccctatcaggaagtgggcgagatgcttcgcaacatgatcacgcagaaacagtacgcaattggcgagcggttgccgccggagcgtgaactggcgatgctgctaaacgtcacgcgcacgctggtgcgtgaggcgctgattatgctggagctggaagggttgattgaagtgcggcgtggcgcaggcatttatgtgatcaacgacacgccggcaccgcgtgccgctgcgcaaaccgcctgcaatgcggccggtccgtttgagatgctgcaggcccgccagctgctggagagtaatatcgccgaattcgctgcgttacaggcgacgcgcgaagacattatcaaaatgcgtcaggcgctggcgctggaagagagtgagctggcgtcaggcgcggtaaacgacagtgaaaacggcgatcgtaatttccatctggcgattgccgaagccacgcataacagcatgctggtggagctgttcaaacaatcctggcagtggcgcgaagacaacgtgatgtggagccagctgcaccggcatctgatcaacaccaactaccgcaaaaagtggctcgacgatcataaaaagatcctcgccgccttaatcaagaaagacgcgcgcgccgcgaaacaggcgatgtggcagcacctggaaaacgtcaagcagctgctgctggagttctccgatgtggacgacatcgatttcgacggctatctgtttgagtcatggccgctgcaagacgccagaaggccgcaaatagtaacggtttctgatagccttccagatggactaaatgggttggcgacagcgcggggatg

SEQ ID NO: 38800 - DNA, 973 bp, Glycine max
  misc_feature (36)..(36): n is a, c, g, or t
  Peptide Sequence Number=SeqID_130485
gacgtcggttccaaggattgcaaggtggtggaatgncagggcacgaccggctcctcgcccgccatcaaccgcaagaagggcttcgagcaagccatcgcttcgcacgccaatatcaagatcgtccgctcgcagacgggtgactttacccgcaccaagggtaaggaagtgatggaaagcttcatcaaggcggaaggcggcggcaaggacatctgtgcggtttatgcccacaatgacgatatggccgttggcgcgatccaggcgatcaaggaagccggtctcaagcccggaaccgacatcaaggtcgtgtcgatcgacgccgtgcctgacatcttcaaggccatggcagccggtgaagctaacgccaccgtggaactgacgcccgacatggccggcccggccttcgacgcgctcgaagcctatctgaaagacaagaaggcgccgccgaagtggattcagaccgaatccaagctctacacggcatctgacgacccgatgaaggtctacgaggcgaagaagggcctggcgaaacctctccgatccagtctgcagaatggtctcgtatggagcgagcgcatgccacttgtttcttctccccgtccggggagaagtccgcggcagtgggatgagggggcaagcctggagatgtcagaagagcttgccccttcatccgacccttcggcccaccttctccccggcggggagaagaaatatgccgcaccgctgtggcgtatccgtcagacgatacccttccggccatggatccgacggatcgagcatgtgctggtgtattccggtgatccagccgcggccggatatttccggcattatggccggtcggtcgccgactgttgtggttccgaggatacggcccgtgaaggtagagccgatcagcgacaccgccgtcagcgtttccccttccttcatttcgccgcgtgcatgcagcacggccatacgggccgaaagcgccgtgccg

SEQ ID NO: 38801 - DNA, 591 bp, Glycine max
  Peptide Sequence Number=SeqID_130486
atggcagaatcgtcaaagaagcgaaagggatcatcctccaccaccgctgctgttggccatcgccaccacagaccatctgaagcacccatagcaccaattcatccttccttatcatctccaagatcatctactctattttcttcagatgatcaacgtctatggtacaattctcaattttcttctaggatcattctagaccctaagtacctagacacaaatttctttaatgatgagacatttgactgttatcaagtgtttcaaaactctggattggctgattttatgtccttgaaattgccttactatcctgaacttgttaaagtcttttatagcaattttaaaattcaggatggtattatttcttctgaggtacatggtatttctatgatcattgatcaatctttattcttttcactgactaaattacccagtcaaggtgcaccttttgagggcaccattgttgatgactggaaattcaattattctagtcatgatgcttgtcgtatggtttgcaatgacaaggctgaaatgatcggtagattgctggccggatcattaacctttgattgtcgcatcatgcgctatattaat

SEQ ID NO: 38802 - DNA, 150 bp, Glycine max
  Peptide Sequence Number=SeqID_130487
atgaccaaacttggtctctgcttgtcatctgctctggatgacaaaagggtgcggataaccgtaagggtgcggataaccgtaaggtatctccgcgtatcatgggtgcagaatgaccaaacttggtctctgcttgtcatctgctctggatga

SEQ ID NO: 38803 - DNA, 630 bp, Glycine max
  Peptide Sequence Number=SeqID_130488
atgtgtcaggagaaattggtacaagaagccgtggatacacttcttgataatggaatccgcggacaaccgatgagggacggtcataataaggtttacaaatcattttctgatataattgagggcaaagagggaagatttcgcgagactctacttgggaaacgggttgattattcgggtcgttctgtcattgttgtaggtccatcactttcattacatagatgtggattgccccgcgaaatagcaatagaacttttccagacatttctaattcgtggtctaattcgaaaacattttgcttcgaacataggaattgctaagagtaaaattcgggaaaaagaaccgattgtatgggaaatacttcaagaagttatgcagggacatcccgtattgctgaatagagcgccgactctgcatagattaggtatacaggcattccaacccattttagtagaggggcgtgctatttgtttgcatccattaaagctcaagcagagctcgtttacttatgttttctcatacgaacctcctgtctccggctattggggatcctatttccgtaccaactcaagatatgcttattggactttacatattaacgagcgggaatcgtcgaggtatttattcaaatag

SEQ ID NO: 38804 - DNA, 364 bp, Glycine max
  Peptide Sequence Number=SeqID_130489
gaagcacttggaggagaaggcgaaggcattggcggatgaaggtgaatgggcttcgttcattgatgtctcggcgttattggtatttggagtcgttctctttccaaatgtggatggactagtggacctagcgacgatcgatgccttccttgcttatcaccatagcaaggaaagtccggtcgttcctgttttggccaatgcctatgacacatttgaccggagatgcgagaagagcggcgcaaggattgtctgttacacacctgctctttatgtatggctggtcttgcacctctttcatcatgaaagtagacccatctgtcccctgcaaggtcaccgcatatgcaccgagaaagggaaggcaaattga

SEQ ID NO: 38805 - DNA, 501 bp, Glycine max
  Peptide Sequence Number=SeqID_130490
atgagtcgatctcttgctttctcacttcagagggtggacccttgggtacttgtacctatcgcctttagaggactacacatcctcgccttcagaggactgcacgtcctcaccttgagaggactacaacgtcctcgccttgagaggactacatgtcctcaccatcagagggctgcacgccctcacctgcagaggactacacgtcctcgccttgagaggactacatgtcctcaccatcagagggctgcacgccctcacctccagaggactacacgtcctcgccttgagagggctactcgccctcggcttggagggctacacgccctcgccatcagaggactgcatgtcctcaccttcgtagggctacacgccctcacctttagaggactacacgtcctcgccaacagagggctacacgccctcaccttgagaggactacacgccctcacctccagaggactatacatcctcgccttgagagggttgcaccgccctcacctttag

SEQ ID NO: 38806 - DNA, 780 bp, Glycine max
  Peptide Sequence Number=SeqID_130491
tcggagtatcaaggaagtgtttggaggaaagggcaaaggccttggaaaatcaaggcgaatgggctttcttttattgacatcttggcgcttttgatctttggagttgtcctctttccgaatatggaagggttagtggacctagcagtgattgacgctttcctcgcctttcatcatggcaaggaaagcccggtcgtcgccattttggccatgtatgacacgttcgaccggggatgtgaaaagagcgacgcaagaattttttgttgtgcactggctctctatgtgtggctggtttcatacccttttctccaagaaggaaggaagaatcaggattctatcttcatgcgaaggatgtccaaatgttcccttgatggaacaaggggttgtattaattataatcccgtcctcaccataagacagcttggctaccccatgagaggagtgccatcagacgaaagcatcacgcctttcatcgcacggggtttcagtgaccacaacgtgagggacagagagcttaggggaagcagtaatgggatcatcggcggctatcataagtggctgagagtccgaacacaaggattggattggctcccaaatctaaacactgtgagagacgatgaggttaaagcttcggaagaaagtgatgaggtacaagccctaaaggcagagcttgaaagagcccgggtagtcgaagagaagttcaagtccatagccatcaaaggcagcaatagtgagctcaagctccgaagaggtgaaaggaatcatcacgggtcaaaggcatga

SEQ ID NO: 38807 - DNA, 87 bp, Glycine max
  Peptide Sequence Number=SeqID_130492
atgcggaaattgattaaggttaagtggtggctggacagaaatatagaaatggaaataactgaagctacagggctccaaatgaggtga

SEQ ID NO: 38808 - DNA, 537 bp, Glycine max
  Peptide Sequence Number=SeqID_130493
atggtagaagctgttgatggtggtggtgaatatcatcaactggacggatctcaacacttattactggacgtggtgactacacaaatgcaacatttgttgaatcgtaacaatgaagatctctacagacgaataaaaggactagagcaccaaatgaatccaaatgttgggagaccttatggtgggaatagaagggccaatgatggaccgaaccgaatggaggggcagaacaaaattgagggagtaaaactcaatgtacccccttttaaaggtaggagtgatccagatgcctacattgattgggagatgaagattcaacatgtattctcttgcaatggttatattgaagagcataagctacaacagaaccatgcgacagaaactccagaggctatcccagggaagtttgactgtggaggagtacacaaggagatggagatggtactagtgagggccaacattgaagaggaaattgaggacacaatggctcattgtttgagtgtcctaaatcctgacattagagatgttgttgaattatag

SEQ ID NO: 38809 - DNA, 147 bp, Glycine max
  Peptide Sequence Number=SeqID_130494
atgttgatgcacaatccgcccacttgggccctccagaagattcctccagaaggcggttgcttctggaggaagcaaccctgctcgcctgggcgagctgagctcgcctgggcgagctgggcggcaaccacctcccctattttgctataa

SEQ ID NO: 38810 - DNA, 405 bp, Glycine max
  Peptide Sequence Number=SeqID_130495
atgcaagcatgcgcgcgggcaccaatttggatacatcccaatccaataatcaaaaatcctatcgccaccaagatcaaaccaaagccatatttgaaggctgccgatgggttatatttggactcccaaattttggataccgaggaggcaagtgcaatgataaaaaatgagttgaggatcgaaaaccaggagactttaatttctgatgcttctttattgaattcattgtacaacatccagattactgctccccagatcaacccaaaacagataaacaatacgatatttgaaatggcaattttgttccaggttacttttgccaatttaatcagaacccaagagataatcgaaagtggtacaatcgtcaataaaccatttaccacattaaaggtcgtcaatgcagcacca

SEQ ID NO: 38811 - DNA, 420 bp, Glycine max
  Peptide Sequence Number=SeqID_130496
ggacttgcagtgcctcctgagcctctggttggtcctggtccctccggtcctcgagtgagcacaaaggggagttatgttgatccctcaggaaacgatcctgagacgggtgactctgacaggtgcggcttgtacatagaagcatatcctgtccgcctggttgccatggggagagtttatgagggatccactcttgttcataacactcatttgttgcctggccaagtaaaggtgagtgtggacgaggttaaagattcacatgctccagttcctgtacccactgatgaggtagttgtgtctccgccaaaaccacctccgaagctcgatccggaggtcgatgatccgctttatctgatgacattgaccatcccagagcttttcttgaggccttatcaggttagatgggatgccaccgtgttcggg

SEQ ID NO: 38812 - DNA, 543 bp, Glycine max
  Peptide Sequence Number=SeqID_130497
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccgtgcaaaaaccacgaagttgaccggggggcaaaatttcaaccaacggcttgccaagacctagccacgggccaaaaccgaccaccgggcacatggaaaaacttaagcaatggctaa

SEQ ID NO: 38813 - DNA, 201 bp, Glycine max
  Peptide Sequence Number=SeqID_130498
atgtcagaatctccaaagaatcaaacttgggatgaaattttgggaaaatttaatattccagaagcatccaatgccaagaagaagcttgagaagaacctcatggaggagaaaaggaagaaaatacaggaggaaacaattttggttggggattcagcaatgcttgttgacccttcatctcccattgaaagacatgtgaagtga

SEQ ID NO: 38814 - DNA, 246 bp, Glycine max
  Peptide Sequence Number=SeqID_130499
atgtgcacgtatgcaatttttggtagccaaaatgctttgagtatgcatgaaatggccccgaggaagctttcctcaaagaggtctaggaaggataaagcggccgaaggaaccagttccgctcccgaatatgacagccaccgctttaggagtgctgaacaccagcagcgattcgaggctatcaggggttggtcatttctctgggagcgacgcgtccagctcagggacgatgagtatgccgatttctag

SEQ ID NO: 38815 - DNA, 1032 bp, Glycine max
  Peptide Sequence Number=SeqID_130500
atggccaaatcctccaaaaggaagcatggagagtgctctcaagcagctcttaacaggatagatatgtggttcataaatgaagacaagaagattgatttcaagatgatttatgccggattcaactttcccaacttgctcgaagcacagggtttgtcaacatttgtgaagatgaaaggaactttctaccctgagttggtaaaagttttctatacttgtgctcatgctgacatggaaggaaatttgtactctactatcaatggtgtagatatgatcattgatgctacagtttggaaagcagttgcaggactggatatgggtggagtctgcaagttcaaagaatatgtggatggctacaacaagatgaagacatacgaaggtatgctccttgacccagcaaggaatctgacaaatcgcctaggatttggtggtttaactacagaagattggatgctagtgtatctcattacctacattctcacaccaaggtctagcaatcatgcgcaagtaactgatgatgaattacagattgtatatggcctaaaattaggtattcaattgaattgggtacttcttattgaagatattatgttaaagagccattcattagtggattacgagtttccatatgttgtattagcctctagattcattgatcacttcaacatcaatgtttctaatgagataattgatttcaccaaagcctctaatgagataaccaaaaggcatctcaagaagcttgggatgagatatgttgatcatgaatggattatggccggagagccaccactagcagcaaacatggaccaaatggaagaagaagaagaagaagaaaaagctcaacaagagcctgcacatcaatggaaccgttttgagtctcttatgattcagaagatggatgctattcttcacctccatcaagagcaccaagccaaagttgacagtttcttagaaaacattacaacaaggcttgagaacatagaaactaggctatcccttagtaaccttctcaactcggatgaggatgaaacttag

SEQ ID NO: 38816 - DNA, 525 bp, Glycine max
  Peptide Sequence Number=SeqID_130501
gtcgactctagaggatcccctgccattctgacacggatgagcgtccatgtggctcagttgattgttgatgtcatctatttgtttgcaggtatgccacccactaggcaccctctagacccggataagtctaacagggccctggggtttccggcattgatcacgggcctctaccagtcgtttgcggttctcgtcacccccagcaaattgatccgaccatcgatcacccgatccttcattgagaagtactacacgcctaggcaggcacagggtgatgcacctcaaggtgcgggcgcaccgccaccacctcctcaggctggtgccgctggatcactaggcatgaagcgttatctacagcacttggttcgccagcagcagtttgcggctgaggtcgcatggtcgggagactggcccgatgcccaggcaggggaggagcctgcaggatcccccagtaggatcgaagagccccgcatggacgaggatatgacggacctattcgatttcttgggagggagcggagccacatga

SEQ ID NO: 38817 - DNA, 219 bp, Glycine max
  Peptide Sequence Number=SeqID_130502
atgtccgattcaagcgcatattatatcgagacagtcaaaattgaacacgaatgctctccgcaaattcaaacgaccgacatgaccaagagcaagggcaaggatccactttatggacttggaggacctatgacaagggctagagcaaggaaagccaaggaagttcttcaacaagtgttgtccatactatttgaatacaagcccaagtttcaaggagaatag

SEQ ID NO: 38818 - DNA, 770 bp, Glycine max
  Peptide Sequence Number=SeqID_130503
atggctccggaaaagctttccgcgaagaggtttaggagagacaccgcggctgaagggtccaatgccacccccgagtttgatagccaccgtttctggagtgccgagcaccagcggcgcttcgaggccatcaaaggatggtcgttccacagagagaggcgcgtccagcttagggaggatgagtatacagattttcaggaggagatagctcgcagacattggacgtcgctggtgactcccatggctaagtttgaccctgagtggattccttttgatgcagatgccctcagccagttcctgggtgacacgctaatgctggaggaaggccaggaatgcgagttcagtcagaggaggaacagggccgacgggttcgacgaggaggccattgcccagttgttatgcacactggggcaggattttgcccgggccgctgcagggatgcagatcatgtgcactagcatgaccaccttaacccagacgtggatgacattgctgctcagcaatgtcttgcctagtgatcataactccgatctccctctgccaaagtgtatgccacccaccaggcaccctctagacccggataagtctaacagggccctggggtttccggcattgatcatgggcctctgccagtcatttggggttcccgtcacccgtagtaaggtgatccgaccgccgatcacccgggccttcatcgagaagtattgcacacctaggcaggcgcagggtgatgcacctcaggccgcagatgtggcgtccctaaataatgactg

SEQ ID NO: 38819 - DNA, 464 bp, Glycine max
  Peptide Sequence Number=SeqID_130504
ttcgccgtcaaatcccagggctcaaccctggacaggcggtggaaactaccaagctggagtacgagacgaaagctaggggagcgaatgggattagataccccagtagtcctagccgtaaacgatggatactaggcgctgtgcgtatcgacccgtgcaatgctgtagctaacgcgttaagtatcccgcctggggagtaccgaagaaccttaccagggcttgacatgccgcgaatcctcttgaaagagaggggtgccttcgggaacgcggacacaggtggtgcatgggctgtcgtcagctcgtgccgtaagactgccggtgataagccggaggaaggtgaggatgacgtcaagtcatcatgccccttatgccctgggcgacacacgtgctacaatggacgggacaaaggatcgcgatcccgcgagggtgagctaactccaaaaacccgtcctcagttcggattgtag

SEQ ID NO: 38820 - DNA, 318 bp, Glycine max
  Peptide Sequence Number=SeqID_130505
atgctccaaccatatgagatcagtataggcttaaaggagcactcaaacccggtgacccccaaggcctacactccgaagagtccgtcagggcctctccctcctgattcagagttctcaaacgttagaaagaaagagaagggattgaagccttcattctgtactgcttcgtgcgatgcacatttctccctccatagacattgttttgcaaatcccaacggtggaggtgtgcggaattggatcgggaacaacatatcaaattttcacgacaatccaacggttaacgaaaccgggatcgtaattttacctagacaactctag

SEQ ID NO: 38821 - DNA, 122 bp, Glycine max
  Peptide Sequence Number=SeqID_130506
gctgtcgtcccttgtgatggacgtgtggggtgctaataccttccccgtgcgtaagaacaactcccggaccattcgcaaattaaaacacacccgtgagcctcgcgtcgccctcccaccgaagg

SEQ ID NO: 38822 - DNA, 293 bp, Glycine max
  Peptide Sequence Number=SeqID_130507
caacaattaatagtcttgctagtgtctctgcctctgggccttcatccttctccacttgggccttcatccttctccactcgggggctttgtccttctccacttgggtcttcgtccttctccacatgggccttgtggcgtctacccaaacttatcttccttcaccagaagtggcgtctaccctgacttatcttccttcactggaagtggcgtcatccaaaacctccgtagcctgtatcaaacgatccgctcctactcaggttcacatcatctggtatcagagctttggctcttga

SEQ ID NO: 38823 - DNA, 1243 bp, Glycine max
  Peptide Sequence Number=SeqID_130508
gtactggaagttgccgtacagccgcgcaacggaaagaatgtgacgggcactgttgttacacttgcaacggatgcagagaacagcgacgggaacaataccagcggtggcggtgaaggcgggattattattgacccaaccggcctgccttctgtatcgaacctgaaatttagtggctcgctggtctccggaacggcgctgacggcaagctatgattttgatgcgggcgtcggcgtgcccggagataagtcgcagtttgcgtggggtgaaaagggtacaacagcggcgctggtgagccagggcagtacggtttcaggcagtggcgtagtcccgtcacgtcagcttgtggcgtcagacgtgggtaagattcttgagctttcgctgctcgccagaaacagcgcggatgtaacaggaaatactgaaaccctgacgactgccgataaggataacggaattaatggcaatgactccggaacgattatcgatgcagcactggctccagtggtggagaacctttcgctttcaggcacgcttgccgcaggctcagcgctgaaagggacgtataccttcaatcctaacaacggagaccgtcgcgataactcagtatatctgtgggggattaaggggcagacggcttccgcggtcagttcttcaggctccacggtatcgacctcaggagtgatacccgatgagataatcggaccgcagcatgtcggtaaaattctcgaagtgtctgttctcccgaaaaacggcctcgacgttaagggaacggttgtcagcatggcaaccgacgtctcgggcggaaataattttaacgggggcaacaacggacaaatcgtggatcctgctggcgcgcctgcgctgagtaatctggtgctttccggcaaactgatcaccggcagcaagctgcaggcatcctatacgtttgatccgcaaactggtgacccatccgacaagtctgagtatttgtggggagaaaaaggtcagaccgccggtaacgttgccggtcagggactgacggtatcagtaccgggtacggtcggagagataatcctcgataacagctatatcggcaaaattattgaggtctccgtgctggcgaaaaacgggctgggtgtgacaggcaataccgaaacgattgcatctgacgctcaggctcctgctaacagcaccacagacgggggaactgatggcaagattgttgatgctcttgcggcaccgtccgtaacgaatctggcaattcagg

SEQ ID NO: 38824 - DNA, 669 bp, Glycine max
  Peptide Sequence Number=SeqID_130509
atggcttctaggaaaagaaaggcaccctctacacctacccaagccagatttgatagatccagattctcttcccaagaggcttgggagagatacactgacattgtggtgcctcgtaagcttttactagaaaggaatgtggtagtctactatacagagtttgatgagttcaagcaggaacttgagagacgccattgggatgaggagttgattgactttctggatgacaacattgatgttgccattgtaaatgaattctatgcaaacctttatgaccctgaggacaaatcacctaagcaggtgagggtgaaaggtcatctgattaagtttgatgaggatactcttaacacatatttgaagacccctgttgttgtggaagagggggaaacactcagtgcttactctagatttgcactcctgaggtctgatcctcaggagttagctgctaagcattgtatcccagggaggagatttgagcttaatgctgatgggcagcctttgaagattctgaggaagagcatgaccatgcttgctcagacttggagcgttcattccttttcaaaccttattcccacttcccacacttctgatgtcactcttgacaaagccgaactcatttatagcatcatcatgaagatggacatgaatgtgggatacctcatctcccactag

SEQ ID NO: 38825 - DNA, 272 bp, Glycine max
  Peptide Sequence Number=SeqID_130510
agtccggtagcatgcggagacaccttacggttatccacaccccgtcattcggagaccccaagcccgattgacatgcagagaccaatgttgtcatccgcaccctttccggagatgtcagcatcttctgcaaaagcctcgcttttgtcgaccgccccacctttcgttaccgtgacccaagagtccgatgacatgtggagatacccaagtggcggagatacccaagtggttatccgtataaacactctttcgctatccgtcaaactcagagtccg

SEQ ID NO: 38826 - DNA, 312 bp, Glycine max
  Peptide Sequence Number=SeqID_130511
atgaaggcccaagtggagaaagatgaaggcccagaggcagaggcactatcaagaccattaatgttgctgaaggcccaaactaatttgaaggcccaaacttatcaaggtaatccttgtggcgtctacccagacttatcttccttaaccggaagtggcgtctacccagacttatcttccttcactggaagtggcgtctaccctgacttatcttccttcaccggaagtggcgtcatccaaacctttgtagcctgtatcaaacgatccgctcctactcaggttcacatcatctggtatcagagcttcggctcttga

SEQ ID NO: 38827 - DNA, 606 bp, Glycine max
  Peptide Sequence Number=SeqID_130512
atgaaaaatgaatttatgagcgaccggattaatcagcgcatgcaggcgcttggtttacggagcacgcatcttatggatgcaacaggggcatcaaagggtactgttagccaatgggttaacggtggcactgcgccatcagcaaaattcataagtaagcttgcagaagtccttggtgtatctgagcgatggttgactcaggggggactgattgaagaaagcaaagggaatgcttatccgggcccagacctcagacgcagggtcccattgttgtcatccgttcaagctggaagctggaaggagattgttgaaggcaacctgcaagacgtgaatgaatggattgaaacaacggcaaaagtatcaccctattccttttcattaagggtatctggtgactctatggatggtccgccaggtcaaggtgtttctattcctaatggctccatcgtaatagttgatcccgaggttgaggcccttaatggccgcattgttgttgctcgtgtcaatggttcgaatgaggctactgtgaaaaaattggctattgatggccccaatatatatctgatgccacttaaccctaactttaagccaattcggggatcctctaga

SEQ ID NO: 38828 - DNA, 525 bp, Glycine max
  Peptide Sequence Number=SeqID_130513
atggtggaagcctctggtaatcgattaccagcctgtgtaatcgattacacagaggaatgggtcactggtatcgattaccaggcatgtatcgtgatggcggcgcagctaatccgtgatcgagtaaagatggagtgcctagagggagcttgggagaccctcgaaggcaacacgaggtgccgatttcggggcaccattcgattcacggctacttctttggtgcatccagatgaacctgcacggacgcttcagcgcacggtggagtggatactacccacgcctacaccatatcgtctagtggagcccgtccaagtgatcgaggtaacgtcatccgaggaagaccctgaggaggacctggaggagctacctcctgagcctgctgtggatgcccttgactttctagagggtgatgaggatccacttcttgaggtggattctcccgaggaagtcatgtcggcatctgaggcagactctacggaggatagtggcccgagggagatggcgatcagcggaggctcttcatcctag

SEQ ID NO: 38829 - DNA, 258 bp, Glycine max
  Peptide Sequence Number=SeqID_130514
atggggaggacgtgtagtcctctgaaggcgaggatgtgtagtcttctgaaagcgaggacgtgtagtcctctgatggtgaggacatgtagtcttctgaaggtgagggcgtgcagccctctgaaggcgaggacgtgtagtcctctaaagattgactgtccttttgaaataggtgataattcatgcaaccttgtcctatcttttgcaaatctctctgggaactccctcggagtgtatgttctgtttgttttagccacctga

SEQ ID NO: 38830 - DNA, 608 bp, Glycine max
  Peptide Sequence Number=SeqID_130515
gagattacacagagaatacttcagagattactacagagaaaaaacctgtacgtcagctggctccaccagcagacccacaagccgactctctgaaaatcgattacaaggccatacttgaggccttccacagcacgctgcctgaactgccagtcgttcttaaaatcactgacgaccgccgcaagaagctccgcaaactctgggccgactacgagctgaaccttgagaagtggggggcttacctgcggttcatctcgaaaaaatgccgttggatgctggaagaccgtgcagataccaacaccggtaagacctggcgcaagaaggacttcgattacctgatcaccgagaaatgctacctcaaggtcaaggaggagcgggccaatgacctgccaaaggttcagaagcttgatagcgctgctcgggaggacgcttacacccgcttggtatcccaacgccgaaaaccccaaaacgaggttgaggcactggcaaaggaaatggccggatctcttgggcgcatgaccgattacgacgcacgcagggcgtggactggtatctgggctcaggcagtaaccaaggcaagcgagaacgacctggcgaggttggcatcatga

SEQ ID NO: 38831 - DNA, 973 bp, Glycine max
  Peptide Sequence Number=SeqID_130516
atgaagaaagatggattggctgaatatgcagaaaatatattcaatgatctgaaatacgatttcaatctattctacgaagagaaagatgcgatcggaaaacgatacagaagacaggacgctattggtactccttattgtataacaatagatcacgattctcttacggatcatacgacagatcttaaacaaatgctaaaatatattatcggcggagctgctgcaggtgtagcttttgcttaccttttcggatatgattatttattcagtggaattgccaaaacttatctgaaaggtaaatcaagtgccaacattgacgacggaaaactgtttcccagcaatattatttccacagagtctccaaagctttgggaagaagatcctgcttataacaaaagtactttacctaaaacaatcgttgaaaacctcatccaatccaatacagcctcttttttagtgattaaaaatggaaaattgcttcatgagcagtactggaatggctataaccagctttctaaaacgaattctttttctatggcaaaagcagtgactgtaatgctcctgggaaaggctcttgaagaaggtaaaataaaaagtattgatgaaaaattctccaactttttcgaagattttaaaaacaaagaattaggtaatcagctaactcttaaaaacctggcccaaatggaatctggcctggattgggacgaagattataaaaatcctttccgccctaatgcaaaagcctattacggaaggagtctcttaaaagctactttttcaaaaagatttaaagcagaacccgggacacggtttgagtatcaaagtggttctactcagctattgggatttgccataaagaaatcaataaaccaaacactcgcaagctacttatctgaaaaattctggactcctttaggcatggaacaaaatgccgaatggagtgtggataatagccgaatggaaaagacatattgct

SEQ ID NO: 38832 - DNA, 398 bp, Glycine max
  Peptide Sequence Number=SeqID_130517
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggactttacgatacagtattcgacgttgaccatgataaggatagagcccaagcgcaaggtcttgagccgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 38833 - DNA, 330 bp, Glycine max
  Peptide Sequence Number=SeqID_130518
atggccaacaccttcatagactgcaacaaggttggcaggtccaagtatcaagcaacttggaaaatcaagcatgaaaaagatatggaagcaatgtcttccaagattcaaaggactaaccgccagagaattctttgtcccaacacattggagggtacatcctttgtgagagggtacatctcttgtggatcagttcaagtgaagggtacatccacttggttattcaaagagaacaaggaagggtacatcccttgtggatctttggcttgtacaggattttacaaggttgaaagaaatctcaagaactgttggttgcttggggactggatgtag

SEQ ID NO: 38834 - DNA, 499 bp, Glycine max
  Peptide Sequence Number=SeqID_130519
gatccccgaggtgcatggtattcctatggtcattgatcagtcattgttcttttctttaactcatttacccagtcaaggtgcaccttttgagggcaccattgttgatgactggaaatttgattattcaagtcatgatactcgccgtatggcattacaggccaatgcacctctcccttacccacaattaataactttgtttctgcgtcattttcaaattccacttgatgatgaaccatttgttcaagtcaagcgttcctttgcaattggtgctggtgcagtgacttcttttggttaccgtaaggatcggaatggtcaatggctgaagaaagacgcactccctcctcaagatgagcgtactccttcacctcctcctcagcgagatgattcagcactcatgaatgaagtccttaccgaattacgaggtctttgttcttatgttggtgaacgtttcgactcattggatacacgttttgccggcatggatattcgcctcacatag

SEQ ID NO: 38835 - DNA, 216 bp, Glycine max
  Peptide Sequence Number=SeqID_130520
atgcttcctttcgactcccaacatgtcgcggaacttcacggattgcctaacgatgggtgtcaagtacctcgaagcggtcaagcgaaggtcgcatcccaccaaatagatggtccctggacgaaattaagcctaatcctgatcaagcttcatcctcagattcctcttgttggactaaactcgagcagaaccgcattaagacaaacatacaacaactag

SEQ ID NO: 38836 - DNA, 565 bp, Glycine max
  Peptide Sequence Number=SeqID_130521
atgaccaaggaatccaaggacttagcatcaatgtcgatggaagttctctccggaaaattgcttgcatatgaacaagatttgattcaacaatctcatgaagattacaaagaaagttccgatgatgacgaagatggagagaatttcggcttaatggtaaagaagtttggaaattttcccaaaatgtacaaagatagaaaattctctaaatcgtcaaagaagatagataacaacaacaacaccttcatatgctttgaatgtggaaagcaagataatgtatccacatcctccgactcttctagtgaagaagaagttgcaaatgtatgcttgatggaaaactcaatggatgactcatcaaccattgaagaaagtgaggtaaattttgaatctgaagaagttttggaagcatttaatgaaatgcaagaagaagctcaaaggcttgctgttttaaacaaaaagctgaaaaatgatctaaaattgcatatcactaaattaacttcaacacaaagtgagctggatgaattgaggaaagaaaatgaaagacttgtttcaagctttatagccactg

SEQ ID NO: 38837 - DNA, 348 bp, Glycine max
  Peptide Sequence Number=SeqID_130522
atgtcttgcctagcgatcataactccgatctccctctgcctaagtgccagttggtgtatgccacccactaggcaccctctggacccggatgagtctaacagggccctggggtttccggtgttgatcacaggcctcttccagtcattcgggaagtactacacgcctaggcaggcgcagggtgatgcacatcaggccgcagacgcaccaccaccacctcatcaggccgatcccgctggatcactaggcatggagtgttatctacagcacttggtttgccagcaggcggccaaccaccgggggcaggtgcagatacatgagtgtctctaccagttcagcctcagtcagtag

SEQ ID NO: 38838 - DNA, 270 bp, Glycine max
  Peptide Sequence Number=SeqID_130523
atggtccgtggcggtgatggccctcagcagcgatggtggaggatgatccctttctcttcttcgatgattctgccatttgaggaagttttagtgaatttcaattggtggaatcaaaagaggagtgaaaatgaggaagattgggctttacgggacaggaggacgaggtgtaatcggttgcaaggtatggtaatcgattacaggagtagtaagccttctggtaatcgattacaggatgttgtaatcgattacaggctgcttgttcttgtgtaa

SEQ ID NO: 38839 - DNA, 671 bp, Glycine max
  Peptide Sequence Number=SeqID_130524
tcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgccggataacaatttcacacaggaaacagctatgaccatgattacgaattcgagctcggtacccctagtgaaagctgtacccaatgaggattcacaaaagggtatgtcgaaaagggttacatctgcaacaatggacaatacagtggctgcagttgatccattgggagaattagtgaagaacctttttggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcgccccgacacccgccaacacccgctgacgcgccctgacgggcttgtctgctcccggcatccgcttacagacaagctgtga

SEQ ID NO: 38840 - DNA, 393 bp, Glycine max
  Peptide Sequence Number=SeqID_130525
atggaggattctgaggattttctccatggaatcttcgaggaggattctgaggatttcactctgattaaagtgttcctcttggtgtgggggtccaacggcaagcaacggtggctcacggcggccaccggtggtcttgggtgcgggccttctgggtgctcagtgcacttcctctcagttggaaatgggcttagcgcaactttgggccactcagcgcaattcctcttggtgggaattacgcttagcgcgcttttctcgcttagcgggagatcaaaagttattttttttcaagatcccaacagtcagaatgtagaaacatatcttagggatatccagacaaaagttgaagacgatccaacggttaacgaatccggtatcgcgatttcactgaactag

SEQ ID NO: 38841 - DNA, 238 bp, Glycine max
  Peptide Sequence Number=SeqID_130526
agaagattcatcttctgttccaaatttttatgaatgtaatcaacctggacatctaagagttgattgccctagtttcaagagaagaatggaaaaatctgacagaaaaaccttcaaagataagaaggcaaagaaaacttacatcacttgggaagataatgatatggattcatccagagactcaaaaaatgaagtcgtgaatctaagtctcatggctaaaaactatgaaagtgaagaagag

SEQ ID NO: 38842 - DNA, 669 bp, Glycine max
  Peptide Sequence Number=SeqID_130527
atggcctccaagaagatgaaatttaccgcctccagacctagggagccctatgacaccactagagtcatatctgagggcatctgggagagatatgcacagaatgttcactcccagaacattcttatggagaggaacatcatcctatatgtcacagagtacgatgagttccgtcgcgagctcgataggcggagctggcataaagccttgaccatgcagctcgacggtcacattgatgtggccctggtcaaggagttttatgccaatatctatgaccctgaagataaatcccctaggcaggttcgagtgcgggggaagttgataaagtttgatgctgagtccctgaactcattcttggagaccccagtgatcttggagcctggggagcactacaccacatactcccgattctgtcattcgtgcccaaaccctcaggagttcgccgccagactctgtattctagggtgcggttttgttcttaatactgaaggggcaccctggaagctcctgaggaaggacctcaccactctggccaagacttggactgtgctctcatactccaaccttgcccccacatctcacacgtccgatcttaatatggacagggcgaggttggtatacggattggtaatgaagatggatatggacttgggctcgctcatttctggctag

SEQ ID NO: 38843 - DNA, 957 bp, Glycine max
  misc_feature (929)..(929): n is a, c, g, or t
  Peptide Sequence Number=SeqID_130528
atgacttttaaacaccaggaaaaagagacattaaatatattcgccgttctcgccgtctcgttaagcacggtaatcgccatgctcgacagtaccatcgccaacgtggcgctgccggtgatcgccaaagatttcggcgtttccgaatcggcctccatcatgattattaatgcctaccagtttgccgtcgtcgcctctttgatgcccttcgcggcgctgggccgcgcggtgggcaataaaaaaatctttatggccggggtggtgctgttcgctttttcatccctgggctgcgcgctgtccacgacgctggagatgctgacggcattcagggtgatacagggcttcggcgcggcggcggtgctcagcgtcaatgcggcgctgatcaaggagatatacccggaaaggctgcttgggcgcggtctgggcataaacgtgatggtggtgtcggtttccgccgccgccgggccatccatcgcctcggcgatactttctcaaacgagctggaactggctgtttaccattaatgttcccatcgcttgcctgtcgctgctgctgagcgtgatattcctgggttcccgcgagcggcgcagcgttgggttcgacagcgggggcgccctgttggtgtttgtgctgtttatcgctttctcgctcagcaccatgagcatgaccactcaccatctgccggcggcggcgctgagctttgcggtattcgccgggctggccgggttgctgtacatcaatcaaaaaagaaaggctgacgccgcgctgatcccgatcgcgatgctgcataacccgacgctgtcattgtctttgctgatgtcgatgctgtcctacagcacccagcttttggcctatgtttcgctgcctttttattttcacaacgtcctgcaaagaaacgtggtggaaatcggtctgttgctgaccgcctggcncgctggccaccatgggcgtcttcgctaa

SEQ ID NO: 38844 - DNA, 258 bp, Glycine max
  Peptide Sequence Number=SeqID_130529
atggctccaaaaaagcttctctctaagagggcaagaaaggacgctgcgggagaaggatccagtgtggctccacaagcagacatagaatttgacggacaccgtttccgaagcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtga

SEQ ID NO: 38845 - DNA, 108 bp, Glycine max
  Peptide Sequence Number=SeqID_130530
atgaccgtaaaaaggagaaaacttgaaggtgcaaaagttgttgtctcgctaagcctggaccgtgcgcttagcaagactcaaccgctaagcgagacatcagccgcttag

SEQ ID NO: 38846 - DNA, 1115 bp, Glycine max
  Peptide Sequence Number=SeqID_130531
tttgaagaaatcgtgggatgcccactgggaggaaggaagccatatctgttctatgggttctatccctccacgacaagagttgccaaggccttgggaaatcaaggcgaatgggctttcttttattgacatcttggcgcttttgatctttggagttgtcctctttccgaatatggaagggttagtggacctagcagtgattgacgctttcctcgcctttcagcatggcaaggaaagcccggtcgtcgccattttggccatgtatgacacgttcgaccggggatgtgaaaagagcggcgcaagaattgtttgttgtgcactggctctctatgtgtggctggtttcacacccttttctccaagaaggtaggcccgtctatccgctacaaggtcaccgctcgtgcgtcgaaaaaggaaaggcgaattgggaccaactcttggctagcatggaggggcgtctggtttgtattaattataatcccgtcctcgccataagacagcttggctaccccatgagaggagtgccatcagatgaaagcatcacgcctttcatcgcacggggtttcggtgaccacaacgcgagggtactccaaggagttcgcaaggcatgggatgcggcagtccgaacacaaggatgggattggctcccaaatctaaagactgtgagggacgatgaggttaaagcttcagaagaaagtgatgaggtacaagccctaaaggcagagcttgaaagagcccgagtagtcgaagagaagttcaaggcagcaatagtgagctcaagctctaaagaggtgaaaggaatcatcacgggtcaaaggcatgatcttgaaggacgagctaaagggaatatgtgggccatcatcgataagtgcaaagagaagctaaatctagcggcgactcacgagcaaaggctagaggatgagtacgccaagatatcagcagaaagggaagcaagggaaagggtaattgattcattgcaccaagaggcaacaatgtggacggaccgatttgctcttactttgaacaggagtcaagaacttcccccattcctagccaaggccaaagcagtggcggacacctactccgcccccgaagagatccacggacttctcagctatt

SEQ ID NO: 38847 - DNA, 345 bp, Glycine max
  Peptide Sequence Number=SeqID_130532
atgggtgaagcagaggaggtgcaagagaagatgaaggccaacatggaggccatgaaagagaaaatggccacaatgatggaggccatgatgagcatgaagaagataatggaagccaaatgcgagacccatgaaattccccatcacaatctagccgacttcgagccttggctcggatataccactgaagggcaagcagttggtggtatacccctacaaaaccctttggagggccctcagtatcacccacaactgcacctcttgcattccacagcggttaaaaaccctcatgactatggcaggaatgggaaagttggatcatctagaggaaaggctcagggccattga

SEQ ID NO: 38848 - DNA, 258 bp, Glycine max
  Peptide Sequence Number=SeqID_130533
atggtgttagaggataagtcaaaggcttgtcagaggtcaaagagaagtttgacaaaacagtgttcgcactctgggatactgcttgtttgtgtggatgcgaaatctaccggcaagtgcaccaggttgtcaagctcaagtactaaacaccgatgtcatatagggaaagagtttacatcaattactcagcaagaatccccaactgaggatttagcctcccatagcaaggaagctcttttcacaatgaagaagaggaattaa

SEQ ID NO: 38849 - DNA, 330 bp, Glycine max
  Peptide Sequence Number=SeqID_130534
atgaacttaatcattgttacaaaaagaaaagaacacgctttacggcgcccttaccaaacccgtactagagttagagtaatgggtgaagtagaggaggtgcaagagcagatgaaggccgacttggaggccatgaaagagcaaatggccacaatggtggaggccatgatgagcatgaagaagataatggaagccaatgcggttacagttgccgctactagcactgttgctaaggtgaacctgatgcccccatctgacctcaaccaaatgaatcatccaacctcagatatggtaggtaaagatttgggaagtatggacggccccatgatatga

SEQ ID NO: 38850 - DNA, 555 bp, Glycine max
  Peptide Sequence Number=SeqID_130535
atcatcggttctccacctgcctccactcctcctcctcttcctcattctcctccttctcctcctcctcctcctcctacttcagacgcatcagcatcgccgtttgccgttaagcggacacgcaaagcctcacatttacgatctttgtccactagaccacctggtgttgagagaccagtggtgcatgttgatcctgctaccgggaaggccgacggtccccacatgaagaaatcaagaacatatttggggattgttgcatgtgataaggtggacatcacctacgagaactggaaggaggtccctactgctcagaaggacctgatttgggaggatattcatgcggaatttgatatctcagaggcttctgacagtaggacgaaaaggaagttactacagaccatgggggagagatggaggcagtttaaatcagacctcacgaggaaatgggcccttgcagtcgatcaggacggtgtcgaggacattgtctatgagaaatacaacatcagcaaggaaaagtgggcccagttttgccagactcacagagacccttcttgggag

SEQ ID NO: 38851 - DNA, 87 bp, Glycine max
  Peptide Sequence Number=SeqID_130536
atggattatcccacacaaggaaaaatttgttatagcatggacgaacaaggtgatgcacctaggcaacacaacaacaaacagggttga

SEQ ID NO: 38852 - DNA, 650 bp, Glycine max
  Peptide Sequence Number=SeqID_130537
aaaacaccgagactttttcaagtctcacaagttatccagaactacgtaggtctgagttcatcattggaggatacgtaggagcaagagcctcgcttttgtcgaccacaccgccttttgttgccataactcaagagccgttgtgtccgatggcacgcagagaccaagtttggtcattctgcacccatgatatcgcggagataccttacggttatctgcacccctatgctaggcagacacagttgtgtccgatggcacgcagagaccaagtttggtcattctgcacccatgatacgcggagataccttacggttatctgcacccctttgctaggcagacacagttgtgtccgatggcacgcagagaccaagtttggtcattctgcacccatgatacgcggagataccttacggttatctgcccccctttgctatgcagacacagtcgtgtccgatggcacgcagagaccaagtttggggctgacacagtcttctgcaccttttgttcctccgggaacaacaaagtcatttacatgcggaaatttcatggtcacccgcgactctcgtcagccgagaggagcgaaattagtgtcatacactgattttcggggacctttgcttgatgacatgcgaccattctttggtccttgtgag

SEQ ID NO: 38853 - DNA, 174 bp, Glycine max
  Peptide Sequence Number=SeqID_130538
atgaaggaaagcttcttgcatagcaactatccgatgatcatcaacgatccacgatgtcggatacaatgtcctgacatcctgctcgagaatactggagttgctgtgcaatgcaagataaaagtcaagtgcagaagtgaagctgcaggatccacgatgtcggacacgatgtcctga

SEQ ID NO: 38854 - DNA, 420 bp, Glycine max
  Peptide Sequence Number=SeqID_130539
atgaaggccgacatggaggccatgaaagagcaaatggccataatgatggaggccatgatgagcataaaggagataatggaggtcaatgcggttgcaatagccactaccagcaccattgctgaggtggacctgaccctcccatatggcctcaaccaaataaatcttccaacctcagatatggtaggtctggaaggcaaagagttgggaggtacgggcggccctcatttagtgcgaaaaacaagcatcccttcccaccatatggcttgcctcccaactatacaccacccactgtggcatacactcccaacacatgaaattccccaccacaatctagccgactttgagccttgcctcggatatgccactgaagggcaagcagttggtggtatacccctgcaaaacactttggaggggccttaa

SEQ ID NO: 38855 - DNA, 582 bp, Glycine max
  Peptide Sequence Number=SeqID_130540
caccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggctccctctccggaatcgaaccctaattctccgtcacccgtcaccaccatggcagagcctgtgttgaccttttatctaataaatgcatcccttccagaagtcggggtttgttgcaccatcgcgttgaacaaagcaagcgccagggcaaagcgtcatccgagacaaccgatttttaaggaacaatgtgggggcactagaccacccacgttcactgcatgcaccgcatccgagagaacaatcaccacacgtgtgccacaggaagccgttatgatgacgactaacgtggttcacgtgtgggactttgaaatcctccagccgccccaacaaagaggcctggatggaatgggtctgactagccacacgaataccgtttggag

SEQ ID NO: 38856 - DNA, 683 bp, Glycine max
  Peptide Sequence Number=SeqID_130541
ggcgtgtggcgacgcgttgggagtacctattgatggaagaggggctctaagcgatcacgagcgaagacgtgtcgaagtgaaagcccctgggattattgaacgtaaatctgtgcacgagcctatgcaaacagggttaaaagcagtagatagcctggttcctataggccgtggtcaacgagaacttataatcggggaccgacaaactggaaaaacagctattgctatcgataccatattaaaccaaaagcaaatgaactcaagggccacctcagagagtgagacattgtattgtgtctatgtagcgataggacagaaacgctcaactgtggcacaattagttcaaattctttcagaagcgaatgctttagaatattccattcttgtagcagccaccgcttcggatcctgcacctctgcaatttctggccccatattctgggccgtggcatatcgacaaatgtcattattgttacgccgaccaccaggccgtgaggctttcccaggcgatacctgctattaacgtcggcttatctgtcagtcgcgtcgggtctgccgctcagttgaaagctatgaaacaagtctgcggtagtttaaaacttgaattggcacaatatcgcgaagtcgccgcctttgctcaatttggctcagaccttgatgctgcgactcaggcattactcaatagag

SEQ ID NO: 38857 - DNA, 303 bp, Glycine max
  Peptide Sequence Number=SeqID_130542
atgatcatgaagacagatggtgaaatcaccagtgaatttgaaatcagtgaagaagaagagcttgaggaggaagctatgcagggtgatatgctaatagtgagaaggctcttgggaagtcagatgcagccactggacaacacccaaagagaaaatattttccacaccagatgtataattaatgatgaagaggtaaaagtgactcagcaggttgaggtatgtctcaccattggaagatacaatgatagggtgttgtgtgatgtggttccaatggaggcgactcatatactgttaggaagaccatga

SEQ ID NO: 38858 - DNA, 468 bp, Glycine max
  Peptide Sequence Number=SeqID_130543
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggcgaggctctcgggtgcgtcttccaaaggaggaatacgcgtggagtcgccaccaatgtttatttgtggaaaacgtcagaaaaaccgaaggaaaccggtcatgaagaatattccagattcgggagttgtatttacgtttgaggaaggtattagcacctctcacatcgacaaaagcgggactcttgctcctacgtaccctacatcaaagaggaaataa

SEQ ID NO: 38859 - DNA, 144 bp, Glycine max
  Peptide Sequence Number=SeqID_130544
aattgcactaagcaatcactacgcatggctccaaactctggaaggtggaggacacatgaacgaaaacgcaattcatggggctccgaaaagattgagaatggagaattacactaagcaatctctacacgtgtctctaactcgagg

SEQ ID NO: 38860 - DNA, 450 bp, Glycine max
  Peptide Sequence Number=SeqID_130545
atggcggtcaccggtggtcagtggtggtggaggaggagcttgagggttttgggggagggtttaggtgaagagaaggaggaagaagatggctattttatgctattaaacgtatttgtagcctgcaacactcacccaggcgagtttggctcgcttgggcgagctgatccacagctcaaattttctgcttcgttcaaccgtcctagcaaacctcgaacttgcttctcggtgcgtggttcgggcatttcgaggatggccttcactttgtctgggtctacctctatccctttctggctcatgataaaatcgagcaacttctctgacttgacctcgaaaatgcactttgcgagattcaaccttaatcggtacttacgcagcctcttgaacaactttcataagttgacaaggtgttcctccttggtctttgacttggcaatcatatcatccatgtag

SEQ ID NO: 38861 - DNA, 420 bp, Glycine max
  Peptide Sequence Number=SeqID_130546
atggttaaaggaagcacgaaaataaatttacatagcaccttatttaaatcattgctcgtattgtgcccaggtgacaatctagtggtttggttttgttctttacgaaagaagcctgatgctgccatcaagggtgcagtaaacagtgcaatgaaatcagtcagcaaaactgtagagggaaagccacctcagcatgggcctcagtggattgaagcaaagagtcatgttcaaacaggaaactatgagtgtggatactatgttatgcattggatatggtgcatcataagtgctggattaaaggatgaatggattcactggttttctgatagatcagcggtaacaaaagataccatgaccacactccggcataaatgggtggcatattttctccaaatgaagaaatgcgaacttagaaaaatttag

SEQ ID NO: 38862 - DNA, 626 bp, Glycine max
  Peptide Sequence Number=SeqID_130547
atggcggaggcggaggacataaggcatccatgtctgcctcccgaaagcccatcgctcggaaaggagggagtcctctttctcatgtggggactacccaaacatcccgttgatagggaacaagggggttgcattaactacaatccccgcccttgctataagaagttaggggtaccccatgaggggagcaccgacgggagaaagcctctctcctttccttgtgagagatttcggtacgcaaagtttcaaagattatacaaagagtccataaggcgtgggaaagcccggttagattggctctccaagttaaagattatcaacgaagagaacttcgaagctccagaagaggatgaagaagttcgagctctaaaaacagaactaggaaaagcaagacttgccaaagaaaaattcaagttggtcactacagacgttcggaaagagtgtgccaagttacgagaagaaaatgcggctaccgcaagagcccttgaacaagaaaccaagagggctcgcaaggaagagcatggccgtgacaaatttcgtggagctttgtggggcagcaacagtgagctcaagcttcgaagcgaagagagagaccaatcacgagcacatagcacggtcttgaaagagga

SEQ ID NO: 38863 - DNA, 438 bp, Glycine max
  Peptide Sequence Number=SeqID_130548
atgtggggcatcccttttatccttgagccaaaccaaaccccgacatcaaaaagaaagagaaaggaaattcccaatcaaagagtgggagaaagcaaaaaaagagaaaggaaattcccaatcaaagagtgggagaaagcaaaaagaaaagaaaggaaattcccaatcaaagagtgggagaaagcaaaaaggaaagaaaggaaattcccaatcaaagagtgggagaaagcaaaaaggaaagaaaggaaattcccaatcaaagagtgggagaaagcaaaaagaaaagaaagaaaattcccaatcaaagaatgggagaaagaaaaaaaaaagggagaaaagaaggaaagaaagctcctgatcaaggatcgaaaacagaagaactgtgcagagaggtctttggaccggacaatatctgaacaaaacagaattgtcaccaaatga

SEQ ID NO: 38864 - DNA, 228 bp, Glycine max
  Peptide Sequence Number=SeqID_130549
atggaggccatgaaagagaaaattaccacaatgatggaagctatgatgagtatgagaaaaatgatggaggtcaacacggctacagtcgttgccgcaagtaccgccactgaggtggacctgactcacttatctggcctcaatcaagtaaatcatccaatctcagatatggtaggtcagagaggcaaagcattaggaagtacgggcgccccccatttcgtgcaggtctag

SEQ ID NO: 38865 - DNA, 342 bp, Glycine max
  Peptide Sequence Number=SeqID_130550
atggcttccatgatggatgccatgctaggaatgaggcaactaatggagaaaaacgcggccaccgctgccgctattagttcggctgccaaagcaaacccaactctcccagctatcgcgcaccaccctatcccagacgtggtcatgtccctccccccatccttgaaggggaacctcctcgacagtcggacgaggtccacgaggatcgtcgggagcatgcccaaggagacatcgattcccactccccgttccctgctgaggggccggcacccaatgcactacctcagcccaacctcatgggagaacctcgaaacccctcaacacagccaatattcttttccatag

SEQ ID NO: 38866 - DNA, 453 bp, Glycine max
  Peptide Sequence Number=SeqID_130551
atggcaagagtagcaaaggtggtcaagatctcgacgcaagaattggaccgagtgaaacaaaatagaaatggggtggttgggataccaaagaagcacttggaagagaaagcgaaagctttggcggatcaaggagagtggacttctttcatttatgttttagcactattggtgttcggagtcatcctctttccaaatgtggatggactagtggatctagcagcgatcgatgcttttcttgcttatcaccacaacaaggaaagtccgaccgttgctattttggccgatgcctatgacacgttcgatcaaagatgcaagaagagcagcacgagaattatttgttgcacacccgctctttatgtatggctagtctcttatatttttcattatgaaagtagacccgtctgtcccctacaaagtcatagcttgtatgctgagaaagggaaggcaaattag

SEQ ID NO: 38867 - DNA, 555 bp, Glycine max
  Peptide Sequence Number=SeqID_130552
atgggtgaagtagaggaggtccaagagcaaatgaaggccgccatggaggccatgaaagaacagatggccacaatgatggaggccatgatgagcatgaagaagataatggaggtcaatacggctgcagttgccactgtctgcgttgtttctagggtggacttgactccccgatctggccaaaacctaataaatcgtccaacctctgatacgggaggccctcattttgtgcaagccctgaacaagcatgtttttccgccatatggtttacctccgaactatactccacccaatgagaatgtcaataacttcactcctatactcattgagagccaacaacctcaaactgatcatgcacatgtctctcaacccatgggggagacacatgaaatatcccatcgcaatctagccgacttcgagcctcgcctcggatatgccactgaagggcaagcagttggcgatatacccctgcaaaacactttggagggccctcagtatcacccacaaccacaccccttacattccacagcgagtaaaaaccctcctcctatggcataa

SEQ ID NO: 38868 - DNA, 270 bp, Glycine max
  Peptide Sequence Number=SeqID_130553
atggtggggtacgcaccttcaagctttgcggatttggtcatcacccgggaaaggatcgaagcgggtctgaaaagaggcaaatttgatcatcctgcttggatgaatgagaaaattggggcaaataaagtggatgagaaggagggagaaacccatgctgtgactgccattcctatacggccaagtttcccaccaacccaacaatgtcattactcagccaataacaaccttctccttactcaccacctagttatccacaaaggtcatccctaa

SEQ ID NO: 38869 - DNA, 442 bp, Glycine max
  Peptide Sequence Number=SeqID_130554
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagcagttcgctccaagctggactgtatgcacgaaccccccgttcagtccgaccgctgcgccttatccggtaactatcgtcttgagtccaacccggaaagacatgcaaaagcaccactggcagcagcactg

SEQ ID NO: 38870 - DNA, 321 bp, Glycine max
  Peptide Sequence Number=SeqID_130555
atggaggattacctagaactactaaggcagttggaaccaatgtctaaggaggagagtgacaattctttcaaggacaagtcttacttagttctatacttctatggtatcagagcagctcatcctatcaagattgggggaatcatggttgggagaccccacaacactactgctcaacttctagctcgtatgactcaagtgctagaaaccttagagcaagattgtgatgctaaactagtcgagtatcgggggttttcttctttcactaagcacaatccacccaagtttgaagtcaactttgattcgaaaggagcccaacattag

SEQ ID NO: 38871 - DNA, 1001 bp, Glycine max
  Peptide Sequence Number=SeqID_130556
cgcaataccggttgcaacttgatgacaacaacgcaatgagcgggggcaggcgatgcggcgagcagagggcatcgccgcatcggaggggattaaccgccggcgataacgaacagcacggcctgtacgatgacgatgcagggcccggtggcgccgtcgatgtggaagctgatcagggtgccaagcacgcaggagaacaccgacactaccgtcgccaccaccagcatgcgttcgaagcggcggcacagcataaaggcgatgatgcccggggcgatcagcatggcgatcaccaggatcacccccacggcctgcagcgaggcgacgatggtcatcgccagcaggcacagcagcccgtagtgcagcagcttgaccggcaggccaatcacccgcgcatgatgcggatcgaagcagtacagcatgaagtctttgcgcttgagcagcaccaccgccaaggtgatgccggcgatcagcagtgtttgcttcagctcgccgtcggtaatgcccagcatgttgccgaacaaaatgtggctcaggccgaaggcgaacatgccggaaaagacgatgcccatcaccgtgtcttctttcacccggctgttctctttcaggtaaccggtggctaccgcacagaagatgccggaaaggaaggcgccgatcgccagcggaatgccgaccacgaacgccaccacgatgccgggcagcaccgcgtgcgagatggcgtcgcccatcagcgaccagcctttgagcaccaggtagcaggagagcacggcgcacactacgccggtgacgatggcggcgacgatcgcccgctgcatgaacgggccgtgtttcggcgcgaagaagaacgccgccaggaacaccagcgtttgcagggtgacgatcacccccccggtggcgccgtcgaggaagaagctcaggtaggcgccgatgccgctggtcaatgcgccgatgatgatggcgatgatcaccagccggctgaagcgatcggtcaacaggggatcctctag

SEQ ID NO: 38872 - DNA, 456 bp, Glycine max
  Peptide Sequence Number=SeqID_130557
atgaccatgattacgccaagctcgaaattaaccctcactaaagggaacaaaagctggtaccgggccccccctcgagaaagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 38873 - DNA, 243 bp, Glycine max
  Peptide Sequence Number=SeqID_130558
atgcaaatagcaaccaggcccacttgggccttccaagaagttctccagaaggcatcgccttctggaggaagcaacctagctcgcctgagcgagctgggtggcaagctcctccctcattttcttataaataggggaaggagggaagaacaaaaaggtttaaccctcctggtatctgagaatcacttaaaattagtgaaaaaaattgtttccgtgaagaaaatccaagccgaggagcttccgtaa

SEQ ID NO: 38874 - DNA, 339 bp, Glycine max
  Peptide Sequence Number=SeqID_130559
atggaagaaacaccaaacatatcccaaacttctcgctcccaccggccggctgatggaaatagactgactaccggagatattcgtgttacttcgtctgcacaggtagcgcatctagatagcatagctgaaagcggccttcaaaagcctagcaacggaattgccgatacctatctctatctcttcctatcggcaggagtcttacccgcggatactcttattcgagagatggaattgggaatctgtttcgagacttcgtcattgagagctactaactgccattattccgaggcttatggagacccggttccccgtaaagcattgttccctgggcaagactaa

SEQ ID NO: 38875 - DNA, 495 bp, Glycine max
  Peptide Sequence Number=SeqID_130560
atgagcaatttaaatcttgacgaagatgatgatgatgatgatgatgattatcttgtgtctaactcatacgttgaagagtcgttagacgaagatgacagtgttgacggtatatcagataccgacagtgaagtctccgacatgattccaccagtaagagttgttcacccagcagaaggtgtacaaggaattcagaatccattttggaataatgctttgcattataataatatcaattggagtcatcctgatgaggaggacatttgtggtttggagatgccatccagttttaatgttggccaaaaattatatgttggcatggaatttgatagtaaagatgcggtcaagaatgcggtcaaacaatatgttatgaaggtgcatcaaagtttcaaagtggttgaaagcaaatgggacaagtatgtggtttgttgtgtgaatttatatgcagattgtccttgccctttctacatgagggaaattcgctctaaaaaaatctag

SEQ ID NO: 38876 - DNA, 330 bp, Glycine max
  Peptide Sequence Number=SeqID_130561
atgggtgctaagcaccttacaaggaccaaacaaaggtcgcatgtcatcaagcaaaggtccccggacgaaattagggaaatggccccgaggaagctcgtcacaaagagatctaggaaggataaagcggctgaaggaaccagttccactcccgagtatgacagtcaccgctttaggtgcgttgaacaccagcagcacttcgaggccatcaagggatggtcatttctctgggagcgacgcgtccagctcagggacgatgagtataccgatttccaggaagaaataggtcgccgggcggtgggcatcactggttacccccatggccaagtttga

SEQ ID NO: 38877 - DNA, 708 bp, Glycine max
  Peptide Sequence Number=SeqID_130562
ggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgttaccaaaaacacaggtctccgcaaagtcgtaagaccatgtatgggggctgacgcctgcccagtgccggaagagccatcagtgagataccactctggaagagctagaattctaaccttgtgccaggacctacgggccgagggacagtctcaggcagaagggagcttgactgcaagacccacccgtcgagcagggacgaaagtcggccttagtgatccgacggtgccgagtggaagggccgtcgctcaacggataaaaggttgggctgttcgcccattaaagcggtacgtgagctgggttcagaacgtcgtgagacagttcggtccatatccggaccgggaaggacgcacctctggtgtgccagttatcgtgcccacggtaaacgctgggtag

SEQ ID NO: 38878 - DNA, 282 bp, Glycine max
  Peptide Sequence Number=SeqID_130563
gttcgcagtacttgctttatgccttccttctgactttcctgagcggggaagtggacaggacgatcgatgtgaggcctaggccaagtcagtaccacgtgcaccacccagacaggacggaagctatagtcataacatcgccgaaaacaaccatcgactggcaagatactgcccgggagcagaaagagtcagggggtgaagcctacgctagcatgcctaccgcccccactctctactattggtggctaataggccccttcgcgtatcctgtcttttggttggcca

SEQ ID NO: 38879 - DNA, 462 bp, Glycine max
  Peptide Sequence Number=SeqID_130564
atggccacaatgatgaaggccatgatgagcatgaagaagataatggaagccaatgcggttatagttgccgctattagcgctgttgctaaggtgaacccgatgctcccatctggcctcaagcaaatgaatcatccaacctcaaatatggtaggcaaagatttgggaaagacccatgaaattccccatcacaatctagccgacttcgagccttggctcggatataccactgaagggcaagcagttggtggaatgggaaagttggatcatctagaggaaaggctcagggccattgaaggaggtgaagattatgcctttgctaacctagaagagttgttcctaatacccaaacatggtcattcccaagttcaaggtgccggactttggcaagtacaaggggactactcgctccaagaaccatctaaagatgtactgtcagaagatgggggcatacgcaaaagatga

SEQ ID NO: 38880 - DNA, 129 bp, Glycine max
  Peptide Sequence Number=SeqID_130565
atgtcatttagagggccaaggaaggccagggatgtttcattccatgctccagagcttacacagggggccgtccattatcatgcagagccttcagagcttgggcttgccatccatcatgagcatggatga

SEQ ID NO: 38881 - DNA, 582 bp, Glycine max
  Peptide Sequence Number=SeqID_130566
atgggaaatattgaaactgtcctttccagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagtttatcagaagcttggtctaaaattcccgaaaaattagctttttatgattatatcggaaataatccagcaaaaggggggttatttagagcaggttcaatggacaatggagatggaatagccgtcgatggggatggaattgttagggccgatgttccttttcgaagggcagaatctaaatatagtgtggaacaaatggtgtttttcgtagcagtccgaggggtggtttacttttggacatgcttctttgctctgctattctttttcgggactttggcatgggggctagaacttattcagagatggttttgctggaatcgaccagatttagacgctcaagtagaatttgaagcaatcccaagaccttggagatccaactactaa

SEQ ID NO: 38882 - DNA, 426 bp, Glycine max
  Peptide Sequence Number=SeqID_130567
atggagggcggccatttctcatgtttggacgtcaaagaaccaaaaaaaaatagtcccgttccccgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 38883 - DNA, 407 bp, Glycine max
  Peptide Sequence Number=SeqID_130568
cttaatccagtccaccaccatgttgcgttcttcggggttatcaccgcggccggtaatcatgatggtgtcccagcgttcgcgcggatcgagttcagccagtttgaggtcggcgagcagattgaggccggactggccgtggatcacctggatgtcggcgatacccgccgcctcgaacagcatgccgccgtccgggacaataatcagaaaggcagtgataatgactacgataatgagcagctgagtaaatcagacttaaaaccatcaattctattcaacctgcagaaaagtcaaaccacgctcccggttcagcgagacgctgcgcgtcacggcataatcacaggagggttcaacaatcgcgccgacgaacgtgatttgaccgtcggcggcaagggtggcgtggctggcaa

SEQ ID NO: 38884 - DNA, 117 bp, Glycine max
  Peptide Sequence Number=SeqID_130569
atgtggaccactacgggggagatggttgccgcccagctcgcccgggcgagctcagctcgcccaggcgagccaggttgcttcctccagaagcaacagccttctggaggaaccttctag

SEQ ID NO: 38885 - DNA, 299 bp, Glycine max
  Peptide Sequence Number=SeqID_130570
ggccaacctgggaagattctcaggaaggatctgactacactggctcaggggttgtctctgatagccttaccttcgagtgcctgagcccagtcattaacctggcctacatcaggacgaactgttggaaccccgaggatctaatagtctctatccgaggggctaggagggcgagggcatggccagctgagcttccttctatttctgcagctcctactccagcatccacttcagcagttatcccagctcagacaaattctcaatgctttgaagccatgctccaaagcattcatccgggatag

SEQ ID NO: 38886 - DNA, 411 bp, Glycine max
  Peptide Sequence Number=SeqID_130571
atggagaaaaatgaagaaacaacaatggaagagaagcttgcttgtggagcttctatggaggctggatctttgagcttcaatgaggtccttcaaatggtgatttttcaccatggagatgcagcggaaggcaaaggagaagaggagaggggaggcccccatccactagggaataagccaaggaagaaggagcttcaccacccaagaattgccttggataagaagcttgaagatgatgctttaatggaggaaaagaaagagagaaggggggagcacgaaattgaaggaataaaagagggagagaagtggaactttgaagtatgtctcacaagactctcattcatcaaagttacaacaagtgttacacatgcttctatttatagactaggtagcttccttgagaagctttcttga

SEQ ID NO: 38887 - DNA, 312 bp, Glycine max
  Peptide Sequence Number=SeqID_130572
atgccgaaaaaccaaaaaaatattgatgcacaatcccacccaggcccacttgggccctccaaaatattcctccagaaggctgttgcttctggaggaagcaacctggctcgcctgggcgagctgggcggcaaccacctcccctattttgctataaataggggaggaagtgaagaagaaaagggttcagcccctttggcacttctctctctttcgaatttgcttggaaaaattgtttccgtgaagaaaatccaagccgaggcgcttccgaaatgtttctgtaacgtttccgtgaggaatttcgcgaaggtttga

SEQ ID NO: 38888 - DNA, 291 bp, Glycine max
  Peptide Sequence Number=SeqID_130573
atggatttggagatggaaaacagattagctgctatgcttatgagggaagtagcagaattacggtggcagtctgaaagggaaggagttatggcttatcttcgcaagcctaatgtacggacccgaccaaattcatgtttcctcgctgcaactattcgtggagtacaacaagcaaatcgagttgtggaagtgaatgagatgtggcgactgaggcaaaaagaggatataggaaggcaggttttgacttatggagaaaggccagtttctgttgataacactaatgatgtgcgttaa

SEQ ID NO: 38889 - DNA, 378 bp, Glycine max
  Peptide Sequence Number=SeqID_130574
atgacctttcagtggttccggaagcactttccggaagagcccttcttccggaatgtttccagaagaaccacttcttccggaattgtctattccggaagcactttcccgaataggtgttccgggaactttccggaagaccagtactttcggaagacgtttcagtggttccggaacaactactcttccggaaatcttccagaagacctttttccggaagttccggaagaacccctaacggtgcataacaaaaccaaagctaagaagaatgccacctaccttgaatgcaaatgggtccaagggctgccggagaagctcgcggagaagaagctcgtcggggaagagagaagagaagaagcttttgcggaagagactcagtga

SEQ ID NO: 38890 - DNA, 381 bp, Glycine max
  Peptide Sequence Number=SeqID_130575
atgaagacattatcaaaaacaaaataccttgaagaattgaagaatatcaatagggaagaaagaaaatcgcaagaagcaagcacgaaaacaaagaggattcaggagactggaaatcatagtgacggtgccccaaaaaaacgtttgtccacacttgggggctcgacaaattcatcacctactacttgtcaaggatactaccccgaacctcagataatctccttcgacattggacaacctcttttgcccacaagtgggctcagtggggggcttatgtactatccagggtccacaaactacacgtggcatcctacatggcactctaagacatgtgtcaacccttcacgtcagtccagaaacaggagtaagacactcaacccttag

SEQ ID NO: 38891 - DNA, 1341 bp, Glycine max
  Peptide Sequence Number=SeqID_130576
atgaagcatgatcttgtcaatgtagaggtcttgtcacccatttggtgggacttccttctgctttgtggagctttctcccctgatgtgaggagtatatttgacttgcccctggttaaaggtcttgccaatcagtctgggggtaggttgcttgacttgcggagtttttcctctgatggttataaggaggcaaaccttgcgtaccttgagttcctatggagatggaacttagtaacagaaatggctcaccaagatatttgtggagctgcccttgttaataaggaccttgggcaccatgaagtttgcaataatgatggagataaccacaagatggcattttcggggctgactagactatcctccataggaaaatccacccgcaatggtgttgattacacctttgatctactgaacagactgtctgcgaacttgtcgggctgtagagcgaggagcatggaatgcaatgctaactctggattaagatttaagatctggacagctgtgcgcccaaatctatgcatgaattttctgaaagactcgttgtttgcttgtcccagactggccaaggcggttgaggtcaatgtcacccctttgagggacattgggaagacacgacataggatcacatcgtcattgggtatgttagcatccataatgcggttgatgaagggatgccaacgagtactctaccctactggacgcggagagcttgtcattctggggacatttgacacgagcctccaagtatttgtgtctgtcatagctgctagtggaaggtttgagccttcaaaaggggtctcgtgtttgaggccagatcgagtgctaaccatggatgaacaagagagagatgacgagagaccgtggacgtggccaaagtgggctcttggacttcgcacgtcagctttgagagtggcctttattaagaggaaaagagggggacctgcaaaacaaaggactctgatgcttagtaagtgcacaggcatgtttgctagtgtgctggtgtgtgtggcatgtgtcgaggattcgatggaacttggtatttattggagaggagtggagttgtgggtccttgcaaagggtcactttggggcagttgcagcttgcccaggcgagctgaaacttagtgctgaagcaataagttcgcccagacgagttggtttcttcaccatgaagctatttggtggcccaggcgagctagaggctagccagggttatacatcaacctatttcttcaatttggagccttacaaagtgagcttagacatattcattgtgaagaagtcttatactatcattatttacatgattgttgcccttgaggcgagtagaaaacaacctttgtga

SEQ ID NO: 38892 - DNA, 168 bp, Glycine max
  Peptide Sequence Number=SeqID_130577
atggaggcatatatgaaggatgagagcatgtggataattgatagtggtgctacactgcatgttacagccaggaaggagttcttcacatcttacactcctagtgattttggagtcttgaagatgggtaatgatgacctatttcccccatcagacattactctgttatag

SEQ ID NO: 38893 - DNA, 332 bp, Glycine max
  Peptide Sequence Number=SeqID_130578
agggtgtcacagatgccattggaacggcggcgcatgcttggctgaaggagagaggaccatgccagggttggactggatgggcttgcatcagagataaaaattataaggggaatagctatgtggcttcccttgcacttccatggggcttttatagagtagtgaggaatggggaaagtgtttactcaaaaaatttgacctctatctctgctcacaaaacgccaacgtgcattacacagaagcataattttaaaagcagggccctggtgactcatccggtggtgacacttatcactagatcaactatatcagtggtcaaatcattgagtcactag

SEQ ID NO: 38894 - DNA, 180 bp, Glycine max
  Peptide Sequence Number=SeqID_130579
atggagtgctctcagttttgtatcactaaactcacttctctattcagagtgagtaagggtctggaagaacaaaactgcctttcaggttcatgtgtgtgccgcttcgcgttcgatttacaatggctggagatgaagatgtgcgaagatgggctggtcttgaacccttgccctgcagcatga

SEQ ID NO: 38895 - DNA, 327 bp, Glycine max
  Peptide Sequence Number=SeqID_130580
atgccactggaacctgggggctgggcggctgtatgtactcctcagggtctgcggctggtgcatccctgggctggtcacctgcctgggaaagatgaacaacaagctactgagtggctacttccttcaagatcattgcctctatctattcgttctcataacattcctactgaaccaaacgtgaatgtcagattctaccccaatttcaaaggacatcgaatcttagaatggaaaacatgcaacaaagtctggagaagcaagatagatattaggactcaggtccttgatcctaagatgcaaaagttggagctggaagctcaatctaattaa

SEQ ID NO: 38896 - DNA, 366 bp, Glycine max
  Peptide Sequence Number=SeqID_130581
atgtaccctcccttgttctctttgaacctagtggatataccctccactagaactgatccacaagagatgtaccctctcttgttctcagttaacaacccaagtagatgtaccctctactgggagaagggagacacaaaagaattcaggcggttagtccttcgttcttttggaaaagggagaagagagacacaaaaagaattcaggcggttagtccttggcgaattctttttggcaaagggagaagagatgaaaagaatgaatagcacaagttttcaaggtttagaaaaccagaaaactttggaaagctttttggcacaaagaagaagaagaagttcaaagagattcaaggcttgtaaaggattgtaa

SEQ ID NO: 38897 - DNA, 708 bp, Glycine max
  Peptide Sequence Number=SeqID_130582
gctaaaaggtggcttcattcgttcaaaggtaatagtctcaagacttgggatgaagtagttgagaaatttctaaagaagtacttcccagagtctaagacagctgatgggaaagatgccattttatccttccaccaatttccagacaaatctttgaaggcaaagatcaaattgaagacctcggaagaagctatggaattaattgaggacatggctgctagtggccatgcaattctgcgtgatagagcccacattcctaccaagagaagcctgctagagctttcatcgcaagatgcattgttggcacaaaacaagctgttgtccaagcaattggaggcattgactaaaacattaacatggccagccatacaattcacaacagggacaatggaggaatcaccctggaaaccacttcaacaaagaccagggtgtccctctaataggccaccacaacaagggcctagtctctatgatcaaacaatgaagctggaagagacttgctcagttcatgcaaatcgttcgtctagcagctttggagctaatattgagaaaaatccaaaggaggaatgcaaagttgtcatgactagaagcagattagtggccatgaaagaaggtgagaatggaataggtgcagaaaaacaacagctggtgtctggcccaacacttgatcctatggtagagtctttgagtgagtctgatgaagagttagag

SEQ ID NO: 38898 - DNA, 1434 bp, Glycine max
  Peptide Sequence Number=SeqID_130583
atgtcttctatttttggttccgcattaggtgtaggtggaagcaatttcgggtgttccatccaacaacccatggtggaatgggaagtggttctcattggtgattactcattggaggaatcacctcatgaggcttctgacagcgagtcctccttcttcaagaggttgatgaagccgagtcatgtcagcgaggaagaactttcggcgactactacaagaagtaacggaggtgaagttaggatttttcctcaaaacaggcgtcgttgtggtagcgaagcgccttcgtcccctccctttgttgttggtttcaaatgggtgaaggacgatgttctaaggacgagtttttattcatgtgtgatggttcaggctgttgacccttcttctaagtctactgctacatgtttgagggcctttgaggtcctgtgtccattcttcaatatcagatccaacgtgcctatgttcctctacttctttgaaatgaagttgactgggaagattggttgggtgttgttgagcagtgtgtccaagaagatgttcgagttcaagtcaaacgtgtttcatatattcaaggactgtttcttcaagccttctgctagggaaggaggtcaaactaaagccagagtcaaccctcctcgagcttttgaagctgatgaggaagaagtttttaaggcgatcccttccactatgctggctacgtcaacccccttggtggttcctgtttctgctcctctttcttctattatgatgccattgctaaatgttggtgtgacaacaatagatgccttggtgaacctgcatcctccttcctcggccttgctaccctcagctccaaccatcttgccttcagcaataccttcctcctcttcgcctccaagtgtttcactagaccatgtatacacttgtcgggatacaaagtcattgtggagcatggtctacaagcctaagcagaggaatcctactaactttgagtctggctatcttggaggagaatggaaaaggcacaaggaggttctgaacaagattatatctttagagactaaggtcaccaaatggagagccattactcggactgaaagttatgacttcgtgagcaaggtagagcgcttcactaaagagaaggaagaacttaatgcgatagtgtctgaatctgctaaggagattgctaagctaaaggagttcgagcttaaagtggcaaaggagaaggaagaaaataaagagcttgaggaggagctaataatgtttaaaaaggaagtcgtggagcaacacgagaagggattcctcaagaccgtcaagcaggtcgatttcttcactgagggtcttgacttatgcctttttgacccgtttaaagatgtgaaggatgatcaattgcttgacaaggaggagattgttgttggggaggaggacgatgatggagaagacaatgaggccaatgtttag

SEQ ID NO: 38899 - DNA, 1212 bp, Glycine max
  Peptide Sequence Number=SeqID_130584
atgtgtcccaagtacttcacctgtgggattgttgcaaaagagcacttcaagaatttgaggaagaattggttggcacgaaggacctcgaaggttgtttgcagatgctccaggtggatggagcgttgcataacccgaaaggcattacaaggaactcgtagtggtcgtgatgcgtccaaaatgctgagcaccagcgatgagaaaggggctcgtgctcgagcgaattatgcctgtttggagcatggtggtgacttgtgcctcgatttcttgcttctgacaatatgggtacctatagggcttgatgttgactggggtggatgtgggagtgaggtgaatgcaatgattggttggtcgagacgggggtatgggagagcagacgcagatatgaaagaattcactagcaccgtcggtctaaaccaaacgacgaagttgcatgggagagacagcttcaaggtctcgggtagtgtcaccgcggagctcgataatcttcccatgatgaacgaatttcatggtgagggtgttataatcagtcaggattggcccaagggatttcaaccagtgcacatcgaggaccacgtctatgccacatatcggcaagacatggaagtctgtggtgaatgcatggccctcttgcacgaagttgtgcgtgctcctgccgtcgaccaggatcacgacgggctggttcgcaatacagcccaacatgcgatttgggtgagggctaagtatataagggtttgggggttccttaagacgctcatcatctgcgatgaggatgaagaaccaggaggtgttaggcatttcaagggcacaaatggaggtttaggtggagtgggaaacaagggtagggttagagaagaaggtgagggcagagagaaaatcgaggggttaggtggtgggagtggcggtggaggtcctgtgctcggggcgggacgaccgcgaggtttggccgaggatgacaagggtgagtgggtggagttgcgtcttcaatacggtcgagactcgacttgtcgggatcagcaatggaaggcggaaatgaaagcaccaaaattgttaagggcaaaagtaaaattcccagcttttgagacccagtgcgcgatggttgttatggtaggtggaggcacagaagaagaagaagttttgatggcaagagaagaaggagaagctattgggagggagattcaaagaatgaagtatgatgttgctcttttagggtaa

SEQ ID NO: 38900 - DNA, 378 bp, Glycine max
  Peptide Sequence Number=SeqID_130585
atggacgacaaccattgcccaacaccttcaaggctcttcaagggcaaaggagcagaaagaggagttgaagaaattgttgcccttgagctagaggcgaaaggacttgagactcaagccatcaaagttgaagactcttccaagttgagtgatgaggaggcttgtgatgatgtatttgaggtgcatgcatccagcttcaatcaccaccttcatcaagtgctttttcattgtgacgtgccagatgagtccatctttaacatggataaggatgtctataatgggcaattgattcccattgatgacattcccgaagatggggcttctattgctgaattgtcgacgacccctcctgtagcgacccatatgaccaacggggtttag

SEQ ID NO: 38901 - DNA, 363 bp, Glycine max
  Peptide Sequence Number=SeqID_130586
atggcagatcaagaaagtggacatcaagatacaactcctgttcttggctatactctttcaccttctcctagtccttgttatactctttcaccttttgctggccatgtcccttcagcaacaccaaatgaatccattcttccacatgaagcagaagaaatagctgataatttggaggggacaacacaaacaggaacaagtaggcttaaaaggagtacaaggcaaacatttctcgtgcctaaggtcatccatggaaagcaagaattaggtacaaaaacttatgatgcagataatgcaaggacaaagcttgcaaatgcaattattatgcatgggtatctactttccattatggatcattggttttag

SEQ ID NO: 38902 - DNA, 345 bp, Glycine max
  Peptide Sequence Number=SeqID_130587
atggcgaggaggatcgggggcgaggaggcggtggaaaagaggaagatggtggggagggagagggagaggaggaggaggtgggtgaggacggaggtggcgaggagggggaggaaggaggtgaggatggagaggagcgcggggaggagctttacggggcggccgaagaagccgtggaagacgctgtgggtgatggaggccagggcgaacaaagagaagaacactacaaagaggaggaagaagagtagagggaatgagaacgggaacggtagtagtggaggaggggtttcggttagggttagggttaggggttggggttgggtttggcggaggaggatgtggatgtga

SEQ ID NO: 38903 - DNA, 1872 bp, Glycine max
  Peptide Sequence Number=SeqID_130588
atgaggaaacatggatggcagttaccttaccatcctcttcaggtggtagctgttgctgtgtttctggctctggggtttgccttctatgtgttcttcgctccttttgttggaaagaagatgtatcagtacattgtcactggcctttactcacagctgattattagtgtctttggactgtacatatggtgtgcagcagcagatccagcagatccaggggtttttaagtccaaaaagtatcttaaaatcccagacagtaaaaagcttgctgaactaaagaattctaaactaggtgaagaatcaacttcatcaatgcatgaagcaaatgcttcaatggttggatctaattctgtggataaagaggcattgggaaaaatacgaacttcaaaagatgcttcgaattcagtagagaagagtacatcatcgtcttgttcatcctgtatcctcttggtttcttctccttgtgcatatatctgcagctgctctagtccaactgagaaatcttctgataaacaaacaagtgaagatggcatgttctattgcagtttgtgtgaagttgaggttttcaagtacagcaagcactgtagagtctgcaacaagtgtgtagaccactttgatcatcattgccgatggcttaacaactgtataggcaaaaagaattatcgacaatttttcaccctcatggttgcagctatgctcttgtttattcttcaatggttgactgggatacttgtgcttatctgctgttttgtcaagaggaaggaattttctgtggatatctcctccaagttgggaaccagtttctctttggttccctttgttcttgtggtgtctatctgcaccattctggctatgattgctaccttaccggttgttcagcttttcttctttcatattctcctcattaacccgggactcagcacatacgattacatcatagcaatgagggagcaagagcaggagcagctaggaaatggaggtcagcaaagtccccaaatgtcaactgttagctcatttactggattgagtagtgcaagctcctttactactttacaccgaggtgcatggtgcacaccccctcgcctgttgcttcaagatcagtttgatgtggtgcccccagaaacagcatctgtaagttcagtggggaagaagacaatgagagaagatccattaaagaaaaagaatcctggaacagtcaaaattagtccttggacattggcacgcttaaatgcagaagaaatttctaaagctgctgcagaagcaagaacaaaatccaaagttctgcagcctgtaacaagacatggtgaggctatcaggctagaaccagaaagcagttttagtagcagtggccgaagaatggttcccagaattgagagcaataagaaaggagctagtaagcggattcatcatcccgccaacttgtctatggagtccttgacaaaagtttctgccagtaatactgataaaggcttgagtgggatgtctaggttggcccctctcccatttgaagcacacaacacatttcaaacaagtcaaccaatgtcaagctcagctgggattgttccttcatctcctgaaagcagtttagactctcctgatattcacccttttagggtgtcttcatcaggtgctgaaaaagcaagacagcttgcagttgcaggtgcttcaggtgctggtgctgcaactctgaaggaaatttcactgtcaggttcaactagtgatggatatgaggcttctggtggggaagatagtgaccgggttgttccttttaggattgttcagagatctacaaattggactaatcttttcagagctgatcaggatgagagggcttttaaaaagcctcaatcttcaaccattgttggtcatagatag

SEQ ID NO: 38904 - DNA, 270 bp, Glycine max
  Peptide Sequence Number=SeqID_130589
atgtcactacatgttgatgggttaatcacggtcactatggataactggatggatataaccaacatgggatatgtgattgcatcaagatataatgtaatccttgtatccttgtctcaccaacaaagcacgacgttctttcctcttagatttcaaccaccgggagatccttcggtgcatcgcataatttgtatcggtcacgtctatgacaatcattttgttcagatttatttgaaagatcattgtcctttaccgccgatagaatacaaataa

SEQ ID NO: 38905 - DNA, 402 bp, Glycine max
  Peptide Sequence Number=SeqID_130590
atggcacaatgctgccatttacgcattctctcgttccgttgtgtctccggtgcgcagtgctttccccgttttgttcgtttcggtgaaggtaaaggcggaggtagcggcgatgtttggtgttgcagtggtcgtcgacgatggcatatgaggtacgcagtgttggatgcgttctggtgtactgcgtttcacgcggatcaaatggacgaagatcagtggatgtatgaacgtataatgcctgaagaagtggatatggatgatgaaaatgaagaagaatgtggtgtgaatgaaccacatgttgattgttcggatgcattcaatacttctcaggtgtttgatagtcaagagtatgttttgcggtgggctcgatctgttgctctcatgaaaatggatttgtggcgatga

SEQ ID NO: 38906 - DNA, 294 bp, Glycine max
  Peptide Sequence Number=SeqID_130591
atggttggagtgaagggttttgtgatttcagattccaagtgtgaaagaagtattgaacagattgcgagggagggaaaattacccgatactgaaatggacaaggaagttaagggtggcttggtcatgatgtggaagggatcgatcaaaggggaggttatgagtttagctaagaactttattaatctaaaagtcatggatgaggttacaaggggatggattcttataggtttctatgggattcctgattgtgacaaaatgagggagtttgtgggagttactgaggagtttggctag

SEQ ID NO: 38907 - DNA, 642 bp, Glycine max
  Peptide Sequence Number=SeqID_130592
gggggatttaagcaactgaaatcgttgttggggctagcgatttacccatctcaagcaaatcgccagtttgactggcgattccctagtcctctgcgcgctgcaactgctcatttcagcaatagtgacaaactctccagtgcaagtggcgagatgcccttccacatgaagtcgccagcagtgctagcggtttgcccagacacgtgtcgtgttgcagccaaatcgctattggcaatggcgcaaaccgccattgccaatagcgatttggctgcaacacgacacgtgtctgggcaaaccgctagcactgctggcgacttcacgtggaaaggcatctcgccacttgcactggagagtttgtcactgctgctgaaactgcagactgagcaactgcagcgcgcagaggaccagggaatcgccagtcaaactagcgaattgcttgggatggaaaaaaagaaggaagctcttgttggtgtttgtgtgccggagaccatccacgcaggaaagaagaaggaagctattggtgtgttcgttgacgaactcgccaatgcaagtggcgagatgcccttccacgtgaagtcgccagcagtactggcagtttgcccagacacgtgctgtgttgcagccaaatcgctattggcaatggcg

SEQ ID NO: 38908 - DNA, 1569 bp, Glycine max
  Peptide Sequence Number=SeqID_130593
atggaggagaggaagaagtatgtgtgcaagtattgcagcaagaggtttccttgtgggaagtctctggggggtcacatcaggacccatattatgactgaagaaagaagcaacgatgttgttgttgttgatggtgatgataacaatgacaacatgttcatcaagttggatggtactgtgatgaggaataataagaagagagatttgttatggtgtgaagataataacaaccccatttatggcctcagagagaaccccaagaaaacagtgaggtttgtgcattctggtggtggtgccaatgccaacaacaatgaacagcaacagaataaggaggataagaggttctgcaaagagtgtgggaaaggtttcccatcactgaaggctctctgtggccacatggcttgtcactcagagaaagagaagagaacaacaacaacaaccatcaagtttgaagaagagaaactggttatggatagtcgttctgacaccgagacttgtgctccaacaactcatccaaggagatccaagagaatgagggtgaagaagaccattaacctttccaatcacaacccttttttttctttttcttcttcttcttcttctggtgttgttcctttggccaatggttcttcacctgtgtcagaggtggagcaggaggagcaagaagaggtggctaggtgcttgatgctgttgtctagagattctagcttcaacttcaagggtggtcgttttgcttcggttactgaatcttctgataacaactcggttattctagaagcaaaattatcatctcctgatacccggattggtgtcagcaatggtaataataacaacaactttgtctctaataatcatgcttatgatcttgtggcgaagaagttgcttaaggttaaggatattaagtttaagtctgctgagtttggtgcttctgataattattcaggttctagatttttcagatatggtcccaaaaccaaaatggtagactcagatttctcgaatgatgaattcaggtggtccaaagtggagggtaagtcaagcaagtacactgcatctgtagtgaagaaattaggggtggaagatttggattatgatacaacacatggaactacaaggaagtttgattcaataaagaggaacaactatgatttagttggtgtttctagcaagaagatagcaagtggttttggcaatgaggtatataagaatggcacaagaggttggaagtatgagtgttttgaagttgaaagggacaacgattcttatgattcaatagatgatgagagtaatgaaaacagttcagagactgaatcttttcctgctccaaggtctcatcataagagtaaggctctcaatggaaagaaatgcacaaagcccaagaagaagttgaagccttctaagaaaagcaaggatcatgagtgtccaatctgctacaaaattttcaagtcaggccaagccttagggggtcacaaaagatcacatttcattggaggttctgaagaaaacactatggtgatcaaacaagttccttactttattgatctcaatctacctgctcctgttgatgaatag

SEQ ID NO: 38909 - DNA, 87 bp, Glycine max
  Peptide Sequence Number=SeqID_130594
atgtggcctcaagacagccagcaccagaggcagccaacgagaatcaaatcgcatataaacaacagaactgtactaagttttttataa

SEQ ID NO: 38910 - DNA, 1960 bp, Glycine max
  Peptide Sequence Number=SeqID_130595
atggcaaaggaggccataccaataccaatagggatagttcttgatttgaactcctcaattggaagcatgtctaatagctgcatatggatggcataccaggatttctatgaacgtcaccctcattacaaaaccagacttgctcttcaaacccgagactctcgggataatgttgtcacagcagcatctgtagctcaagaattgttaaatgagaaggtgcatgcaatcattggaccacaaacatcagaacaagcttggttcgtcatagaacttggaagcaaagctcaagtgccagtgatctcgttttccgccacaagtccatcgctttcctcgacccagaagccttatttcattcgcgccgccagggatgattcctcccaggtggaagccatagctgccattgtccaaggcaacggttggcgcgaaataatccccatatacgaagacaccgaatatggcaatggtcttaacccatatctaaacgatgcctttgtaaaaattggcacccgagtgccttacagaagtgtcattagtccaggctcagggggcgccgagatttcaaatgagctcaagaagctgaacactgaccttgggtgcaaggtgtttctggctgcaaagaaagaagggatgatgacaattggatatgcatggatagttactgaaggcctatctgcagaggtagaccctatggtgctaaaatgcataggaaccatgcaaggtgtgttgggagttaggccaagcccaaaacacactaaaaggcttgacaacttcaaagaaagatatggaaatactgtaaccatctttggattgtgggcatatgattctgtttgggcattagccaaggctgtggagaaagtttggggggaaaacgtcactgctacccttcacaacacaatcctggctaccaaattccatggcctctctggtaatttccatttggttaaaggacaactagagccatcaattcttgaggtgttcaatgttgtggagcaaacagagaggagcattggaaattggatgccagagagggggctttctaaattagagcaaccaaaatggcctggtaacacaacagagcccccagcaaagttgaggattggaatcccaccaacaaatagtgtcaatgaattcaaaaaatttctcaacttctcctttgatgtgttctttgaagtcttgaagaagtatgatgccgtggttggggacgtgacaattgtggctaagcgctcagagtatgttgattttacaatgccattttcagaatcaggtgtggcaatgctgctttcatcttcacaggcttcatcgtttggtttttcgaacaccgctcaaacacggagttcaggggcactccaaagaaccaaatcggcatggctctctggtagagaacaaatggtcacgatttgtgctgattatatggttctttgtggtactcatcataacgcaaagttacactgcaagtttagcttcaattctcacgggctactaattgaaaagttaggattcaatgaatctaagttaaagggttaccatggccctaaggcctatcaacaagctctgtctcttggaagcaacaatggaggagttgctgctgtttttgatgaaattgtctttattaacctctttctcatgaaatatggctgcaaaaagtatcagattgttggaccaacatacaaaaccgatggatttgccttcgcattcccacgaaactctccattggttccttatttttcgaggtcgatcttaaacgtcactgaaaataaaacaacctttgatgggattaagaagaagtacttctcaagagacgtcataagtgaagatccaatcatggtccatttgtttaagttcatgcattcaaaatggactgctcgagactttcagcgatccctttcggagatgatgactgaattggcaaagcatttcaacaaagaagagtgctctttacatcctcctccaataatggaggaag

SEQ ID NO: 38911 - DNA, 1197 bp, Glycine max
  Peptide Sequence Number=SeqID_130596
atgatctcagcttattttatcgtatccctgctgaatgcagctagtatattaaagtatgatttctgtttcaagttagcaattgtttacaaatgcctgaagggtggaacagtgcggcgatttcttgagaagcagaaaaacaacataatagctgttgtcttttgcactgtgagcacaactgatactgagatatataaaaggttgcttcctctgtactttcctcgggataaacatgaggagcaagttgctttgtctaaacttcctgcagatgttggggatgaaaatggtgagacaatctcagatgagcgtaaaatcagaataaagcctttgcccaaaaggatagtttcaagaccacctgaatttccagctgatcatcctgttagtgatgtcggcttggttagcaggaattcatcacatttagattcatttctggatcctgccttcatgtccatgatcaaagaccccgatcaacggcggatggagcagtgggagaaaactgctgaagcacaaagaggctggaattgtgctaaattgattggatatggcgaccttggtggaccctcattgtctgctgccgaagaatattctctacactctagatacctgtctaaagcaaattccttaaatctttctgaaattgcagaaatgaaaattgttataaatactgctcttgtaagagattacagtgcctttgtaatattttctcaatgcaatatacaaatctcttttctcttctctatactttctacatggtatctagagctctctgatccattttcatggcttccgcaaatactgatgcaactttggttaacaccggcgacactggtgcgatctgactccagcaaacaacaccggtgcgactctgtctctagcgaacaactccggaacaagattagtttctccttgtttggcttcagtcaacgctctcgagctcgatgcttgctcgtgttcttggatagacgtactcgtatcaagtgtgggacaagacccaagttttctgattttctctcttacatcaaagagcttattgatgcacttgcttcggttggtgatgctgctacctatcgtgaacacatggatgcaattcttgaaggtctacctaggaattttgactcaacgattgctctaattgagagtcgtctaccacacatcaccattgaagaagcggaaggttacattcttgtgcaggaactatga

SEQ ID NO: 38912 - DNA, 249 bp, Glycine max
  Peptide Sequence Number=SeqID_130597
atggcgaagaacgagaggaaggtgaagagaatggaggtggaatcgtggctttgtcgcgccggcggcggcggcgacagaggagaagccgttgttcgttgctgcaaatccatggcggacgacttgttcttgtacatcagggctatggatccaccacttgtaggatcaagcactgcccgggagaggcttgatggtattgggaagtcaacgcgacagccgactaaccctgtgactgagaaagggaaacgatag

SEQ ID NO: 38913 - DNA, 1074 bp, Glycine max
  Peptide Sequence Number=SeqID_130598
atgaatagggttttgcttccttcagcgtcaccatccttccaaaatagcttatccattctgcaccaagtccctgaaggccatgtgggggtatattggagaggaggtgcccttctgaaaacaattacagagccaggtgctaaatactcctttgatttcttcaatgtatacaagcaaaagcgtttgcttcatgttcttcgtattaattttccaggcttccatctaaagatgccttttataactcagtatgaacctgttcaagttacacttcaaacagatatggtgatagatataccctgtggtactaaaggtggtgttatgatcagttttgggaagattgaggttgtgaatcaactccataaggaatttgtctttgagacattgctcaactatggtgtacattatgataagacatggatatatgacaagattcatcatgagattaatcagttctgcagttctcattctctgcaacaagtctatattgatgtctttgatcagattgatgaaaagatgaaagatgctcttcaagttgactgcactcgctatgctccaggaattgagatcttaagtgtccgtgtcacaaagccaactattccagaaagcataagacgcaatttcgaacaaatggaagaggagcgtactaaggtcttaatagctattgagaaacagaaagtatccgagaaggaggcagagactatgaagaagatggccattagtgaggccgagaagaatgccaatgttagcaagatccttatggagcaaaaattattggaaaaggatagtgctagacgacaagaagaaatagagaatgcaatgtacctggcacgtgaaaagagcctggcagatgcagacttctaccgtgtaataaaggaagctgaagcaaacaggttgaagctcacccctgaatttcttcagcttaaatttattcaggccattgctaataatacgaagattttctttggagataagcttggtctccaggttcctaatatgattttggatcagaggctgcttgggaacttacttcatgatgtttctagagggagaactacaacggccaaagcagatatctga

SEQ ID NO: 38914 - DNA, 2100 bp, Glycine max
  Peptide Sequence Number=SeqID_130599
atgttcccaatttcaagagtcctccgcgtcaccacaaaacctcgtcttcactggaactccctctaccaccaccatggacaaaaacaacagccaccatcacctccaacattctacctctcccgcctctgcacaaatctcccctccctcaaaaccctccacgcctccttcctcatccatggcctcaccaacgacctcctcctctccacaaagctcctcagcctctacgcctccttcggccaactccgccacgcccgcaaaatcttcaaccatctccccacgcgcgacctctactgcttcaaagtcatgatccgcgcctacttcctaaacgacaccccctccggcgtcgtttcgctctaccgcctcatgcgcctctccctccaccccaccccgcacgactacgtcctcttctccatcgttttcaaatcctgcgccgagtcgcgcgacttccaaaccctcacaatcacccactgccacttcgtcaagtctctcccctccgactccttcgtcctcacgtgcctcgtcgacgcgtacgccaagttcgcgcgcgtcgacgaggccacacgagccttcgacgagatccacgaaaacgacgacgtcgtttcgtggacctccatgatcgtcgcgtacgtgcaaaacgactgcgcgcgtgaggggcttaccctgttcaacagaatgcgagaagcgtttgtagacggaaacgagttcactgttgggagcttggttagcgcgtgcaccaaattgaattggcttcaccagggaaagtgggttcatgggtttgttattaaaaacggaatttgtgttaattcttacctaacgacgtcgcttttgaacatgtatgttaaatgcgggaacattcaggacgcatgtaaggtgtttgatgaaagttcttcatcctcttatgatcgtgatcttgtttcctggacggctatgattgtagggtatagtcagagaggctatcctcatttggcactagaattgttcaaagacaagaaatggagcgggattttgcccaattcggttaccgtttcgagtttgttgtcctcgtgtgcacagttaggtaactctgttatggggaagttgcttcatggattggcggttaagtgtggattggatgatcatcctgtgaggaatgctcttgttgatatgtatgcgaaatgcggtgttgtttcggatgctcgttgtgtgtttgaagcaatgcttgagaaggatgttgtgtcttggaactcgattatctctggctttgtgcagagtggcgaggcttatgaggctctgaatcttttcaggagaatgggattggagttgttttcaccggatgctgttactgtggttggcattctctccgcgtgtgcttcacttggcatgcttcaccttggttgttcggttcatggtttggcgttgaaggatggcctggtggtgtccagcatctatgttggcactgctctgctgaacttctacgcgaaatgtggggacgcaagggcagcaaggatggtgttcgattcgatgggggagaagaacgcagtgacttggggcgcaatgattggcggctatgggatgcagggcgatgggaatggatcactcacattgtttagggatatgttggaggagcttgttgaaccgaatgaagtggtgttcacaactatattggcagcttgcagccactcagggatggtcggagagggttcaaggttgtttaatttgatgtgtggggagttgaattttgttccttccatgaagcactatgcatgtatggttgacatgttggcacgtgctgggaaccttgaagaggcgttggattttattgagagaatgcctgttcagcctagtgttagtgtgtttggagcttttctccatgggtgtggacttcattctaggtttgagttgggaggggcggcgattaagaagatgttggagttgcaccctgatgaagcttgttactatgtgcttgtgtcgaacttgtatgcttcggatgggagatggggcatggttaagcaagtgagggagatgataaagcaaaggggattgaacaaggttcctggttgtagttcagtggagatggatctccagaatgatagttatgctaaagtagcagttgtttcttaa

SEQ ID NO: 38915 - DNA, 321 bp, Glycine max
  Peptide Sequence Number=SeqID_130600
atggcaggagctggtgacaatggtggtgtatatcatcaactggacggatctcagcgcttattactggaagcgatgactacacaaatacaacgtttgttgaaccgtaacaatgaagagctctacaggcgaatagaaggactagagcaccaaatgaatccaaatgctgggagaccttatggtggcaacaacggtacatccactaggttgttcaaagaaaacaatggagggtacatcccttatggatctttgcttgtaaaaggatttttacaaagttggaaaagaaatctcaaggaccgtaggtcgcttgaggactggatgtag

SEQ ID NO: 38916 - DNA, 810 bp, Glycine max
  Peptide Sequence Number=SeqID_130601
atggcccggttttccactcatccatcttctcaactccctttcatctggtcatccctttcatttgtcttccttatggctcctgaaaactgcaaagcaccttcatattcagacgctgcagaaagtttttttagaatttttcctctctcaatcccaaatctcccacccaaatcaaatcttaagtcaagctcgaatcactggaagtgcctacaacgtgagtttgatggtaggaaaggtgttaaagaccagataaatttgtattggaagttttgggatgtgtctgaagcttctgtcagcagaaaccgtagcactataattgttcctgctggaagctccagggatgaaggatgggcagcattcaggaacgttttggcagagatcaatgaagcctcaaggcttttcattctgcccaatcagcaaaattctgaatcctcagagcgtcttgttggactttcggatgatgttggtgctggcttcatatctggtcatagtactcaacctgccacttcttctgagttgaatgtggacaggtctgttgatttgccgcctcaggatgaaattgggaacttgggggtctcaaaagtaatcagggctgatcagaaaagattcttctttgatcttgggagcaataataggggtcatttcttaagaatatctgaggttgcgggttctgatagatcctccatcattcttcccctgtcagggcttaagcagtttcatgagattgttggtcactttgtggaaatcacaaaggaccgaattgagggaatgacagttgctaatgttcgcacagttgatccccctcaaagatga

SEQ ID NO: 38917 - DNA, 846 bp, Glycine max
  Peptide Sequence Number=SeqID_130602
atggaggaagcacaaatttggggtaaggggaagctgccagcatttgtgggggaagacccaatttgttggattgctacggcagaaaattcagaggtacaagaaattccttcattccataagctacaatatgcattcatgagcatggagggtgctgcgatgcattggttctacatttggagccaaaagaacccagattcagattgggagtcattttccacagctttaaaagattcagagatcactatgaggaccaacattttagaactgaaacacatgctgcacaagttattgaatgaagaggctgatcctcagtcaactgagcaagaaaaaaatagcatggagggaagtgggtctgaatgcagtgaagcaaaagcctcttggacaagaaagaaatcactgttggacccaaattcgatcatgaaggtggttggaacatcaatggcattgaaatcttggaatttcaacttgctgggtgatcctttagcattaaactttgttgcatctatggctgatagcttagatacggagctaaggcataaggaatgtactgagtcgtggttcactgatgaggacatgaccaagagcaaggacaaggatccacttggaggacctatgacaaggactagagcaaggaaagtcaaggaagcttttcaacaagtgttgtccatactatttgactacaagtccaagtttcaaggagaaaagttcaagtggtctttcgattctttcgggaaagcacccactgatttgacccatgaaagtgtctcccaccacaaggggagaaccttactgcaattgaagaaacggtgtgctgcatcctcctccgaatggaggaggactaaatga

SEQ ID NO: 38918 - DNA, 1464 bp, Glycine max
  Peptide Sequence Number=SeqID_130603
atgatgacatataacaacaacaacaataacaacaacaacaacaacaatcagttcattgttgagggagcatccctcacgaggccaccaggtttcataggagaagactatccttactgcatcaactatgaaggaacaaaagatgttcaacttagaaagcctgcaactctaacacatcaatacgaaagtttctccatgaaagaaggagaatatgcggatgacatgtttggaagagttcaagtgcttctgaatggccttaaagctctaggacacacattcaccaaaggtcaaataaatttgaagattcaagacagttttcccaagaacatgaagctgctcattgctctgcttctggtgttgtgcgcgccgttttcatcttcttccaaacccaaagacccgttcctcggaatctcccccgaagatgacaagtattacaaggcttccgatgtaataaggtgtaaagatggatccggaaaattcaccaaggcgcagctcaacgacgatttctgtgattgcgctgatggcaccgatgaacctggcacatcggcatgtccgggtggaaaattttattgtcggaatgcaggacattctcctgtttacttgttttcatctagagtgaacgatggaatttgtgattgctgtgatggaactgatgaatatgatggtcaagtaaagtgtccaaatacctgctgggaggctggtaaagttgctcgagatagactggaaaaaaagattgccacttatcaagagggcgtcaaattgcgaaagctagaaatggaacaagctaaagtagctatggagaaggatgaggcagaactttcaaaactgaaaaaggaagaaagtatacttaaagggattgtgaaacagctaaaggatcataaggaacaaatagagaaggcagaggagaaggagcgtttacagaaagaaaaagaagagaagcagaaaaaggagtctgaggagaaagctaatgaagcaaaagataaagctgatgaagatacagggcatagaaatgaagctgaaaagcattcagatgttgaagacaattctgtagaaaataaccatgataaaatagaaaatctagagggttctcctgccgatcaggatgaagcaggggacaaattagaagatgtacttgataacgatgatgaagccagtgatagtcctgggagtgaaggatctttgcataataaagtggaagagaatgcaaaagaagctgaggaagaacctattgtgaaatctgaaactgatataaaggtcggaaacaaagagtcttctgctgaaatcatcaataagcacttaaagaatgtcaataaagaagccgcaactcttatagatgcaaaagaagttgcaggtaccaagctttcacttatagcaccaaggtttagggcagccattgttccaagacaactcccaggctcaagtctcacatcacagcaacacaatagtggtcacaggtctattaggtaa

SEQ ID NO: 38919 - DNA, 1269 bp, Glycine max
  Peptide Sequence Number=SeqID_130604
atgttgggtggtctatacggagaccttcctccaccttcttccgccgaggaagacaacaagcccacccccaacgtctggtcctccagcaccaagatggctcccgccacgctccgcaagcccgcctccctcttcgcgcccccccaaaccctcctacgggcccaccccaagcccaagcccaccgccaagcccgtcctctcctccaccacccccgcccttcccccggaagactcccccctccagcccgccctcgttggcgtccagtccaccgtcctcgaggagtacgacccggcccggcccaacgactacgaggaataccgccgcgacctcaagcgcaaagcccgcgaggccgagatgctgcgcgagctcgagcgccgccgccaggaggaggaagaggaagagaaggaaagggaaaaggaaagagaaaaagagagagaaagagactacaacaacaacaacgattcttcgtcgtcgaggctgaatgtttccggcgaagaggcgtggaggaggcgcgcggcgatgagcggggcggcggcgggggcgccgccgagatcgccgtcgccgccgctgccggggaattcggacgggtttagcatcgggaagtcggagaccgggggattgggcgtcggggctggcgggcagatgacagcggcacagcggatgatggcgaagatggggtggaaggaggggcaggggctggggaagcaggaacaggggatcaccacgcctttgatggcgaagaaaacagatagacgagccggggttattgtgaatgccagtgacaataatagcagcagcaagaaagtgaagagtgttaacttcaatggtgtgcctaccagggtgctgctgctcaggaacatgttgccaattgatttggaggttgctgccttagatgaactgattcatattaaatgtcctacctttgtttatctgacaatgtctctgagggttgacatgcaattgccacacttgaaggtgggtcctggtgaggtagacgacgagcttgaagatgaggtaggatcagaatgtgccaaatatggaattgtaacccgcgttctgatatttgagataacagagccaaatttccccgttcatgaagcagtaagaatctttgtgcagtttgagagatccgaagaaacaactaaagcacttgttgaccttgatggtcggtactttgggggtagagtggtgcgtgccacattttatgatgaggagaaatttagcaagaatgagttagctccaatgccaggagaaattcctggcttcacctga

SEQ ID NO: 38920 - DNA, 1635 bp, Glycine max
  Peptide Sequence Number=SeqID_130605
atgatgagtggagggactagtgagcggagccatggtctggccaaggagaaacacagtgaggagagggagatacaagggaagggaaaaagagtagatactgaagagaagaaagaatacaagaacttactaagatggaagatgaaaactttgtcaattttcaagacaatccaaaaatgggatgaagatttggggttagcaaatagaaacaaagaatttcttgagagcagactatgcttgaattatggtgttcacttcgtcccttcagatgatatcttcatcgttaagggggtagttatagatctgacaaagatcgtgtttcaagtgaaggaagattgtggaagtaggaggcagatcgaaaagcacaatggggcattcaatggagtacaagctttggttgacatacatgaagaaacaaagaatttctcacgagtggactgtgctcagattctagataccattgtggtgcactttatggactttgatctggaggaagataggaataaagaggggttatggaagcaggaggcagatcggaaagcacgacaaggtgttcaatcagagaagaaacatttctattcccactggaaaagcagtagtcaagttaaaggaggaggcagatatgaacaacaaggaaagcagttgggtgtaactggaattgggaatgcaaaagaaaaagatgggcaaggaatgaagcttgaggcgaaaaaggaaggtagcgtaaaagacaatgggactagggataattttaaaaatctgaaggaagatttagtgactgttgaagatacttcattggtggatggtagaagtgggcctaaagcccaatatcaaaagaagaaggtagattttaagaaggcttattgttccctctcgtgggaatttttattatacatgctaaagagtcctacacaagaattcaaatgctccaaaggtcttacgcaaggagtccctttggtaccatttcttttccttggggtggccgaagggttgagtggtctaatgaaagaagtaaaggtgaaagatttgtatatggctacaaggtgtggatcatgggatggttatctaaatttgtcgaattgtaaaactttggaattgccttttatctatcttggtttgccaattggagggaaccctagaaggttactgaaagaagtttggaggaagcttgtgggtatggaaaggagattcttatggggagggaatgatgagaataaaaaaattgttttggtgaattggaaggaggggcttatgagggatggtgagctttcaagggatcctttgtggtggagagatttgaagaaggtttgtgggggatggtgtagcaagaaatggtttaaggagagaactaagtggaaaattggtgtagggggacatatggtgttaggatttaaaatggagaagggagtgtttgagtcagaaaatagattatttcaggactttaacaatgttttgcaagctatccaggtcataaaacatgttgcagattcttggttttggaggcctatctcgtcaagtgatcacacaacaaattcaacttatgttttgtcggttcaagccattggtgaagacaacaacaatgatctcatttcccagacttggagcatcataattccaaacaatgtcacttttcttatatag

SEQ ID NO: 38921 - DNA, 279 bp, Glycine max
  Peptide Sequence Number=SeqID_130606
atgagccaatatgttgtaattcaaccagagattgtttcaactttaagtcaaatgttggatgagcacaatatccatgcaaaaagtttcagaatggccagggacagattggcagatagtcaactagatagtgtaaaattgagattgatagctggacatgaaaaagatggtcatacatacaatctaccagatgtttctgaagttgctaccttgattgttggtgattttgatgccgactcaagaagggatattcttgttgaaactcaaaatggagaattataa

SEQ ID NO: 38922 - DNA, 540 bp, Glycine max
  Peptide Sequence Number=SeqID_130607
atggactacggaaggttgggaccctctgatcttggtggctcctcgcgcctcaactctctaagatcttccgggaggaaaaagattgtgttgctgtcactctttgctgtcttaataatagtcgcgtccactgttactgcagttgtcgtccgctctcacactaaaaataccagagcggatggaactagtctcgagaagttcacaaaggcgatttcaagtgagatcgatcgtttcttagcattgtctctttcaaggggcatctggaaaaggagggtttgccggataaacacacatctgagtcttttgtctctctctctctctgggaagaacaaagcagaagaagcaacacagaacagaaccaccgaacccactcagaaccacaagtgcttcgaagtagcgtcgcgaaaaaccgctccgcaacctgcgctgctccaccacgatagtggccgctccagccgtgacccaaaaccacgccgatacacacgtgtccgtcgcggatgggtgtcactccgccgctatagcggccgctacagctgctattga

SEQ ID NO: 38923 - DNA, 510 bp, Glycine max
  Peptide Sequence Number=SeqID_130608
cctataaatcctcctcctccttctgctaccattcttggtcgtgtcctattagacggtgcaccctcaccctgtgctgcatgcaagctccttaggagaaggtgtgctcaggactgtgtttttgctccttattttcctgctgatgagcctcagaagtttgcaaatgtgcacaaagtctttggtgccagcaatgtcaacaagatgcttcaggacttagcagagcatcagcgaggagatgcagtgagcagcatggtgtatgaagcaaatgcaagagtgagggaccctgtgtatggctgcgtaggggccatctcatctcttcagcaacagattgatgtgttgcagacccaattggccgtggcacaggctgaagctgtgcacctcagggtgcgccaaactgcatcactctacagccccactagcccaaccaacagtggctctccatcacaagccaagcctatttttgacatggacatggtggtggaccagaacagctatggtgattcaatgtggtga

SEQ ID NO: 38924 - DNA, 507 bp, Glycine max
  Peptide Sequence Number=SeqID_130609
atggtagaatcctcaaagaagagaaaggggtcatcctccaccagcatcgctgcaggccaacgccgccacgacacatccggtgaccaaccagcaccacctcctccttctttttcttctccaaggtcattgactctattttctttggatgaccagcatcaaagtcagggtgttccttttgatggcactctagttgatgattggaagtatgcctattctagttatgatgctcgtaaaatggtctataatgaccatgctgatatgaccgacaaattgcttgctggctcattcacctttgaatgtcacattatgcattatatcctttgtcgagttttgcttccacggtcctcaaattttgctcaggcctctgaggaggatttaatcttgctatgggctcttcaaaccggtcgccaaattgactgggcccatcttgtcaggcaccgtatgcataaggcattacgggctaatgcacctcttccgtatcctcatcttgtcactctgtttctttag

SEQ ID NO: 38925 - DNA, 522 bp, Glycine max
  Peptide Sequence Number=SeqID_130610
atggtctgcaatgacaatgctaatatgaccggcagattgcttgttgggtcatttacctttgagtgtcgcatcatgcactacgttctttgtcgaattttgcttcctaggtccactaatcttactcaggcctctaaggaggatttaatcttgttatgggctcttcaaactggttgtcagattgactgtgcccatcttgttcggtaccgaatgcataaggcattacgggtcaatgcacttcttccgtatcctcatctagttactttatttctccagcatttcaatatcccctcagaagatgaaccttttgtcaaggttaaacggtcttttgctattggtgttggtactgttacatcttttggatatcagaaagatatggatggccaatgggtgttcctcactgagctacgggatcttagagcttttgtcggcgatcgctttgatacaatggactcccgtatcacccatcttgaagacaatatgagtttcatccggcgttgctttgatccacctgccgattcttag

SEQ ID NO: 38926 - DNA, 336 bp, Glycine max
  Peptide Sequence Number=SeqID_130611
atgaccacagagcacagagtgagaaaagagctccttgatgctggggagcttcttggcaaccccaaagtagcggtatcaagggccacgctcgcccaggttcgggacatcaacgatgattccattgagatttgttatcttcgcggagtgcttcaagtaatttggcctgtcaagctccacgatgcggcattcccagtgagactttttgctaatgaccttgttgatcttgtcattgagattgcggaggcagtgctcgtcgagacctctgttctggatctcagctacttttcggtcgatctctcgcatgactgtcgacctccaagaggttgcaaaacttag

SEQ ID NO: 38927 - DNA, 300 bp, Glycine max
  Peptide Sequence Number=SeqID_130612
ggtagaagacatgcttggtctagtttggtttttgatggttttggctgcgcgaggttgaagacgagccttcttccgcggaaggttcatttcttccgcgcgtgtcatcttccgctggagtccgcggaagaaacgatcttccgcccgacctccaacggcacccagacacgcgcggaagaaatgaaccttccgcggaagaaggctcgtcttcaacctcgcgcaaccaaaaccatcaaaaaccaaactagaccaagcatgtcttctaccctatggccatcaaaagcgattaaaggagaaaaatga

SEQ ID NO: 38928 - DNA, 606 bp, Glycine max
  Peptide Sequence Number=SeqID_130613
atgccgagaggaatgagcaaattaaatcatttacaacatctggatttctttgttgtgggcaagcaccaagagaatggaatcaaagaattgggaggactttcaaatcttcgtggtcaacttgaacttaggaacatggagaatgtttcccaaagtgatgaagcgttggaggcaaggatgatggataaaaaacacattaatagtttactgttggaatggtctggatgtaacaacaacagtaccaacttccaacttgaaatagatgtgctttgcaagttacagcctcactttaacattgaatcgttgcaaataaaaggctataaaggaaccaaatttccagattggatgggaaattcttcctactgcaatatgacacgtctaaccttaagtgattgtgacaactgtagtatgcttccttcacttgaacagctaccttctctcaagttccttgtttttacaagaatgaagattgtcgttcttggaggccctttccctcccttgaatctctgttcatttatgacatgccttgttgggagttgtggagttcctttgattcagaagcttttcctttgcttaaaagtcttagaatacttggctgccccaaactag

SEQ ID NO: 38929 - DNA, 534 bp, Glycine max
  Peptide Sequence Number=SeqID_130614
atgtccaaatcttgtggatttgggatgaccggccctctcgatgagtcgatctcttgctttctcataaggctggacccttgggtacttgacctatcaccgttgagaggactacgtgtcctcgccatcagaggactgcatgtcctcaacttcagagggctgcacgccctcgccatcagaggactacatgtcctcgccttgagagggctacacgccctcaccttggaggactacgcgtcctcaccaccagagggctgcacgccctcacctccagaggactataacgtcctcgccttgagagggctacacgccctcaccttgggtactagttacccttcaacttcagaggactacacgtcctcgccgtcaaagggcatgtgccttcacctttgtagggctacagccctcaccttcagaggactacacgtcctcacctttagaggactacatcctcgccatcagaggactacatgttccccattttcaaaggggggcatgccctcaccttcagaggattgcacatccttgccatcatag

SEQ ID NO: 38930 - DNA, 319 bp, Glycine max
  Peptide Sequence Number=SeqID_130615
ttggaactcttacgtgccgatcaacgtctcattttcgccaaaagttggcccagggcttcccggtatcaacagggacaccaggatttatttattctgcgaagtgatcttccgtcacagctgtccctcctgttcagctactgacggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 38931 - DNA, 768 bp, Glycine max
  Peptide Sequence Number=SeqID_130616
gatggaccctggggtactagtacccacaccatcagagggctacacgtcctcaccttcagagggctacatgccctcacctttggaggactacacatcctcgccttcgtagggctacacgccctcaccttcacaggactgcgcgtcctcgccttcagagggctgcacaccttcgccttcagaggactatacgtcctcaccttcagaggactacacgtcctcacctttagaggactacacgtcctcacctatagagggctacacgccctcgccttcagtggactatacgtcctcaccttcagaggactacacgccctcacctttatagggctgcacgccctcgccttcagaggactatgcgtcctcaccttcagaggactacacgtcctcgcttttagagggctgaacgccatcgccttcagaggactacacgtccacaccatcaaagggctgcacgtcctcaccatcagagggctgcacgacctcaccttcaaaggattagacgtcctcgccatcagagggttgcacgtcctcacatttagaggactacacgtcctcgccatcagagggctgcacgccctcaccttcaaaggactacacgtcctcgccttcagaggactacacgtcctcgccttcagaggactacacgtcctcgccttcagaggactacacgtcctcgccttcaaaggactacacgtcctcaccttcagaggactgcacgccctcgccttcagagggttgcacaccctcaccttcagagggatcctctag

SEQ ID NO: 38932 - DNA, 750 bp, Glycine max
  Peptide Sequence Number=SeqID_130617
gttgtcctcttcccgaacatcgacagtttggtagacttagccgccattgatgctttcctcgcatatcaccatagcaaggaaagtccagtggtggctatcttggcggatttgtttgacacctttgaccggagcgcgatcaattggtttcctcgttggaaggaaggcaaggaaggagttcttttctcgtgtggggactaccctaatgttctactgataggaactaggggcgcccaaagtctcaaggcgatacaaagagtccacaaggcgtggagaagtccgttgaggaaaggcaaggagcttaggggcatccgtaatggcatcatcggagttatcgatgaggaagactgtgaagcttcggaggaagatgaagaagtccgagctctaaaattagatttagggaaggcaagactcgccaaggagaagttcaagtcagctgctacacacatccggaaagagtgcaccgagttacaagaggaaaacgtggccactgcaaaagcccttgaacaagaaaccaaaagggcccgcaaggaggaatatggccgagagaaattccgaggagcattgtggggtagcaacaatgagctcaagctccgaagagaggagagagatcggtcacgggtgcatggcatgatcttaaaagaagagttagttgcttgtgcgaggtccgaaaggagtgtggctcaacacttggaagccacggagcaaagcattctagctatcataaggcaatacaaggaagaattgaactag

SEQ ID NO: 38933 - DNA, 234 bp, Glycine max
  Peptide Sequence Number=SeqID_130618
atgatggcacatcacaaagtgttaagctgtttaagcagagaatggcaacctaaagtaacagccattactgaatcaagagatttatctaacatggctcttgaaaatgacaagaaaaagaagggaattgctcttaaagccccatcttcaatccaagaagaaagtgataaggaaattgatctagatgaagatgatgatcttagcctttttgtaaaaaggttcaacaagtttcttaaa

SEQ ID NO: 38934 - DNA, 105 bp, Glycine max
  Peptide Sequence Number=SeqID_130619
atggcggtaggcagtacggcgatgggcgcactggtcgcgccaatggccgccggtgcggcagcgtcgtcggccgcggcgccgcagcaggcgcgcgagtatcaaccg

SEQ ID NO: 38935 - DNA, 437 bp, Glycine max
  Peptide Sequence Number=SeqID_130620
gactacacgtcctcgccttcaaaggacaacacgtcctcgccttcgccttcgtagggctacacaccctcacctttagaggactacacgtcctcgcctttagaggactacacgtcctcaccttcagaggactacacgtactcaccttcagagggctacacgccctcaccttcagagggctacacgccctcacctttagaggactacacgtcctcgcctttagagggctacacgtcctcacctatagagggctacacatcctcgccttcagagggctacacgtcctcgccttcagagtgtttcacgccctcgccttcaaagggcgacacatcctgaacttcagagggctgcacgccctcgcctttagagggctacgcgtcctcactttcaatgggctccatatccacatcttaagagaatttaaggtcctctgcccttaa

SEQ ID NO: 38936 - DNA, 360 bp, Glycine max
  Peptide Sequence Number=SeqID_130621
atgccaagttctacaaagaaaagaccaagaagtttcatgataattaagaaggacttcatggttgggcaaaaagtgttattgtataattctaggcttgggctcatgagtgttgagatcaaaagcaacaccacaaacaagagcttcaaggtcaacaaacaccgacttaagccattcctcacaaacccttctttagtggacatagtggtggaagagacttccttagaagatgaaaggctggcttctttaaatgaaaccgagtgggctaagattcaaaggagggttgtgagcatgattcggttagtccttgctcccgagataaaacacaacatgttgaaggagaaaacaccaaaggcattgtag

SEQ ID NO: 38937 - DNA, 684 bp, Glycine max
  Peptide Sequence Number=SeqID_130622
taccaaggaagtgtttggaggaaagggcaaaggccttggcaaatcaaggcgaatgggctttcttttagtgacatcttggcgcttttgatctttggagttgtcctctttccgaatatggaagggttagtggacctagcagtgattgacgctttcctcgcctttcatcatggcaaggaaagcccggtcgtcgccattttgaccatgtatgacacgttcgaccggggatgtgaaaagagcagccgagaattgtttgttgtgcactggctctctatgtgtggctggtttcacaccttttttctccaagaaggtaggcccgtctatccgctacaaggtcaccgctcgtgcatcgaaaaaggaaaggcgaattgggaccaactcttggctaacatggaggggcgtctgttaattggttccctcgctagaaggaaggaagaatcaggattctatcttcatgcgaaggatgacagagagcttaggggaagcagtaatgggatcatcggcggctatcataagtggctgagagtccggacacaaggattggattggctcccaaatctaaagactgtgagagacaatgaggttaaagcttcggaagaaagtgatcaggtacaagccctaaaggcaaagcttgaaagagcccgggtagtcaaagagaagttcaagtccatagccatcaaagtctga

SEQ ID NO: 38938 - DNA, 279 bp, Glycine max
  Peptide Sequence Number=SeqID_130623
atgggggacagatgtcgtacaggatgtcacgacatcacgcttcagaacatgcagtttaagtgtgtccgtatgaacagattaaacaaatataacagatttatatgtccagtattttcgggccggatgtcaggacatcgtgtccgacatcgtggatcctgcagcttcacttctgcacttgacttttatcttgcattgtacagcaactccagtattctcgggcaggatgtcaggacattgtatccgacatcgtggatcctgcaacttcacttctgcacttga

SEQ ID NO: 38939 - DNA, 111 bp, Glycine max
  Peptide Sequence Number=SeqID_130624
ggttcgatctggtcaagaaccctactataggtcatttgttgatccaattgtccagcaacttctcccttgtctctgtccttgaagcaattgctgtccctggggttcaatctg

SEQ ID NO: 38940 - DNA, 252 bp, Glycine max
  Peptide Sequence Number=SeqID_130625
atggggatgaaagtcgttactgagacaacggatcgacaaaagaaagaccgcctatcccggtgtctgctaccgaaagagagaatcggtctaagtgcagctcaaaaccagcccaacctcttcatggtcacatccccttatccgacgcttttcgtgttgttgcatgtgccttacggtatccagatccagtcctctctgcttcctatgattgaagtgaagatccgcaatgtctgctttccttactctaacaagtaa

SEQ ID NO: 38941 - DNA, 234 bp, Glycine max
  Peptide Sequence Number=SeqID_130626
atggcaggacgtggtaaggatcagaatcgtgatgtcctagatcgcatcacagctgtgctggaaactctagtgcaggaacgtgatgtggaaccggcagagtatcgaggactcatggctttccgtaagaaccacccgctgaagttcagtggggactatgatccagaaggtgctaggttatggttagctaagactgagaagattttcgaggcgacgggttgcctcgaggagcataag

SEQ ID NO: 38942 - DNA, 165 bp, Glycine max
  Peptide Sequence Number=SeqID_130627
atgaaattcttaatttctctggttcctcactcggctgctgtgtattctcttgcctttgagtttccatggcttgtttccgcatcaagtgatggcaagctggctctaattgatgtgagaaagctgttgaagattagcaagcgagctctggggaagagagtctcaaag

SEQ ID NO: 38943 - DNA, 213 bp, Glycine max
  Peptide Sequence Number=SeqID_130628
atggctctgaaaaagctttccgcaaagagatctaggagggacactgcggctgaagggactagtgccgcccccgagtttgatagccaccgtttcaagagcgccgagcaccagcagcgcttcgaggccatcaaaggatggtcgttcgacaaagagagacgcgtccagatcagagatgatgagtacatagattttcaggaggagatagctcgctga

SEQ ID NO: 38944 - DNA, 309 bp, Glycine max
  Peptide Sequence Number=SeqID_130629
atgaaacacagctccaaactcgaaagtggaggacacatgaacgaaaacgcaattcctggagttccgaaaaaacagggagaatggaggattgccttgagggcaatcgtgaaacacagctccaaactcgaaagtggaggacacatgaacgaaaacgcaattcatggagctccgaaaaaagggcgagaatggaggattgccttgaaggcaatcatgaaacacaactccaaactcgaaagtggaggacacatgaacgaaaacgcaattcatggagctccgaaaaaagtgggagaatggaggattgccttgagg

SEQ ID NO: 38945 - DNA, 243 bp, Glycine max
  Peptide Sequence Number=SeqID_130630
atgtcgcaacctacccttcggcgggagggcgacgcgagactcacgggtgcgtcttccatgggaggaaaatgtgcgaagtcgccaccaacgtttattagagaaaaacgtcagaaaaaccgaaaaaggtgtggtctacgaactttgagtgtgaaaggtttgggtgttgtatttacgcacggggaagggtgtttccctcgctcctacgtattcctcaattgtgataaggaaatcagacctacgtag

SEQ ID NO: 38946 - DNA, 174 bp, Glycine max
  Peptide Sequence Number=SeqID_130631
atggcaagaaaaggcagctcgtggcagtcagtggtggtggaggaggaggttgggggtgttgtgatgcaatcctaccccccaagggcattggatagaagactccaagaagattgggccagagatgcaagagaaggccctaaggttctcatgcgccttatgggctccataacgtag

SEQ ID NO: 38947 - DNA, 193 bp, Glycine max
  Peptide Sequence Number=SeqID_130632
aaggttgttgcttctagaggaagcaaccttgctcgcctgggcgagctggttggcaagctcctcccctattttgctataaatagggggaggagtgaagggagaaggggttcagccttcttggcacttctcattctctcgaaattgctaaggaaaattatttccgtgaagaaaatccaagccgagtcttcaactg

SEQ ID NO: 38948 - DNA, 603 bp, Glycine max
  Peptide Sequence Number=SeqID_130633
atgtctgatgattcacacaataatgtgccgaaactggttggacatgttgagaggtgcaatataggtgttggagaggatccattgggagaattgatgaagatcttgtttatggatgactatggtacaagcagaggtaatggtttagtgtatggtttccttgagcctcaatgtatacacaatgctaaggatagacgacaacaatgtcaacattacattgaaacatgggtcaaggagtcgcaacgacaattgtacttaggagcttacttgaatcattcaatgaagacaataaccagtactttcaaatgtatgtctgatcaagctgcaccttggtggattgaaccaaagagtcatgttcaaaccggaggctatgagtgtggatattatgtgatgcattggatgtggttcatagttactgccagtttgaaggatgaatggaacagggcatcaatgctgtcgaagataggttcggcaggagatagtgtttgtttggacaacctacttgatcatttcggcatttcatggtctacaaaggacaagattcaacaacccaattactttgagtcctttatgcaagcctcagctatccgagttggatcgttctag

SEQ ID NO: 38949 - DNA, 501 bp, Glycine max
  Peptide Sequence Number=SeqID_130634
atggctactatatcacccaacgatcattttattgcggccgcaacatttactgtagatgtgaaggttagatttaatgtgaaaatctatttaatttattatggcttactaatatatcttaatgtaaggaaatatggaagcaatgacttccaagattattttaatgatgccaaagaatcaagagttaaacacgttccaaagaatcaggagtcaaaaagctttcagaatcaagtttcaaagaatcaagattcaagaataatcaagtttcaagattcaatcaagtttcaagaatcaagatcaagattcaagaatcaagagaagactctatcaagaaaagtactaaaaaagtttttcaaaacattgagtagcacaagaatttttcacaaaatcttttaccaaagagttttactctctggtaatcgattaccagaaggaagtaatcgattaccagcagccagcattgttttcaaaactgatttacaaagctgtaatcgattaccataa

SEQ ID NO: 38950 - DNA, 669 bp, Glycine max
  Peptide Sequence Number=SeqID_130635
ggtgacgaatggggcttcggctggaacgccggtatcctgtacgaactcgataagaacaaccgttacggctttacctaccgttccgaagtaaaaatcgactttgatggcgattacaagagcagcctgccttccgcctataaccagatcctcggcaacttcggcctgccgttgggtaccaacggcagtaccacgggtggttctctgagcctgcatctgccggaaatgtgggagctgtccggttataaccgcgtggcaccgcagtgggcgatccactatagcctgacctacaccagctggagccagttccaggagctgaaggcgaccaacagcaagggcgacacgctcttctataaagatgaaagcttccgcgacgcttaccgcatcgcgctggggaccacctactatatggatgataactggacgttccgtaccggtattgccttcgatgacagcccggttcctgccgacaagcgctcgatctctattccggatcaggaccgtttctggctgagcgcaggtgcgacctatgccttcaataaggatgcctcaattgacgccggtatctcttatatgcacggtcaaaaagtttccttcaaagaaggtccgtatgagttctcttccgaaggtaaagcctggctgtatggtatgaacttcaactacgcgttctaa

SEQ ID NO: 38951 - DNA, 294 bp, Glycine max
  Peptide Sequence Number=SeqID_130636
atgaagaatctacatccatccggaagacatctatctgttgaaatcattgcagaaaagccattgaattttgttcatagtacattgaaaaggttttctaaacctattgggcttcatccttggcatgacgacaaagcattggcggtaagggtatcaagattgcatgttatcactccaagtgtagaagattctgttacaagccgataccttgtatgtgttgaattccagcaggatattagacatgtaactttgttagcatgggaaaaatgctgtataggtcattgggacgctccttaa

SEQ ID NO: 38952 - DNA, 685 bp, Glycine max
  Peptide Sequence Number=SeqID_130637
aggactacacgccctcaccttcagaggactacacgtcctcaccttcagaggacttcacgtcctcaccttcaaagggctacacgccttcgccttcgtaggactagaggtcctcaaattcagaggactgcacgtcctcgccatcagaggacttcatgtcctcacctttacagggctatatgccctcgccttcagagggctacacactctcgccttcattcctgggccaccccctgatcctagaggagggctaactatgcaagtacaaccagaggaggaggctatcgtgcagctactatgcatactggggcaagatttcacccgtgccgctgcaaagagacgagtgcggatcatgcgcaccaacatgaccactattacacaaatatggatgacgttgctacttagcaacattctgcccaacgaccgtaatgccgatctccctttgcggaagtatcaggatcgtgcccacaagacacccagtggatccggagaagtccaacagggccctggggtctctagctttggttacgggcctttgtcagtcctacagggtgcccgatccccccagcaagggattgcgcccgcaagaaacccagtggacccggagaagtccaacagggccctggggtttccagctctgattatgagcctctgtcagttttacggagtgcctgtcacccccaacaag

SEQ ID NO: 38953 - DNA, 207 bp, Glycine max
  Peptide Sequence Number=SeqID_130638
atgtatgaaattgaaaatgatgaaggccattattgcctaggatcttcttcatcaatggactcctttgcttcttggaagaagaatgccagcggaatggagaaggaagagagagaggagataccacttcaaggagaagatgagtctagaagaagctcaccaccatatgaggccatggataagagcttggaggaaaaaggagatgaatga

SEQ ID NO: 38954 - DNA, 423 bp, Glycine max
  Peptide Sequence Number=SeqID_130639
atgcctgggatcgctacacagacaatgtccttggccgaaagatcctttcggaaaggaatgagagaaattgagagaaggaattggcataaggagttcactaacttctcagagggaagcattaatgttgctattgttaaagaattttatgctaacctctatgatcctaaagacaaatcgcctaagcaggtgagggtgcgagggcatgtaattaaatttgatgctgacgccctcaacaccttcttgaagacaccagtggtcatagaggaaggggagagcttgcctgcctactctaggtttgctaatctgaggcctgctcctcaagagcttgcagcctgtctatgtctccctgggaaaggatttgagttgaatgcagacgatctacctctgaagatcatgaggaagaatctgactactctggcctag

SEQ ID NO: 38955 - DNA, 324 bp, Glycine max
  Peptide Sequence Number=SeqID_130640
atggctccgaaaaagctttctgcaaagagatctaggagggacgccgaggctgaagggaccagtgccacccccgagtttgatagccaccattttaggagcgccgagcaccagcagcgcttcgaggccatcaaaggagggtcgttccacagagagagacgcgtccagctcaggcacgatgagtacataaattttcagaaggagatagctcgcccacattggacgtcgctggtgactcccatggctaagtttgaccctgatatagtcctggagttttatgctaatgcttggcccacagaagagggagtgcgagacatgcgatcatgg

SEQ ID NO: 38956 - DNA, 312 bp, Glycine max
  Peptide Sequence Number=SeqID_130641
atggaagattcaattgacttggatgatgatgaagaacttagtctctttgtcaaaagattcaacaaatttcttaggatgagagaaactcaaagaagacaaaacttcaaacctaaaagaaggattgaagaatcatctcaaactcgaagatgctatgagtgtaatcaactcgaacatctgagggttgattgttcaatgtttaagaaaagaatggagaagttcgaaaacaagaatattggagaaaagaaggccaagaaggcctacattacctgggatgataacgacttagaatcgtctgatgattctaaaaaagaa

SEQ ID NO: 38957 - DNA, 381 bp, Glycine max
  Peptide Sequence Number=SeqID_130642
gtcgactctagaggatcccacgtcaatcgcggccaacaagctctttgacacgcggagatttacgtcatcttccgcgcagacaatttctgtcatactgacactagagtcacatgacatgcggagatacccgagtggttatccgtttaaaacgatttctgtcatactgacactggagtcacgtgacatgcggagatacccaagtggtggcgggcccgatgacatgcggttatccgcacgctcaatgagtgataaacgcgcagggacaaattctgcgccctttatcattcagaagcagcgagtcaagtggaacaacaagttgggtggtaaacgcgcagagacgaattttgcaccctttatcattcaggaacaacaagttgggtg

SEQ ID NO: 38958 - DNA, 264 bp, Glycine max
  Peptide Sequence Number=SeqID_130643
atgagtcttcattcttcatctagtgctaatggtgagggttctactcctaaggaccccttgtatacgatattagatgagttgagatcccttaagttgtggaaagaaaaacaagagagaaaagaaaaagagggcgccatagttcacatactaaacatcactcccaaagaagagaaacaggatagaaggcctcaaaaggttaacattagcctcccatatttccatggaacagatactgttgaggcctacttagattgcgaaatgaag

SEQ ID NO: 38959 - DNA, 198 bp, Glycine max
  Peptide Sequence Number=SeqID_130644
atgttggtggcgactccacgcgtattcctttcttgggacacgcacccgcgagtcacgagtcgccctctcgtcgaaggagttaagccaattccaaagattcaagaatcaagattcaagaatattcaagaatcaagattcaagaataatcaagatcaagattcaagaatcaagaaaagattcaatcaagataagtactaa

SEQ ID NO: 38960 - DNA, 312 bp, Glycine max
  Peptide Sequence Number=SeqID_130645
atgctaaacatccaaaatctcatttatggttatgggagatttcatcagcagactctccttccccgtggagaaaacaccgagactttttcaagtctcacaagttatccagaactacgtaggtctgaattcctcattggaggatacgtaggagcaagagcctcgcttttgtcgaccataccgccttttgttgccatgactcaagagctggtagcccgcggagacaccttacggttatccgcatccttttgtcatccagaggcagttgtgtccgatggcacgcagagaccaagtttggtcattctgcacacatga

SEQ ID NO: 38961 - DNA, 186 bp, Glycine max
  Peptide Sequence Number=SeqID_130646
cttgtatgcgtttcttgatttcaggtttatcatcatcaaaaagggggagattgtagaagcaagcttcatgatgatgaaccaagcaattttgatgatgccaaaagcccaagtgattgattcaagacttcaagatcaagcattaagaatccaatccaagattcaagagaagaaatcaagaagcaacaa

SEQ ID NO: 38962 - DNA, 267 bp, Glycine max
  Peptide Sequence Number=SeqID_130647
atgggcctgaaatctgcactaaggctcatgagaaccttagggccttctcttgcatctctgcccaatctacttggagtcttctatccaatgcccttgcggggtaggattgcatcacgtcatgatcatggttttctttgtggggcattgagaggcaatgtgacctctcccaagacatttgaagcatttaatgttgctattcctttcttgggaactagtgttaggggtgtatttctctatggtcttacccttgtcttccttgggttttga

SEQ ID NO: 38963 - DNA, 114 bp, Glycine max
  Peptide Sequence Number=SeqID_130648
gtgcttaaggacggatgcaaggagaggctagggtcacgacccgtaggtcgtcatcctttgcctagcccgggacaaacggaaagcgccgctgcaaagcagcctagtatcctttaa

SEQ ID NO: 38964 - DNA, 303 bp, Glycine max
  Peptide Sequence Number=SeqID_130649
atgactaggggcaatccaagtgatttacaaccctttgatcctgaaatagatagaacctttcatagattagttaggcatagtgtgcatcctggtcattctgtgcattgtgagcattctgagcattctattgagggtgattccgaatattctgattttgagcagtccactactaatttttatactgagaacatggctcaacctccacctcgtgagaggactcttagggaaatggctacacctgacttcacatcattgttgcatgtgtatcatggaaataatgtgggacatcccctttatccctga

SEQ ID NO: 38965 - DNA, 588 bp, Glycine max
  Peptide Sequence Number=SeqID_130650
atgaccgaccctctcgatgagtcgatctcttactttctcataagggttaacacttgggtactagtacctatcaccttcagaggacttcacgccttcaccttcagaggactacacgtcctcgccatcagagggctacacacccttaccttccgaggactacatgtcctcaccttcagagggctacacgccctcgccttcgtagggctacgcgccctcaccttccgaggactacatgtcctcaccttcagaggacaacatgtcctcgccctcaccttccgaggactacatgtcctcaccttcagacgactacacgtcctcgccttcaaaggacaacacgtcctcgccctcgccttcgtagggctacacgccctcaccttccgaggactacatgtcctcaccttcagaggactacacgtcctcgccttcagaggacaacacatcctcgccttcgccttcgtagggctacatgccctcacctttagaggactacacgtcctcgccttcagaggactacacgtcctcaccttcagtgggctacacgcccttgccttcagaggactacacgtcctccacttcagaggactacac

SEQ ID NO: 38966 - DNA, 189 bp, Glycine max
  Peptide Sequence Number=SeqID_130651
atggggatgacattctctgctaggtttcacatcaacatgaatgtcaaggccaaatgtaaatccctaattggtcaaaaaatgcttgggagtatgtcatggatgcctggggaagtctggttgattgtccttccgaacaacagttccatgaatgccttaagaagtttgaaatcgcttgtttatcttggctaa

SEQ ID NO: 38967 - DNA, 975 bp, Glycine max
  Peptide Sequence Number=SeqID_130652
atggccctaaaaatctgtcaagacgacaagattcaaaggcaattagccaaggaacaggcccaaactaagagagacttgggatctttctgcgaaaaattcggactactagcttgtccaaaacaaaagaaaaaacaaaactctaggaaagaaatccatgagaataaacctgtccacaaaaagagatttccaagaaggagattctcgcacaaatcctcgactaagacttcggaggaagaaacagaaacggaaacttcatcctccacactcttcgatgaaaatctcaacaaggttcaacaagatgaccaaccatcgtctacagatgatgaaagacaaatcaacaccctaacaagagaacaagatctcttgtttgaggcaatcaattccatacctgatccccaggaaaagaaagtttttatggaaaaattaaagaaaaatctgaaaaccaaacctagacaaaaagattttattacaaacaataaattcgatgttagtaacatattcaaaaggctagaaaacacttcagccaaaccaacaacaatccaggatctccaaacagaaattaataatttaaaaatagaggttaaagaactacgccaacaacaagaaattcatcaaattatcctttcccaactagatgaaagcagtgattctgagagtagggaaaaagatgttgaaaatgaaactgaaaatccagaagatgaaatgtttatgggattaatcaacaagattaaaatccaaaaattttacataaaaattaaaattattatcaatgatttcatcttagatacaatggctctatttgatacaggggctgattcaaactgtattttaaaaggattaatttttacaaaattctttgaaaaaacttcagagaaacttagtacagcaagtggatctaaattaaaaatcaattacaagttatccaatgcaatcattgaaaaccaaggtcttaggattaatacaaactttctcctg

SEQ ID NO: 38968 - DNA, 300 bp, Glycine max
  Peptide Sequence Number=SeqID_130653
atggtacctaatgcatggttaactaagaaaagatgtttctttgggaatctcaaattcataattacatttgccatgcatagcttaagtatgctcaactcattcatctctgtgaaatgttgtcaaattattggggcaattgaaattgccattccttgggttatggggttgaaccaagctcatgcttttatgaaaaaggttcatgaagtcaagttgaagtatggaagtaaccatcttgcaaaaattggggcaaaagatggatcgggttacatcattgctccgtctactgccaaacacatttag

SEQ ID NO: 38969 - DNA, 539 bp, Glycine max
  Peptide Sequence Number=SeqID_130654
atgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaaggggtcgcagtgaccaggcccgggcgactgtttaccaaaaacacaggtctccgcaaagtcgtaagaccatgtatgggggctgacgcctgcccagtgccggaaggggagccgacgaccgaagccccggtgaacggcggccgtaactataacggtcctaaggtagcgaaattccttgtcgg

SEQ ID NO: 38970 - DNA, 207 bp, Glycine max
  Peptide Sequence Number=SeqID_130655
atgatatgtccattacgatgccatgaaaagatgcatgatgcgatcaaggaacaagccaaagtgagtttgctatgtgtaggtttcattccagaatcccaacttaaaagcaaaattagtcattccttaatccacatgggctttattgggcttgtagcgtggtcagggaaaacaaacatgctttggctcgaagggggtagcaagggataa

SEQ ID NO: 38971 - DNA, 692 bp, Glycine max
  Peptide Sequence Number=SeqID_130656
gaggactacacgtcctcgccttcagaggactccatgtcctcaccatcagagggctgcacgccctcacctccagaggactacacatcctcgccttgagagggctactcgccctcgccttggggctacacgccctcacctttagaggactacacgtcctcgccttcagaggactccatgtccttaccatcagagggctgcacgccctcacttccagaggactacacgtcctcgccttgagaggactacatgtcctcaccatcagagggctgcacgccctcacctccagaggactacacgtcctcgccttgagagggctactcgcccttgccttggggctacacgccctcacctttaaaggaccacacgtcctcaccttcagagggctacacgccctcgccatcagaggactgcatgtcctcaccttcgtagggctacacgccctcacctttagaggactacacgtcctcgccaacagagggctacacgccttcacctttagaggactacacgtccttgccaacagagggctgcacgccctcaccttgagaggactacacgccctcacctccagaggactatacatcctcgccttgagagggttgcacgccctcacctttagagggctacgtgtcctcattttcagtgtgctccacatccgcaccttaagagaatttaaggtcctctatccttaa

SEQ ID NO: 38972 - DNA, 264 bp, Glycine max
  Peptide Sequence Number=SeqID_130657
atggttaaaaaggggagagggggaagttgtctccacccaaaactctcccccctcattcaaaaaacgaaggctcatgggattccttggttttccagccttaggtcaccatttctccgtgtttttgattccattttgcattattattcatctccaacaggcagtggccttaggcataatttgtattctgaaaagattgggcatgccacattgcccccattcccttgctattcatgcctaaacgtgcgcccaccaagtgctcggtga

SEQ ID NO: 38973 - DNA, 309 bp, Glycine max
  Peptide Sequence Number=SeqID_130658
atggattggtggttgaaggacaagggttttcagcaactagttcaacggcaatggggcaattatcatcctccaggatggggaggatatgttcggaatcataaaataaaactcctcaaacagtgcataaagcagtggagtttaacaaatggtgaagctaatgctagaaaagttattatgattaaaaaggagctgaatgctttggagaatgggttaaaaatgcagctgtcctttatttcaaagacagatttctggaggaatgttctaacaggccaacactggatggtgttttcttctcctctctggatctaa

SEQ ID NO: 38974 - DNA, 435 bp, Glycine max
  Peptide Sequence Number=SeqID_130659
atgttaggatttacacgcgattctcctcaaatttcagccagcccgcctcaattagactttgcaccttacgcttcgaggtcatacagtgctcaatggaatgtcccggggcttctccatgacaagcacacgttgcgttcgagtcgtattctcggagaaatggaggttgatgaaacttggttggggttatggctaccattgagttatcaagtagatatgggagcaagtcagcataggacaccggaattctgggtgaattctgcaggctttttcgctgcaaaattcatttcttggttggtgtttgggatgacctttgtggatgactgggtggtgggtaatgagaagttgcatcctatccgaagccattatactgacactgccaaacgaaggcaaccattaggtccttccaagaatggactcgggaaggttccaagctag

SEQ ID NO: 38975 - DNA, 662 bp, Glycine max
  Peptide Sequence Number=SeqID_130660
atggacatcctgacactcttgatcttcggggtggtcctctttccaaatgtggaagggttggtggaccaggcaacgattgatgcttttcacgccttttacgaccgcaaggaaagcccgattgtcgctatcttagccgatctatatgacacattcggccgaagatgtgaaaagaacagtgcaaggatcgtttgttgtacaccggcactctatgtatggttggtttcacacctttttcgccaagaggtgagacacatttgcctgctagaaggccaccactcatgcaccaagaaaaaggaggcaaactgggacaaactcttagcaagcaaagaaggagtgtctgtcaattggttcccccgatggaaagaaggaagaaccgggattcttatttcgtgcggggaatttccaaatgttcccttgatggggacgagtggttgcattaattacaatcctgtttgtcataccctaatttcgtccggggaccatctgcttggtgggatgcaacctttgcttgaccacttcgagtcgaaaggaagcgttaatgcacaatctgtaaagttccgtaacattccagaagccaaagaggggacggttgcgggtgtgcaaatagcaatcaggcccacttgggccttccaagatgttccaacagaaggcggtgccttctg

SEQ ID NO: 38976 - DNA, 264 bp, Glycine max
  Peptide Sequence Number=SeqID_130661
atgttcttcagcgtgaaaaacacgattttcgctctctcttcctctcctaacgccacccaaaccctaacacctccttttccaccacccacgaccatcggtggccgccacgagccgctgttgcttgccgccaaacccccacaccaagaggaacattttaattggagcagaatactcctcaaggattcggtggagaaaattcccccaatcctccatttcaaagcttctctaaggtactgtaatagggtgtttttacacttcctttga

SEQ ID NO: 38977 - DNA, 171 bp, Glycine max
  Peptide Sequence Number=SeqID_130662
atgctctatgggcccacaggatcacttactgaacacctttcggaatatctccctatagggtggtttttgggttgtaacatgacatttgatgaagtgagtatggaatggaagcttcaattgcaagaacttgaggagatccgcttagaagcctatgagaactccaagatttaa

SEQ ID NO: 38978 - DNA, 231 bp, Glycine max
  Peptide Sequence Number=SeqID_130663
atggctaagtttgaccctaaggtagtcctggagttttatgctaatgcttggcccatagaggagggagtgcgagacatgcgttcatgggtgaggggaaggccagcagtgcgagttcagccagaggaggaacaaggccgacaggttcgacgaggaggccattgcccagctgttatgcacaccaggccaggatttcgcccggaccgctgcagggaggcaggtgcggattgttag

SEQ ID NO: 38979 - DNA, 557 bp, Glycine max
  Peptide Sequence Number=SeqID_130664
ctgcaattgatgctttccttgcatatcaccatagcaaggacagcccggtggtagctatcttggtggacttatttgatacatttgaccgaaggtgcgagaagaacaacgcactgattgaccaatacttggctgggataggaggcagcacaatcaactggtttcctcgatggaaggaaggaaaagagggagttcttttctcatgtggggactacccaaacgttccattgatagggattaggggttgtattaactataatcccgcacttgccataagacagctagggtaccccatgaggggagcaccgacggaagagagcctctcgcctttccttgtgagagatttcggcgtgcaaagtctcaaggttgtacaaagagtccacaaggcgtggaaaagtccgttgaggaaagaaaaagaagttaggggcatccgtaatggcatcatcggtggttatcatgaatggctaagagttcatacacgagggttagattggctctccaagttgaaagttatcaacgaggagaacttcgaagctcaggaagaggatgaagaagtctaa

SEQ ID NO: 38980 - DNA, 212 bp, Glycine max
  Peptide Sequence Number=SeqID_130665
ggccttcgcttgtggatctctggcccaatctgcttggagtcttctatccaatgcccttgcgtggtagatttgcatcaggtacttcatggagatgcagcgatacaggttccaaaggagaacaaagaggattaggggaggaccatattagggaatacattgctaaagcctcaaggaagaaggagcttctaccctctgtgaaccaagaagccttg

SEQ ID NO: 38981 - DNA, 432 bp, Glycine max
  Peptide Sequence Number=SeqID_130666
atgcatagatctcccacaggcactttagttcctttggacttagaaattgaagctacactgagaaggaacagggctgagaggagaaagaaactgttgcaagacagaatagttgcatccattcttgaggaagagactcatttttctaattcatcatcacctgattcaccatcatcaagggaatccactaatcaattgtctgaaactgctaccatggcagatgagcacgaccagaggactacccttgaagactattcaagtagctcggattacctaatgaagatccctatgcacacttggcaacatctattgagatttacaacactgttaagatatccagtgtaccagatgtaccaggagaggccaagaggtggctccactcattcaaaggtaacagtcttaaaacctgggaagaagttgtggaaaagttcataa

SEQ ID NO: 38982 - DNA, 425 bp, Glycine max
  Peptide Sequence Number=SeqID_130667
atgaagttttcttctctccggctcaccaatgtgaaaggtgtgcatgagtacataatccatatacgagatatttcagctcaacttaagaaactggaggttgatatgtttgagtccttcctggaagaagaaaggcttgtaatggagatgggtgagagtgcattgctgacaactgcttgtgggaagaacaaagcagctaagtctcaagctaatcagaagggtaatggtaaaataccacctcaagctgatattaagaaggtgacaaagtatttcttttgtaagaagaagggacacatgaagaagaattgccctagattccagaaatggcttgagaagaaagataaatcaatctcatggggtatgcaaaacctaaggaaaccagtgggaagtgagcaaagcattttatcaggcaataagctaggctcact

SEQ ID NO: 38983 - DNA, 246 bp, Glycine max
  Peptide Sequence Number=SeqID_130668
atggtcattgaccaatcccttttttatgaattgacccaattgtctagtgatggtgtaccatttgaaggtgcactggatgatgattggaaatttgatttttctatgcatgatgcccgccggttggtttgcaccaaccaagcgaatatgaccggaaggctacttgctggttcattggctcttgaaagccgcatcctccattatctaattgttcgtatcttactccctagatcttcaaaccttgcatag

SEQ ID NO: 38984 - DNA, 955 bp, Glycine max
  Peptide Sequence Number=SeqID_130669
gaaagtagagctatatcacactgagctagatgactttaaggccgagctggagaggtgtaatttccataaatgcctcacccttttagccaatgggagcatagacctggctttggtgaaagagtgctatgcaaatttatacaattctgaggactgtccaccaaagcaatccagagtcaaaggtcatttggtgaaaattgatgctaacagtctcaacacattcctggagacacctgtggtattagttgagggagagactttacccgcctactccagatactgcaggttgcctacatacttcagagagatagaggcttccttatgcatacctggccgagggttcattttgaactctgaaggccaacttgggaagattctcaaaaagaatctgactacactagctcaggtgtggagtgtcctctcatactccaacatggcccccatatcacatacctctgatttgacagttgatagagctaggctgatctttggcctagtctctcacttggatatgaacataggagcactgatctctgaccagatgacatctacagcccagtctaacacatctagacttgggttccctgctctaatcaccgtattatgcagagccagatgggttgtctctgacagcattaccttcaagtgcctgagcccgatcattaacctggtctacatcaggaagaattgttggaaccccgaggatctagcagtctctatccgaggggctaggagggcaagggcaaggccagccgagcttccttctacttctgcagctcctactccagcatccacttcagcaaccccttctgttccagctcagacaaattctcaacactttgaagccatgctccaaagcattcatcaaggacaaatcatttttgttggaccttgtggcctcaataatcttaagagggataagcttagaatgcagaagaagcaacaacaatcaatttaa

SEQ ID NO: 38985 - DNA, 1652 bp, Glycine max
  Peptide Sequence Number=SeqID_130670
atgacccgcatgcccgctctgtttctcggccacggcagcccgatgaacgtattagaagacaaccgttatacccgcgtatggcagcagctgggcgaaaccctgccgcgtccgcgcgctattctcgccatctcggcgcactggtacacgcgcggtacggcggtgacggcgatgagcaatccgcgcaccatccatgattttggaggcttcccgcaggcgctgttcgacgtgcgctatccggcgccgggttcgccagcgctggcacagcgcgttatcgatctgctggcgccggtggcggtgcaggccgatcagcagtggggctttgatcacggctcgtggggcgtgctggcgaagatgtatccacaggcagacattccgctgattcagctcagtattgatggcacccagccggcggcgtggcattttgcgctgggacgtaaactggcggcgctgcgtgacgaaggcgtgatgctggtggccagtggcaacgtggtgcataacctgcgcatgattcgctggcagggcgcggaaagcgcttatccgtgggcggagagcttcaaccagtttgtgcgcgataatctggactacgaaggcgaggcggtgcagcatccgctggtgaattatcagcagcatgaaggcgcgcagctggctaacccgacgccggagcactatctgccgctgctgtatattctcggcgcgcgtgctgaaggtgaggcggtgagcatcccggtggaaggcatggagatgggttcgatcagtatgctgtcagtgcagatcctgggtgatcagcgcacgatcttcgcgcagaccgataccggcaggctgatcgtcaatcagccagctgccaatcagcgtgtagctgtcgccaaatttcggcagcggccagaactgctggacgatcatgccctcttcgccataggggccgtcggcgcgcgcgatttcctgaccgttttccacgatagtgatattggcaccttcgcgggaaaacagcggtttcaccacatatttttccatctgcggcgcgctggcatcatcggcaaaccaggcgggcagcagccagcgcacgccggcatcggccagcttggtcgagaacatctcgcgcagcatgaattcccacggatagagcttgaacaggttgctgatcacctgatcgtgctgatcggtaaactgacctttttcgcccagcccgatctcatcaatgtagagaaattcactcggcagaccggcttcagtggcgcaatcctgcagatactgtaccgtggcgcgatcctcttccgtatcgcgacagcaggcaaagtgcagccagttaaaaccgtgctgctggtgcagcgtggcgaagcgcgcaatcagctgctcctgcaggctgttgaattgatcgctgccctgcggcaggttgccggcgttgagctgatcctccagccagatccactggaaaaacgccgcttcgtacagcgaggttggcgtatcggcgttgttctccagcagcttgatctcgcctgtgccatcccacgccagatcgaggccggtggccgcttccagctgttcaatttgcgccagagtaaactggtaataagcgtcttcgcaccagtagggttcgccatacatggtgtgaaactgaaagccgtactcggtcgccttttctcgccagttcggac

SEQ ID NO: 38986 - DNA, 234 bp, Glycine max
  Peptide Sequence Number=SeqID_130671
atgatgacaacaaaagatgatgacaaaagtgatgaacaaaaagctcaagtgaatcaaagaacatctcaagagaatcaagaacaagtcaagagttcaagaagaaagcctacaaaaaagaatcaagattcaagattcaagatctcaagaatcaagatcaagattcaagaatcaagaatcaagactcaagatctcaagaatcaagatcaagattcaagactcaagattcaagaatga

SEQ ID NO: 38987 - DNA, 333 bp, Glycine max
  Peptide Sequence Number=SeqID_130672
atggctggtatattcttccttttgaaacagcaaaataattcagagaattatgagcggcctaggatcttcttcatcaatggactcctttgcttcttggaagatgaatggcagcggaatggagaaaggaagagagagaggagacgccacttcaaggagaagatgagtctagaagaagctcaccaccataggaggccatggataagagcttggaggaagaaggagatgaatgaagggagagggagagaagagcacgaaattttgtgctctaaaagagctttgaaatctgaagttaatattcaaatgatcaaagttgaaaaaaatgcacacacatga

SEQ ID NO: 38988 - DNA, 435 bp, Glycine max
  Peptide Sequence Number=SeqID_130673
atggggctgaaacaagttccaaggggctttatggggcagaaacaacgaagtcaagctttgaagggccgaaaggggcgagtcaagggtggaaagtatgatattagaggacaagttgaaggcttgtcaaagtatagagagaagctaaacctagctgctagccatgagcaaaggctagaggatgagcatgcgaaggtattagctccgcacatggaaagaaaagcaagagagagagtgatagaattattgcacagagaagctatgaaatggatggataggttcactctcactctgaatgggagtcaagagcttccaaggctgttagccagagccaagtcaatggcgaacgtatactcagctcccgaggaagttcatgggcttttcgattattgtcatcatatgattgagttgatgtcccacaaaattaggaaccactga

SEQ ID NO: 38989 - DNA, 159 bp, Glycine max
  Peptide Sequence Number=SeqID_130674
atggcagaacaagctaaacaggcatttgatgttcaagacccttgtgatgaaaggtggcaaatggctaaaccacctaactctcctcctcctcctcctcctactggtgcaccatcacagtcgccatctaccttgaagcagacaagaaagccacacgactaa

SEQ ID NO: 38990 - DNA, 360 bp, Glycine max
  Peptide Sequence Number=SeqID_130675
atgttacgaaaactcacggattgcgcaacaacacttccttttgattttcggcacgttacggaatttcacggattgcgtaacaatgcttcctttagatttctggcatgtctcggaacttcacgtattgtgcaacaaagggtgccaagtacctcgaagcagtcaattaaaggttgcatgccatcaaacaatagtccccagacgaaattagggtatgacaaggctgacacagttattgctcaggaggatgtggcatcaccagagcccttccctcaggcagagccatctccatttccttcccctaagcctaagctatctgcaccaacaccagtgcctaatcagtctacttctcaggacccatga

SEQ ID NO: 38991 - DNA, 192 bp, Glycine max
  Peptide Sequence Number=SeqID_130676
atgggaaatgcgagatttcttgaggaagttgagtttgggaaggaagagaacataaagaatgttgtctttgaggaagaacctggtatttatagtgatcaagtccttatacctcttactgttcaagacacagctccagtaatagatgacaatgttcaaactattgacattgttccagaacaagacaacaatcag

SEQ ID NO: 38992 - DNA, 426 bp, Glycine max
  Peptide Sequence Number=SeqID_130677
atgggtgaagtagaggaggtgcaagaacagatcaaggctaacatgaaggccatgaaagagaaaatggccacaatgatggaggccatgatgagcatgaggaagataatggaagccaatacagttacagttgccgctaccagcgctgtcgctaaggtgaactcgatgcccccatctggcctcaagcaaatgaatcatccaacctcagatatggtaggcaaagatttgggaagtacggatgatcccatgatgtgcaaatacaaaacaagcatgccttcccaccatatggcttgcctcccaactatacgccacccaatgtggcatacactcccaatgagaatgtcaataactccactcttatacccattgagagccaaaaaccccgaactatcatgcacatgtctcttaaaccgtgggggagacacatga

SEQ ID NO: 38993 - DNA, 285 bp, Glycine max
  Peptide Sequence Number=SeqID_130678
atgtttgcggggatgaaaattctgatgaccaatacttcaacaccttatcataaaggaggtatgatgaatgcatcagggcatgtttatgctatgcatgacaaatgcgtttatctacggacacaagatctcggaagaccatctcttcttacccacaatgcattgggtatcatggttcatttgcagacattaccatggtgcccaatgcatgcaactaagaaggtgatgcagactttccagcttctcatgacgaagatgatgaaaacaaatgcaagacatgagcaatga

SEQ ID NO: 38994 - DNA, 537 bp, Glycine max
  Peptide Sequence Number=SeqID_130679
ggacgggggaagcccgtctgatagcgctctgtgcgcgtactccgaaagggaatcggcctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagcttccgcggcgagagcgggtcgtcgcgtgccggtcgggggacggattgggaacgggcccttcggggcctcttccccgggcgtcgaacagtcaactcagaactgtgctctgaatgtcaaagtgaagaaaattcaacccaagcgcggcgaaaccacagccaagggaacgggcttggcggaatcagcggggaaagaagaccctgtgtgcggggcactgcccctctttttggacccaaggtcggcttcggccggtcgatccgggcggaagacattgtcag

SEQ ID NO: 38995 - DNA, 49 bp, Glycine max
  Peptide Sequence Number=SeqID_130680
cccgcttgtttctcaagaagagatgggaaacatgctcaatatcatttga

SEQ ID NO: 38996 - DNA, 456 bp, Glycine max
  Peptide Sequence Number=SeqID_130681
atgacaagcagagaccaagtttggtcattctgcacccttgtatcatccagaggcggcgggcccgatgatacgcggagataccttacggttatccgcacccttttgtcatccagaggcggcgggcccgatgacaagcagagaccaagtttggcggcgggcccgatgacaagcagagaccaaatttggtcattctgcacccttgtatcatccagaggcggcgggcccgatgatacgcggaaatacccgagtggttatccgtataaatattcttttgctatctgtaagacagaacgcttgatagcatgcgatacgcggaaataccttacggttatccgcacccttgtgtcatccagaggcggcgggcccgatgatacgcggaaatacccgagtggttatccgtataaatattcttttgctatctgtaagacagaacgcttgatagcatgcagaggctga

SEQ ID NO: 38997 - DNA, 210 bp, Glycine max
  Peptide Sequence Number=SeqID_130682
atggggaggagggaggctcaccatgggtacatagatgagattgaaaagttcggtttggggcaaaataggggaggatcttgccactcctacgtacccaggcagctctgctcgccaagaggacgagcctacgtagttgcttttttcaagggtgaatcaagccatttttttacttggaaggaagaatcttggaaggcccgtaggtctggataa

SEQ ID NO: 38998 - DNA, 477 bp, Glycine max
  Peptide Sequence Number=SeqID_130683
atgaccggccctctcgatgagtcaatctcttgctttctcataagggtggacccttgggtactagtacctatcgctttcagaggactacatgtcctcgactttgcagggctacatgtcctcgccttaagagggctgcatgtcctcgccttaagagggctgcacgtcctcgcctttagaggactacacgtcctcgccttaagagggatgcgcgtccttgccttaagaggagggctacacgtcctcgccttaagaggggtgcatgtccttgccttcagaggactacatgttctcaccttcagagggtttcacgttctcgccttcagaggactacacatcctcgcctttagagggctgcacgtcctcacctttagaagactacacacactcatcgtaagagggctgcatgcccttgccttcagaggagtgtatgtcctcgccttcagagggtttcacgtcctcgccttcagaggactatag

SEQ ID NO: 38999 - DNA, 594 bp, Glycine max
  Peptide Sequence Number=SeqID_130684
atgagcgtccacgtggcccaagtgattgctgacgccatctatttgtttgcaggtatgccacccaccaggcaccctctggacccggataagtctaacagggccctggggtttccggggttgatcacgggtctctgccagtcattcggggttcccgtcacccccagtaaggtgatccgaccgccgatcacccgggccttcatcgagaagtactgcacgcctaggcaggcacagggtgatgcacatcaggccgcagacgcactgccaccacctcatcagaccgatcccgttggatcactaggcatggagcgttatctacaacacttggttcgccagcaggcggccaaccactgggggcaggtgcagatacatgagtgtctctaccggttcagccttagtcagcaggggcagggtttcgctccttttgcatgtcctactccaaagcaatttggggctgaggtcgcatggcccggagattggcccgaggcccaggcaggggaggagcctgcaggatcccccggtgaggcagaggaggcccgtatggatgaagaaatgacggacttgctcggtttcttgggaggaagcggagccacgtga

SEQ ID NO: 39000 - DNA, 672 bp, Glycine max
  Peptide Sequence Number=SeqID_130685
atggtaacaataagtacctccaatttaataaatgttattaatgaagatattgaccaaaactcaaaaaatgcaactgagataggatcagtatcagaaaagaatataaatccaattaattccaaacacaggaaaaaaccctctaaattatattatcaacgtccaactgtccctaaccttctattagaagaaagaagtgaaaacaattttaagagttttagtgcaaacaacatctatgagtggaacatagatgcacagatggagtataacatcatgaatacactccaacatatgaccatggtagctacagcctaccaaacctcccatgaatgttcggaagaaaccattatagatattttagtggtaggattttcaggacaattaaaagttaagacagatctcaacggaaaagtcattactaatgacgaagataaagagattcctaacgctgttaatacattaatttttacaatagcccaacacttcattggagacccatctttgtggaaagataggtccgcaaaattattgtcaaaccttaagtgtagaaccttagcagactttaggtggtacagagatactttcctaactaggatttacaccagagatactttaggtgaaccacacacctgtgtacataatcactgcatgttttcatcacttggggaccagtga

SEQ ID NO: 39001 - DNA, 628 bp, Glycine max
  Peptide Sequence Number=SeqID_130686
gtcgactctagaggatcccaccggtttcgccgtacaggccctcggccggcttgtaggtcaggaatacgctgccgttgcgccgcgccacgttgctgacgcggttgccggccaggccgttgttgtcctgaacgatggcggcgttctgcaggccgatgccgccgcgcaggtaccagttgcccgcgagccgtccggcggccgtcagctcgatgccgcgcgagcgctgcttgccggtcagcagcacgagggtcggatcgaccgggtcggtggtgcgacggttgtagagttccaactggtacagcgccagcgtggtgctcaactgcccgtcgagccaatcgctcttgacgcccacttcgtattggcgcgtgtgttcggggtcgacgtcgttggtgttgccgcgcgcgttcggcgtgatgccgatcaggctgccgcccacgggcgagaaggtcttgctgtacgaggcgtagaaggaatggtcgcgcagcggcgtccacaccaccccggcgcgcgggctcacgccacggctgtcgcggcgggccgagaggtcgagcatgcgattggtcgaatcgacgctgaagcggtccatgcgcaggcccagcaacacctgccaggcgtcgtccagcttgatctg

SEQ ID NO: 39002 - DNA, 150 bp, Glycine max
  Peptide Sequence Number=SeqID_130687
atgggtgccaaatacctcgaagtggtcaaacgagggtcgcatcctaacaacggatggtccccggacaaaattagggagcgttgcccttgctcctacgtatcctcaagtgcgatgaggaactcagacctacatagttctttaaaagcatga

SEQ ID NO: 39003 - DNA, 237 bp, Glycine max
  Peptide Sequence Number=SeqID_130688
atgtcaggatttacacgcaattctcctcaaatttcagccagcccgcatcaattagaccttgcaccttacgcttcggggtcatgcaatgctcaatggaatgccccggggctcctccatgataagcacacgttgcgttcgagtcgtatcctcagaaaaatggaggttgaggaacattggttggggttatggctaccattgaattattgcagtggatatgggatcaagtttagcatatga

SEQ ID NO: 39004 - DNA, 358 bp, Glycine max
  Peptide Sequence Number=SeqID_130689
ggatgggttgtccctgtgtggtttagactttgtaatggattttacaaagatagtggaaatctcaagtgggttgcttgagtactggacggaggcacgggttgtggccgaaccacctatccctcttaagattattgaggccacaaggtccaacatggagtggatactacctacacctactccatatcgactagtggagccagttcaagtgatagaggtgtcatcctctgaagaggatcctgaagaggacccagaggagttacctcctgaacctgttgtggatgcccttgacttatctaaggatgatgaagacccactccttgatgttgattttccagaggatatcatgtcagcatctgag

SEQ ID NO: 39005 - DNA, 210 bp, Glycine max
  Peptide Sequence Number=SeqID_130690
atgtccaacttatcaatgcgtgtttatttctatggtacgctttgtaacgccagatccgacgactataagtgcccaagagatcgaaggtctaatacctgggacccgaccatcgatttgagcaagaagaatcaagaccggaggaaaggatatgagcaccttgtcaacccggaagttgttgaaaggcccttgaggcaagtatggggcctctag

SEQ ID NO: 39006 - DNA, 417 bp, Glycine max
  Peptide Sequence Number=SeqID_130691
atggcaacaggaaatacaaccatagaaaaacctagggatcaatggagtgaggaggaaaagagattagttcaatacaatttaaaagtcaaaaatatcattacatttgcattaggaataaatgaatactttagggtttcaaattgcaaacatgcaaaagatatatgggataccttacaagtaatccatgaaggggcaacagatgaacatgaaatggaattgaagagattgaatcaacatgaggagaatgataagaagaagaaaggaattgctcttaaagcttcatcttcaatccaagaagaaagtgataaggaggatttaattgaaatatatgaagatgacgatcttagtctttttgtaaaaatattcaacaaatttctaagagtcagaggaaatcaaagaagatcaaattttaaataa

SEQ ID NO: 39007 - DNA, 387 bp, Glycine max
  Peptide Sequence Number=SeqID_130692
atggctagaacacgaggtttaggtcgtgctatagatagacttataggcagagatagacaggatgaccatgatgcagttgatgttcctgagaggcgtaggcttactgcatcagcccataggcaacgtgttcatcagatgactgtggatgcacctgatatggctgcggatgttcctgacatgactgaggatgtccctgatatggctgaggatgcacctgagatgactgtggacatacagggtgatgatggtgctgaggggtcacatgctgatgatgctgagggattcctaggtgggccacgtgacccatcagtgctgacatcatttgcagaccatgttgcacacgccgtttggagtggacagtggaggtttttaccctccgcaaaataa

SEQ ID NO: 39008 - DNA, 324 bp, Glycine max
  Peptide Sequence Number=SeqID_130693
ggaggtggttgctgcccagctcgcccaggcgagctgggttgcttccaccagaaggcactgccttctgttggaacatcttggaaggcccaaaactttacagattgcgcattaacacttcctttcgactcccgacatgtcgcgaaacttcacggattgcctaacaatgggtgtcaagtacctcaaagtggtcaagcgaagggctcagattggagaccctttgtccacgctcatgactctagtgcctttagccgctttggggctttctgcatagcactgtcgtgcttgcttttgttctaccttgacggttacaatctccctggttag

SEQ ID NO: 39009 - DNA, 225 bp, Glycine max
  Peptide Sequence Number=SeqID_130694
atgttcaagattgaatcaagaacaattcaaggttcaagaggaaatttgatttcaagaatcaagaatcaagattcaaggttcaagcttccaagaatcaagatcaagattcaagattcaagaatcaagagaagaattaatcaagataagtatgaaaaagtttttcgaaaactgagtagcacatggatttttctcaaaacatgtttaccaaagagtttttactctcag

SEQ ID NO: 39010 - DNA, 335 bp, Glycine max
  Peptide Sequence Number=SeqID_130695
gtgctccagtggcttctgtttctatcagctgtccctcctgttcagctactgacggggtggtgcgtaacggcaaaagcaccgccgggacatcagcgctggcaagtgtagcggtcacgctgcgcgtaaccaccacacccgccgcgcttaatgcgccgctacagggcgcgtcccattcgccattcaggctgcgcaactgttggaaagggcgatcggtgcggccctcttcgctattacgccagctggcgaaagggggatgtgctgcaaggcgattaagttgggtaacgccagggttttcccagtcacgacgttgtaaaacgacggccagtgaattgtaa

SEQ ID NO: 39011 - DNA, 558 bp, Glycine max
  Peptide Sequence Number=SeqID_130696
atgaacctcacaatcactcacagactcatctcatactctcaggatgacttcctcttctcgctcagttctctacctgtcttctcacagcaaaagctctcaaaactctctggaacttggacctttctctctctagaaatctctaaacatgcaaaagcttcgagaattgcccaaactccctctccatttctgatttcaggcttgaataggtggccttgttggttcttgtgcgcattaatgttatttgacttagcgctcgtcttttcgctcagcggatggactcaagcggtgcgcttagcaggattagccctcgctcaacaaacatgcacaactcatccttcttccagattcttcctcgtgctcaaccaaaggagtgttgtgctcagcgaatggctcgctaagcgaaaagattggcttagcgagcggatgaaaatcaacacttcacaaacttgcctaattaacctgaaattgagaggaaatgattattatacacataaaatgggagtactaagaattgattacctatctttaaaaaaaagtaattgcaacactacaaaataa

SEQ ID NO: 39012 - DNA, 402 bp, Glycine max
  Peptide Sequence Number=SeqID_130697
atggcacaacctccaccccgtgagaggactctaagggaaatggctgcacctgatttcacctacgaaagcttgtgcatccaatacccagatgaggatgtcccatatgttcttaaaactggactgatccatttgcttccaaagtttcatggccttgcaggcctttcctcattctttagagggagtggaaaggactggctatattaccttgctccaaggtccatcacgagctgggatgacctcaagagagtattcttagaaaaaaatttccttgcttccaggaccacaaccatcagaaaggatatttcaggtattagacaactcagtggggagagcctgtcataccctaatttcgtccggggacttttgcttgatgacatgcgacctttgtttggtccttgtaag

SEQ ID NO: 39013 - DNA, 309 bp, Glycine max
  Peptide Sequence Number=SeqID_130698
atggttaccatggacaaatggatgaatattatggatatgagatatgccattgcttcacgatacaacgtgatcgttgtttctctttcacgacaacaaaacatgatgtcataccctaatttcgtctggggaccattgtttggtggcatgcaaccttcgcttgaccacctcgagcaatttgagtctaggcccttccggaacattttggaagttgggttgcttaaggaggaagcaactgggcggcaagctcctccacgttttttgaaaaatggtttcctgggcttccgtaaaatttctgaaaaccttgggtaa

SEQ ID NO: 39014 - DNA, 249 bp, Glycine max
  Peptide Sequence Number=SeqID_130699
atggcatctgtcgcaacctacccttcagcgggagggcgacgcggggttcatgggtgcgtcttccaggggagaaaaatgcgcggagtcgccaccaacgtttattcgaggaaaacgtcggaaaaaccggaaaggtgtggtctacgaactttaattgtgaaaggttcaggagttgtttttacgcacggggaagggtgtttcccttgctcctacgtattcctcaattatgataagggaatcagatctacgtag

SEQ ID NO: 39015 - DNA, 366 bp, Glycine max
  Peptide Sequence Number=SeqID_130700
atggcgggaaggcgtgctcgttttgaatttgcacatcatgggggccgcccatacttcccaaatctttgcctaccatatctgaggttggatgattcattgatgccggatggggacgtcgggttcaccttagcaacaacgctggtagcggcaattgcaaccgcattggcttccattatcttcttcatgctcatcatggcctccatcattgcggccatttgctctttcatagcctacatgtcggccttcaccttctcttgcacctcctctgctttacccattactctggctctagcacagaaatgggtttatgatcccaacatggttggctcatggtacctaacacatgcaactaagaatgcatcatga

SEQ ID NO: 39016 - DNA, 249 bp, Glycine max
  Peptide Sequence Number=SeqID_130701
atgtgcgatcggcgtcatccggtgatgacttcttttctaaacctcgatcggtcatctttcctggccgacgtcggtttgcattcttttcgatcagtacggctaaaggcccaagtggagaaggacgaagacccaagtggagaaggacaaagcccccaagtgagaaggatgaaggcccaagtggagaaggatgaagatccagaggcagagacactatcaagacaattaattgttgctgaaggcccaaactaa

SEQ ID NO: 39017 - DNA, 198 bp, Glycine max
  Peptide Sequence Number=SeqID_130702
atgaccaaacttggtctctgcttgtcatcgggcccgccgcctctggatgacaaaagggtgcgaataaccataagaatgaccaaacttggtctctgcgtgccaccggacacgactgtgtctgaatggcaaaggggtgcggataaccgtaagaatgaccaaacttggtctctgcgtgccaccggacacgactgtgtctga

SEQ ID NO: 39018 - DNA, 954 bp, Glycine max
  Peptide Sequence Number=SeqID_130703
atggatgactggaacattccagaaatccctcaggatcaattatacgttcctgaaacaattaaggacaaacacaacttcgattacataatcaaaatagtagaaaacaatattcatctaggacaagatataggggaagaatttcatttactttcaaaaaattcaatttatgaacatagccgtaagtataaatatctacacatcggttgtgtacaagtagccatcaagcccttaattgatatgggtatagatgcagcagttttaatgtgtctaagagatattagacataataaatttgaagactccctaattggaatagtcgaaaccagcctaggacaagtgagtctgatggacagaaacattcttgactctctgttcttaaacatccactttcatggccttgacatgaaagaaggatcaatcccagcagccttaatttataggatccagtacaaggtcatgaatacttgtgcatctagagtcctgttaaaacctcaaaaaggacaaacaactttgttaatcactgatatgacaaaggctaacgtttctctcccgagaaaaataaaatgggatgaagtaactcttcccgaaagatgggttatggataaggccacactgtcggttccccgacccgctccaaccatagagaatattaagcaagataactccgaaaaggtagagataaccttcaataggagaaattctttttcatcaaggatagaagcctctaggtctgaatatgagttagctagaaggtctttttcggttagaacccgttcaattccagtaggactaaccagatctgagtcacataaccagttccttactgtaaacctccaaggattagacactacttctagcatacctagaacaacatacaaccaagaacaagaggatgaccaaaagtcgatccaatccccaacatactcttctatggaaccttatgatgttatctga

SEQ ID NO: 39019 - DNA, 384 bp, Glycine max
  Peptide Sequence Number=SeqID_130704
atgtaccctccactagaactgatccacaagagatgtaccctctcttattctaagtcaacaacccaagtagatgcaccctttacttgtatcacaaagaatgtaccctccaatgtgttaagacaaagttctcaggtggttagtccttcgaaactttgtgaatggggaaacaaaagaattctcaggcgggagaagagagacacaaaaagaatccaggcggttagtcctttggcgaattctttttggcaaagggagaagagagacaaaataatagcggacaagtccttctctttggaaaaggagaaaaaccagaaaactttgggacaagctttttggcacaatgaagaagaagaagttcaaagagattcagggcttgtaaaagattga

SEQ ID NO: 39020 - DNA, 510 bp, Glycine max
  Peptide Sequence Number=SeqID_130705
atgactcaagagctggtagcccgcggagacaccttacggttatccgcacctcgtcattcagtgaccccaagtgtgattgacgagcagagaccaatatggtcatctgcgccctttgcggagatgtcatcattttccgatggagacttttcaagtctcataagttatccagaactacaggcggcaggcccgatgatacgcggagataccttacggttatccgcacccttctgtcatccagaggcggcgggcccgatgatacgcggagataccttacggttatccgcacccttttgtcatccagaggcagcgggcccgatgacaagcagagacaaaatttggtcattctgcacccttgtgtcatccagaggcggcgggcccgatgatgcgcggagataccttacggttatccgcacccttttgtcatccagaggcggcgggcccgatgacaagcagagacaaaatttggtcattctgcacccttgtgtcatccagaggcggcgggcccgatga

SEQ ID NO: 39021 - DNA, 234 bp, Glycine max
  Peptide Sequence Number=SeqID_130706
atgaagatgatgtgttttttgacaacaaacgatgaggttgctaaaacaaaacgggtgatggattctgttgcctcaaagcacttttgcagagatcgagagatgtttgatactttgaaaattgatggagaattcagtcatttcaagttagggaatggtggaaaaatgaaggttgaggggagggggagcgtgaagaccaaactccatgatggtgatattcaaactttctcaatgtga

SEQ ID NO: 39022 - DNA, 237 bp, Glycine max
  Peptide Sequence Number=SeqID_130707
atgagggacggcaagaggtctttgtacgtcattgggatcggggtgaattctgaagttggccttgggggaatgttccttatcgcgttggaaccggcgccaaagtgggcgttgccggccgggcgagtcggggttggagccggagcttggggggtctccctctggatgggcgcgggcgctctaggttgtacgggtgctgaattggaagagtcccctgcgcgagctgagaagctcgggtga

SEQ ID NO: 39023 - DNA, 213 bp, Glycine max
  Peptide Sequence Number=SeqID_130708
atgtgtctacccagggaaggggagtatgctgatgaaatctttctcataaccacaaatgagattttggagttaaacatttcgtttctaaatgaccatttagaggaaacactgggttcaacaaaaatagaagaaaatcactcaaagtgtattaatctcacacagatattgtctggtccaaagacctttatgcatgtttcttctattttcttttga

SEQ ID NO: 39024 - DNA, 852 bp, Glycine max
  Peptide Sequence Number=SeqID_130709
atggcttctagaaagagaaagagtattggtacaaggcccacatctcagtatgatacaaggaggaaggtagaaatataccacactaagctggacgagtttaaggctgaattagagaggcgtaacttccataaatgcctcactaatttagttgacagtagcatagatgtagctttggtgaaggagttttatgccaatctttacagctccgaaggaccttcaccaaaacaagtcagggtcagaggccacgtggtgaagattgatgtagacagcctcaacacctttctggagacacctgtggtactagctgagggtgaaaccttacccgcatattctagatactgcaggttgcccgctgatattagagaaattgaggttgccttatgtatcccaggtcggggtgttctctcctactccaacctggctcctacttcccacacctcggacctgacagtagatcgagctaggatgatctttagcctagtctctcagatggacatgaatgtgggagctctcatctctgatcagattacatctatggcccagcctaactcttctagacttgggttcaaacgcctgagcccggtcattaacttggcctatattaggaaaaactattggaaccctgatgatctgacagttactatcagaggggccaggagagcgaggacaaggccagttgaggcctcttccacatctacaactcctcctctagcacgtagcctagcagctccttctgcctcagctcttgcagattttcagtgttttgaagccatgcttcaaagcatccatcaggagcagattatcttattacaaagcttacaaatgatggcacctccagactctattccttcg

SEQ ID NO: 39025 - DNA, 285 bp, Glycine max
  Peptide Sequence Number=SeqID_130710
atggaggattcaattggaaaaataacaaagatcacatttcccagtcaagagggtccgcacttgacggtgaagaacacattggagaatggaggattcaatcgggaaaataacaaagatcacatttcccagtcaagagggtccgcacttgacggtgaaggacacatgaacagcgctaggcaatcaattcatggggctccgaataaaaggcgagaatggagaattgcactaggcaatcactacgcatggctccaaactcgttggtggaggaatcaaacgggaaaataa

SEQ ID NO: 39026 - DNA, 90 bp, Glycine max
  Peptide Sequence Number=SeqID_130711
atggcacatcagggacccattagggccatattacaacaacaacaacaacaacaacaacaacaacaacaacaacaacaacaacaacaataa

SEQ ID NO: 39027 - DNA, 180 bp, Glycine max
  Peptide Sequence Number=SeqID_130712
atggagagagaaaacagaatcgcaggaagacagtataaaatggaggcttcaatcccttcttctctctcacgtttgagaaccctatcagagcaattagagaaaaaaattgaggaatctcaggaacttgctagagatgccgctatcgctgtcgaaagacatgtgagcccgcttagagagtga

SEQ ID NO: 39028 - DNA, 69 bp, Glycine max
  Peptide Sequence Number=SeqID_130713
atgtcgtttcctactttcagctttggacaaacggaaagcgtcgttgcaaggcagcctagtatcctttaa

SEQ ID NO: 39029 - DNA, 387 bp, Glycine max
  Peptide Sequence Number=SeqID_130714
atgaccaagagcaagggcaaggatccacttgaagaacttggagggcctatgacaagggctagagcaaggaaagccaaggaagctcttcaacaagtgttgtccatactatttgaatacaagcccaagtttcaaggagaaaattccaaggttgttagtgggccattactaaaatctgctgtaaagcttctatataagctgaaccattttatcaataaacacaagttgagttttattcagaaaattagagtttatctcttttatcttagtgagagtgattctcctaaattcttgagtgattctcctaaattcttgagtgattcaagaacaccctggctgtatcaaaggactttcacaacctttgtgtgttgccctcgccgaaaagagtga

SEQ ID NO: 39030 - DNA, 225 bp, Glycine max
  Peptide Sequence Number=SeqID_130715
atgcagagccagggtttcgctcctttttcatgccctactccagaccagttcagagcagaggttgcatggcccggagattggcccgaggcccaagccggagaggcacccccagaagctcccggcgatggagaagaagcccacgaggatgaggagatggctgatttgcttgacttcttgggagggagtggagacaccgcatacattttgtttagatcgttgcgttag

SEQ ID NO: 39031 - DNA, 279 bp, Glycine max
  Peptide Sequence Number=SeqID_130716
atggagagatgtcataacttcaacaatgggaagagatctcaagaagtttctccaacacctaaatgctataagtgtaatcaacctggtcatataaaggcaaactgcccctcaaatgagacatggcccgagaagaatgagaagaaaagctataaagaaagaagatccaagaaggcgtatattgcttgggatgacaatgactcatccgatggttcggagaaggagatcaaccttctatccaaggactatgaaagtgatgagaacatctctcaagaagtttaa

SEQ ID NO: 39032 - DNA, 646 bp, Glycine max
  Peptide Sequence Number=SeqID_130717
tggcatgtattttcatggtgctcgtttttccaattatgaggcatggttaagtgatcctactcacattaggcctagtgctcagatttggagagcatctggaataactagtgaattacaactctattgtaccgcaattggtgcattggtctttgcagccttaatgcggggctcctggggttgggatctctttcttgggcaggacatcaaatacatgtatctcccaccaattaaccaatttctaaatgctgcagtagatcccaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggagctcaccatatgtattctatgcccccttatccatacctagctactgactatggtacacaactgtcattgtttacacatcatatgtggattggtggatttctcatagtcggtgctgctgcgcatgcagctatttttatggtaagagattatgatccgactattcgatacaacgatctattagatcgtgtccttagacatcgcgatgcaatcatatcacatcttaactgg

SEQ ID NO: 39033 - DNA, 252 bp, Glycine max
  Peptide Sequence Number=SeqID_130718
atgggtgatcaagaggagacacaggaacagatgaaagccgatatgtcggctctgaaagaacaaatggcttccatgatggaggtcatgttaggaatgaggcaactcatggagaaaaacatggccaccgctgccgccgttagttcggctgccgaagcagacccaactctcctagctaccccgcaccatcctcccccaaatacgataggacgaggaaggagcacactggggcacaacagggacgacttgtcctaa

SEQ ID NO: 39034 - DNA, 264 bp, Glycine max
  Peptide Sequence Number=SeqID_130719
atgtcgctcgagcaaacaaaccaatggctcgcacctacattccagcggaagcaaagatgtaattacgagaggatgagggacaatgattgtaaggattcaacaagcgactctcctcaaatttcagccagcccatatcatttagactttgcaccttatgctttagggtcatacagcgctcaatggaatgccctagggcccctccatgatatgcacatgttgcgttcaagtcgtatccttggaaaaatggaggttgaggaaacctag

SEQ ID NO: 39035 - DNA, 468 bp, Glycine max
  Peptide Sequence Number=SeqID_130720
atggcagaagtctccatagaggccattgcctccctcgcccagtattatgaccagccgttaaggtgcttcacttttggggacttccagctatcacccatggtggaagaatttgaagagatcctaggatgccctctaagtggaaagaaaccatacctcttcttaggattctatccctctttagctagaatttctaagatagtccaaatcttggcgaaggaattagaccacagaaagcaagtcgaaaatggggtggttggagtaccgagaagatgtttggaggcaaaggcaagaatcttggcaggtagaggcgaatgggccccgttcatagacatcctcacactgttgatcttcggaggagttctctttccaaatgtggatgggttagtggacctagcaacaagcaacgcttttctcgcctatcacgaccgcaaggaaagcctggttgtcgctatactagccgatctatag

SEQ ID NO: 39036 - DNA, 516 bp, Glycine max
  Peptide Sequence Number=SeqID_130721
atgactaatgcaaactgtctgcaagagtcattgcattcagtctcaaacgggaatctaagatatatctgcaaagaatgggaaattgggattgaaattgataccaatgtgaagagagaagaggtggaaaagctggtcaatgacttcatggcgggagagaaaggaaacaaaatgagacaaaagatcgtggagttgaagaagaaggcagaggaagccactacacccagtggttgttcattcatgaacttggacttcattaaggagagaaatctcgtgtacctagctgcaatagctgattctcaaccacaaccatctccattggctggtcagcctttctcagtgcttcaacagcagcaaggcatgcacaaccaacttggcatgagttccagtggaagtcaaggcctccacatgctgcaaagtgaagccactaatgttggaggcaatgtaaccataggaaccggaggagggtttccggactttgtacgcatcggtagtggcaagcaagatattgaatctcta

SEQ ID NO: 39037 - DNA, 183 bp, Glycine max
  Peptide Sequence Number=SeqID_130722
atgaaggcatattatgataagaagctacagaggaaagaattccagccaggacagcaggtattactctttaactcaaggctaaggctattcccagttgagttggtagaccccagagaagagaattttgagaagaaatggatcgtcaatggacaacgcttaaaggtctataatggtggacactag

SEQ ID NO: 39038 - DNA, 1005 bp, Glycine max
  Peptide Sequence Number=SeqID_130723
atggcgaaaccatcaaagaagcgaaagggcacttcaagtcggagtcaacggcattctgggtcacaggaaacaccaattccttcctccattccttttggatcattgttttcatctgaggaacagcggatacggtacacaaacctcttttcctctcgttccattatagacccaaaattcatatatatggatttcttttcaaatgagagttttaaatgctttcaagcatttgaaaactccaatcttattccattcatgtctctaaaattgcttgtttattctgatcttgtcaaagtcttctattcaaacttagaaatccaagaagacaacctaatgtctgaggtttatgggattaagatgttggatttttctgtgcatgatgcccgccggttggtttgcaccaaccaagcggatatgaccgaaaggcttcatgccggttcattggcttttgaaagctgcatccttcattatttaattgttctcatctttcttccaagatcttcaaaccttgcacaggcattgcgattgaatgctcctttgccttaccctcatctagtcacccttttccttcaacactttaacatccctcttgattctgaaccatatgttccaatcaagagatccttctttataggcgcttcagtcataacaatcctaccccgcaagggcattggcatacttccaagcttcttatccaaggctcatcttggtggtgaagctccttcttccattgcttattccctaccccacaagcaagcttccatcaagaagggtgctcgacatgttggtgaagaaggacatgatgaagaagattcatctcttctttcaaagattttggataggtttgatggccttcaaacctttgttggtgaaaggtttgacaatttggaattacaagtagatatgcgcttcaatgagatggagtcaagaatcactaaggttgaagaagatgtgtcttatattcgctcaagctttgatctaccaccaccgctgccaccatcatcttag

SEQ ID NO: 39039 - DNA, 459 bp, Glycine max
  Peptide Sequence Number=SeqID_130724
atggacaagtcctccacaacaacaacgcctgtccctccttttcagaatgctgctggtccaagcaagccatatgttcctcctccaatacaacaacagcagtcacaacaaagacaacaagcaactgaggcccttcctcaaccttccctagaagagttaaatccgaaaaatgtgagtgccatcaccctggggtctggcaaccaaattcaagtgcctccaccagtagcagcacctgcacctgaacctgtcaagcttcattctacacctgaaaaagaggatgagatagttgcacaaaagagaaagcttcctaacaaaaaattttatgcaagtgggacttcttctagtaattctgacttaccattgaattatcgagtagatatgggagcatggtggtgtttggcattgggtgcacggcaggcaagctttgtggctgatttagggatgacctttgtggatgactag

SEQ ID NO: 39040 - DNA, 268 bp, Glycine max
  Peptide Sequence Number=SeqID_130725
atgggagattccactaaagtagtgataaaacaagacatgaagggaagagagcataaatatgggtttaacaacaatgaacgtgagaagccagagaagaaaaaggtggtggatgatgaaactggcgacaaacatgagctggatgaaaaaattacattagacgatgttaatcaattctccttcatcatgatcattttgattagcatgaacgtcgtcaacttcttctctgacaacattaccagtgatttgagcggtcaaaggactaacatag

SEQ ID NO: 39041 - DNA, 321 bp, Glycine max
  Peptide Sequence Number=SeqID_130726
atggagctacctaagaattacccaaccccacttgcaaaacaaccagaaaattcccaggcagatacaagaagcataacacatgttgtctatcctaggattcaatggcaccatttatttctaactacaaaggacggcgaacaaaaattgataaaagcacgttcatcttctacagagaaaatgagtgggagtcgccaccaacgtatattcgaggaaaacattagaaaaactgaaagaggtctacggattttgaaaagaagggttcgagaattgtttacgcataggaaaggtattagcaccccacgtgcccgtcacaaagaatga

SEQ ID NO: 39042 - DNA, 339 bp, Glycine max
  Peptide Sequence Number=SeqID_130727
aaacaggcccagggggatgctccgcaggccgcagacgcgccgccacctcatcaggccggtccagccggatcgtttgatacagagcggtatttgcggcatttggttcgccagcaggcggccaaccaccgggcacatagccagggctttacttcttttccgtgccctactccggaccagttcagggcagaggtcgcatggcctggagattggcctgaggcccgggcaggagaggcgccagcagaggcaccagcagaggctcccgacgaggcagatgaggcccgcgaggacaaggagatgaccgatttacttgatttcttaggagggagcggggccacatga

SEQ ID NO: 39043 - DNA, 227 bp, Glycine max
  Peptide Sequence Number=SeqID_130728
atgtaccctctcttgttctctttgaacctagtggatgtaccctctgtcggaacctacccttcgacaagagggcgacgcgtgactcgcgggatgcgtgttccacgaaaggaatacgtgcggagtcgccaccaacgtttatttgaggaaaacgtcggcaaaaccggagaagacgcgatctacgaacttttaagtgaaaggctcgggagttgtatttacgcacggggaag

SEQ ID NO: 39044 - DNA, 156 bp, Glycine max
  Peptide Sequence Number=SeqID_130729
atgaagctaaatcaattgatgaatgacctcacaagtggacatgtctttggtgccattgttggatttgtttacaccattgagtggcaaaaaagaggattgcctcatgctcatattttaatatttctatatccttcaaacaagtatccaaatccataa

SEQ ID NO: 39045 - DNA, 237 bp, Glycine max
  Peptide Sequence Number=SeqID_130730
atgaagatggaagagactctagctcagttcatgaaggtttctatgtccaaccagaatagcacaaaatctgccataaagaatctagaggtccaagtgggacaacttgcaatgcaattggcaaatagatcgtcaagcagttttacagctaatatagagaaaaatcctaaggaggactgtaaagccacgatgactagaagcagaatggcaatccatgtggatgagagtgaagctgagaag

SEQ ID NO: 39046 - DNA, 239 bp, Glycine max
  Peptide Sequence Number=SeqID_130731
atataacagatttatatgtccagtattatcgggccggatgtcaggacatcgtgtccgacatcgtggatcctgcagcttcacttctgcacttttttcttgcatttaagaactccagatttcgggcaggatgtcaggacattgtatccgacatcgtcgaggatcctgcaacttcacttctgcccttgacttttatcttgcatttgtacattgtgcagcccgatctttattccttgacataa

SEQ ID NO: 39047 - DNA, 714 bp, Glycine max
  Peptide Sequence Number=SeqID_130732
atgagcgaactgcagcggctggaaaaaccctataagcgcatcatgatcgtcggcggcggcaacgtcggcgccggcctggccgccaagctggaaaaagactacaacgtcaaactgatcgagcggaaccagcaacgcgccgccgaactggccgagcagctgcacgataccatcgtgttctacggcgatgcctccgaccaggagctgctggccgaagagcacgtcgaacaggtggatgtcttcatcgccatcaccaacgacgatgaggccaacatcatgtccgccatgctggccaagcgcatgggcgccaagaaggtgatggtcttgatccagcgccgcgcctatgtcgatctggtgcagggcagcgtgatcgatatcgccatttcgccgcagcaggcgaccatctccgccctgttggggcacgtgcgcaaagcggatatcgtcagcgtctcgtcgctgcgccgcggcgtggcggaagcgatcgaagcgattgcccacggcgatgaaagcacgtccaaagtggtcggccgcatcgtcgaagacatcaagctgccaccgggtaccaccatcggcgcgatcgtacgtggtgacgacgtgatcatcgccaacggcaacagcaaaatcgaacagggcgatcacgtcatcatgtttattaccgacaagaaattcgtgccggacgttgaacgcctgttccaaccgagcccgttcttcttgtag

SEQ ID NO: 39048 - DNA, 323 bp, Glycine max
  Peptide Sequence Number=SeqID_130733
gataagctcgcgcctgtcatttcacgaggcttcaataagaccaacgtggagacacttcagaaggtccgcaaggcatgggaggtgttgcaaaagaaggacaaggaactcaggggcagtaacaatgggcccatcggtggctaccgtaaaaccgctaaaagggaggaagttgaggcaccggaggaagacgaagaggtgcaggcccttaggacggaactcaagcaagctcaaacagtcaaagaaagggctcgtagggaagagcatggccgaaacaagttccgaggggctctgtggggcagtgtcgcaacctacccttcggcgggagg

SEQ ID NO: 39049 - DNA, 302 bp, Glycine max
  Peptide Sequence Number=SeqID_130734
atgtctaatgtcaatgtgcttggttctgctgtgttgaacaggatttttagcaatagcactcaagttgtcacagaacaatgtcatgacttcttcttcgacattgtcatcctggagcaggttctggtgcccttggtgcaggggtctcctctgtggcttgatcctcttcctctgttgattcctcttcactgggtgaagggaggacttcagtatttggagtgggaagatgttggaacatctttatcagcatcaggcacaaaaacatttggggtggaagatgttgggacatccttatcagcttccgg

SEQ ID NO: 39050 - DNA, 456 bp, Glycine max
  Peptide Sequence Number=SeqID_130735
tccctacttctcagaaaggatttgataagcgaggatattcagactgagtttgatatccctgaagcatataatgtaaggacaaaaaagaaaatacttcagactgtgggggagcggtggagacagtttaagtctgatttgatgtccaaatgggaacttgcagccgacaaggacaatgtcgatgacactgtatgcgaaaagtacaacattagcaatgagaaatgggcccaattttgtcaaagctgcagagaccctttgtgggaggatgtgcgaaaaaaggcgcaagccatccagaagcaaaacactgtctctcatgtgttgtcttgtgggggttatgaatatttagaaaataagttgatggatgagaagagaaagaaaaaattggaggaagctgctcaatctggaagcactgacaccgtgattgatcctccctctcccatcagacgacacgtgaagtga

SEQ ID NO: 39051 - DNA, 498 bp, Glycine max
  Peptide Sequence Number=SeqID_130736
atggagagaagtatgatagatgctgccagtggtggagcccttggagacatgacccctgctgaagccaaaaatttaattgagaagatggcttcaaactcccaacaatttagtgctagaagtgatgctattgtcattagaggagtgcatgaagtagcgacgaattcatcttcatcagctgagactaagaagcttgaagcttatgctgcaaacatatacaacagacctcctcaacctcagcagcaaaatcagccacaacagagcaattatgacctctccagcaacagactatacgttcctccaccaatccagcagcaacaaccgcaacagccccaaaaacaacaaacagttgaggcccctccgcaacctttccttgaagaacatgtgaggcaaatgactatgcaaaacatgcagtttcaacaagagaccagagcctccattcagagcttaactaatcagatgagacaattggctacacagttaaatcaacaacagtcctag

SEQ ID NO: 39052 - DNA, 117 bp, Glycine max
  Peptide Sequence Number=SeqID_130737
atggggacctaccaaaaagataatcaagttcctgggtgtgtcagcaaatcccaggaaattgattactccactactgggtatatgagaaaagaagcaaacgactcatatccttcatga

SEQ ID NO: 39053 - DNA, 75 bp, Glycine max
  Peptide Sequence Number=SeqID_130738
atgggtataaaatgtggtatttatggtgccaattctgcagaatggattatgagcatgcagatgttgatatgttga

SEQ ID NO: 39054 - DNA, 288 bp, Glycine max
  Peptide Sequence Number=SeqID_130739
atgccgctccgccagcaaggagtgccgcgcacgagcggagcgaaagaaccaagtggtttgtgcattccgattgccttttgtgccagggccgacgacggtgccgtaccttccccttcggatttattaacgtatacatccgacatgctcgaagactcggcaagttccgggcgtagtagtagtacctcagcggtcaatcaaccgcttccgggggaacaagctatgcctcccgctcttcctgtttgcatttggaagctgctaatcgggctctgccctacccgggtggggtag

SEQ ID NO: 39055 - DNA, 222 bp, Glycine max
  Peptide Sequence Number=SeqID_130740
atgattgatgaatggggacgaatgctccctgaccctgaaagatggccttcttcaagaggaaggagagggttcactgatgtagctaataaagtacatagtatgggtttaaagtttgggattcatcttatgcctggaaccagtacacaggcatccaataacaacatgccaatactagatacaacaacagtagaaattcttaattattcctacaacattgtttga

SEQ ID NO: 39056 - DNA, 405 bp, Glycine max
  Peptide Sequence Number=SeqID_130741
atggccccgaggaaacttgcctcaaagagatccaggaaagataaaacggctaaaggaactagttccgctcccgagtatgacagtcaccgctttaggagcattgaacaccagcagcgcttcgaggctatcaagggatggtcatttctccgggagcgacgcatccagctcaggaacgatgagtataccgatttccaggaggagatagttcgccggcggtgggcatcactggttacccccatggccaagttcgatccagacatagtcctcgaattttatgccaatgcttggcctacagaggagggcgtgcgagatatgaggtcttgggtgaggggtcagtggatcccgtttgatgcagatgctatcggccaactcctgggatatcctttagtgctggaagagggttag

SEQ ID NO: 39057 - DNA, 1218 bp, Glycine max
  Peptide Sequence Number=SeqID_130742
aattttacttcctctatggatatggtggaactaacaaggcatttgtctggacaacattatcatctgctatatgctccaatggtggtattgtttatatagttgcttcaagtggaattgcttcattactattgcttggtggtagaacaacacatttcaaatttgttataccagtgcctgcaacacaaaattcaacatgtaatattcatcaaggtagcaacttagctgaattattgaaggttacaaaactaatagtctgggatgaagctccaatgtgtcacaagtttacttttgaggcacttgataaaagccttaaagacatcatccacaacaacctgccttttggaggcaaagttatagtttttggtggtgatttccgacaaatactacctattattccaaaaggtaatcgctcggatattttccatgcaactataaatgcatcatacatttggggtcattgccagattcttagattgacaaaaaacatgaggttgctatcaaatgtttctgggcagcccaataatcaagagctcaaacaattttctgattgtctactagacataggtggcggcaaagttggacaagctgatgatggattttctgaaatcaccatcccagatgagttccttataaaggactatactgatcctatccaagctattgttgaagcaacatatcccaacttgatacataactatagcaacacagaattacttgcaaaaaagaatagtgttgataaatcagatgaactactcaatcctgctttcggattactgacacctgaatttctaaactcattgcaaacatcaggaatacctaatcataaattaaaacttaaggttggtactccaattatgttggtacggaatttggaccaagctgatggattgtgcaatggaactaggcttattgttaccaaacttggttctaatgtagttgagacagaggtcattactggacctaatacaggagatagaacatacatacccagaatgaatatgtctccatctgattctctatggccatttaaacttattaggagacaatttccatttatattttcttatgctatgactataaacaagtctcagggtccatcattagaacatgtgggattgtatttgccgcacccgatttttagccatggccaattatatgttgccctttcaagagttaagagcaaaaaaggactacatattcttattcatgacaatcaag

SEQ ID NO: 39058 - DNA, 207 bp, Glycine max
  Peptide Sequence Number=SeqID_130743
atggggggtgaacttagtaactggggtgcccgtagaaatcttcctcaagaagcctctaggcggcaagcacctccctttttccctataataggggaggggaggggggactgtttcaaaatgttcatgacccctaagctatgcatttcggctattttgggcaaaaaacacgtttttgtgaagaaaaatcgagtcgaagtgcttccgtaa

SEQ ID NO: 39059 - DNA, 198 bp, Glycine max
  Peptide Sequence Number=SeqID_130744
atggatccgggttgtatcgtctcagttgagagacatgaaacacagggtgcagattcgataagctcggagcatttcaggcccaagaagtactacttcccccatcatcgtaccaataaagaggagttttgcacttccgcccatatagagcttcaaaaggagccataccaatgctggcttggtagctattgttgtaagtga

SEQ ID NO: 39060 - DNA, 267 bp, Glycine max
  Peptide Sequence Number=SeqID_130745
atggcacgcagcgtgtttgctcgtgcccctatgaacccgggtatagggccctttttcactcacatggagtcgccaactgtcgcaacctacccttcggcgggagggcgacgcgtgactcgcgggatgcgtgttccacgaaaggaacacgcgcggagtcgccaccaacgtttatttgaggaaaacgtcgaaaaaaccggaaaagacgcgatctacgaacttttaagtaaaaggttcgggagttgtatttacgcacggggaaggtattag

SEQ ID NO: 39061 - DNA, 177 bp, Glycine max
  Peptide Sequence Number=SeqID_130746
atggcatgcttggaccaacaacattctggaaaggagggacaggctattgttgctgctattgttgttgtggaggatttgcccatctcagatttggatgattcctccaacctggattgtatctattgcttgaaagatcataattattctgctgttcataggcttcaggttgctcattga

SEQ ID NO: 39062 - DNA, 494 bp, Glycine max
  Peptide Sequence Number=SeqID_130747
ggtacttgtacctatcacctttagaggactacacgtcctcgcccttgagaggactacatgtcctcgccataagagggtcgcacgccgtcacctttagaggactacacgtcctcaccatcagaggacttcatgccctcatcagagggctgcacgccctcacctctagaagactacacatgctcgccaccagaggacacgccctcaccttgggactaaggactacacgtcctcaccatcagagggctagcacgccctcaccttcagaagactacacgtcctcacaatcagagagctgcacgtcctcaccatcaaagggctgcacgtcctcgccatcagagggcagcacgccctcaccttcagagggctgcacgttgtcgcaacctacccttcggcgggagggcgacgcgagactcgcgggatgcgtgttccacgaaaggaatacgcgcggagtcgccaccaacgtttattcgaggaaaacgtcggggatcctctag

SEQ ID NO: 39063 - DNA, 249 bp, Glycine max
  Peptide Sequence Number=SeqID_130748
atgactattgcaaacagtattaagacaactctccctaaaattgaaagtgctaaaaggtttatggggttagtgggagagcactctcaaacagctgataagtctgtttctgggacattaatgactacattgaccaccatgaactttggtggttcactggaagacaaaggagaagaggtgagaggaggcgccatccataagggaataagccatggaagaaggagcttcaccaccaagatgagccttggataa

SEQ ID NO: 39064 - DNA, 324 bp, Glycine max
  Peptide Sequence Number=SeqID_130749
atggatgtgacatttaatgagaataaatttttttatgttgattctacacttcagggaggaaatgaaagtgaagtgcataatcatgatgttatgtcttttgatcataaccaattggctcaatcttctccacaggtttggcttgactcttcagatgtaccttctgatcttatctttgataatactaatgtagatgaaactgatcatgaaattgtttctcttgatcctacccttgataatactaatttagatgaaatcgatcatgaaattgatccttgtctatgtgagaccactagcacaccaaacactgagtctactactatctaa

SEQ ID NO: 39065 - DNA, 381 bp, Glycine max
  Peptide Sequence Number=SeqID_130750
atgaccaaacttggtctctgcttgtcatcgggcccgccgcctctggatgacaaaaaggtgcggataaccgtaagaatgaccaaacttggtctctgcttgtcatcgggcccgccgcctctggatgacaaaaagggtgcggataaccgtaaggtatctccacgggctaccagctcttgtgtcatggcaacaaaaggcggtgtggtcgacaaaagcgaggctcttgctcctacgtatcctccaatgaggaactcagacctacgtaggttctggacaacttgtgagactggaaaaaggctcggtgttttctccactaaaatgcaaacatgctttagcaaagagacaaatattccaactgatttagagcagcatatgcttttttga

SEQ ID NO: 39066 - DNA, 498 bp, Glycine max
  Peptide Sequence Number=SeqID_130751
cttgtcatagtatcaagtgaggaggatatactagtaagttgtctgtcttctgcgccttatgttgaagtagaagaggagtcactagaaacgtcgtttcaagcattggaaattgtgaataatgcttatgtggagtctccttcgatacaaccatatttgtctgatacctctttgatggtagctcgagttatgctaaaggatgggtttgagcctggaatgggtttgggccggaatggtggtggcgcggtaagcctgttgaagattgctgaaaattatgggaggtttggtttgggttacaagcctacaagtgtttacaaaaggaggattgctttggaaaggaaagagaaaagcttagctcgtttacaagggcgaggatcacaggtggaaagggtccttatttgtcacatcaatgagagctttgtgagtgtagggtggctgcatgaagatcaggttgctatgctggataaagagaccaatcaagatcagtcgaattgggtgtag

SEQ ID NO: 39067 - DNA, 279 bp, Glycine max
  Peptide Sequence Number=SeqID_130752
atgtcatatgcttacttactcccgtatctgctcaataatgcaatggtagtcgtaagctcaataaagattcctcaacctccatttccccaaggatacaactcaaatgtgacatgtgcttatcatgtaggagctccgaggaattccattgagcattgtatggccttgaaacataagcttgtttgctcaagtgacctacgttctagagttgatctccaagtctgcccaattagaaatggtgtgttctacacatttggtggcggtgccataaacgacgagtaa

SEQ ID NO: 39068 - DNA, 240 bp, Glycine max
  Peptide Sequence Number=SeqID_130753
atgaaagattgcagaaatacaagtagtgggaatgtctcctccacctctaggacctcacaattactcacaaactcatctcaagctctcaggatggcttcctcttcgagctctgcggatggactgaagtggtgcgcttcgctggatgacccttcgctcagcgaacatgcacaactcatccttcttccagattcttccttgcgctcagccgaggagtgttgcgctcaacggatggctcgctaa

SEQ ID NO: 39069 - DNA, 483 bp, Glycine max
  Peptide Sequence Number=SeqID_130754
atgtgggcctttcaaaaaggtttacaaattgattgggcacatcttgttagatatgacatgcatatggcattgcgattgaatgctccattgccttaccttcatcttgttacccttttccttcaacacttcaacatccctcttgattctgaaccttatgttctaatcaaaagatctttccttataggcgcttcagtcatagcatcttttggttatcaagaggagcatgatggctcttgggtgaagaaaggtgctcgacatgttggtgaagaaggacatgatggagaggattcatctctcctttcaaagataatggacaggtttgatggtcttcaaacctttcttggtgaaaggtttgacactttggaattacaagtggatatgagcttcaatgaaatggagtcaagaatcacaaaggttgaagaagatgtgtcttacattcgttcaagctttgatcttccaccaccgccgccaccatcatcttag

SEQ ID NO: 39070 - DNA, 228 bp, Glycine max
  Peptide Sequence Number=SeqID_130755
atggggctccgaaaaagggttgagaatggagaattgcaccaagcaatcactacgcatggctccaaactcgaaggtggaggacgcatgaacgaaaacgcaattcatgggctccggaaaaaggttgtgaatggagaattgcactacgcaatcactacgcatggctccaaactcgtgggtgcaggacacatgaacgaaaatgcaattcatggggctccgaaaaagggttga

SEQ ID NO: 39071 - DNA, 351 bp, Glycine max
  Peptide Sequence Number=SeqID_130756
atgactcaagagctggtagcccgcggagacaccttacggttatccgcacctcgtcattcagtgaccccaagtgtgattgacgagcagaggccaatgtggtcatctgcgccctttccggagatgtcagcattttccgatggagacttttcaagtctcacaagttatccagaactacgtcatgtgacgtgcacccttgtatcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatga

SEQ ID NO: 39072 - DNA, 291 bp, Glycine max
  Peptide Sequence Number=SeqID_130757
atgacgaaaagggagatgataacaatgatagtagacacattaacagtgttctactatgaagaatggtgggttacacaccttcaagttttagggatttggtcttcgccagctaatggattgatgtgggtccgaaaagagggtgagaatgagggagaaacccatgttgtgactaccattcctatacggccaagtttctcaccaacccaacaatgtcattactcagccaataacaacccttctccttacccaccaccaagttatccacaaaggtcatccctaaatcaaccataa

SEQ ID NO: 39073 - DNA, 2073 bp, Glycine max
  Peptide Sequence Number=SeqID_130758
atgtcgcaactgacccatatcaacgccgctggcgaagcgcacatggtggatgtctccgccaaagcggaaaccgtgcgtgaagcgcgggcggaagcctttgtcaccatgcgcagcgagacgctggcgatgattattgatggtcgccaccacaaaggcgacgtatttgccactgcgcgtattgccggtattcaggcggcaaaacgcacctgggatctgatcccgctctgtcatccgctgatgctcagcaaagttgaagtcaatttacaggccgagccggagcacaatcgggtgcgtatagaaaccttatgccgcctgaccgggaaaaccggtgtcgaaatggaagcattaaccgcggcctccgtggcggcgctgaccatttatgacatgtgcaaagcggtgcaaaaagatatggtgattggtccggtgcgcgagttggtgggaacagatgcaaccgaagtggctgcggatttcccaactgttgaagcgttacgccagcacatggctgcgcagagcgatcgctgggcgctggcgctggaagatggcaaattactggctgccgtcaaccagacgctggtgagttttgaccatccgctgactgacggcgacgaagtagctttcttcccgccgccgttcagcgtaggagaagagtacccgtggctggcggagcgtgacgaagacggtgcggtagtcacctttactggtaaggtgcgcaaccataacctgggcgacagcgtcaacgcattaaccctcgaacactatccggggatgactgaaaaagcactggcagaaattgttgatgaagcgcgtaaccgctggccgctggggcgcgtcactgtgattcaccgcatcggggaattatggccgggcgatgaaatcgtttttgtcggtgtcaccagtgcgcatcgcagcagtgcgtttgaagccgggcagtttattatggattatctcaaaacccgcgcaccgttctggaagcgcgaagccacgccggaaggcgaccgctgggttgaagctcgggagagcgatcagcaggcggcaaacgctggcaccgctgcgtccggcaatttcaccgctcagtacatacgtttacgctgcgtcgatgcacagcctcatcattttgcagtatccttaagatattccttatatcttcaggagatcgtcatggacagattcccacgttctgattcaatcgtacaaccccgggctggcttgcaaacttatatggctcaagtctatggctggatgaccgttggcttgttgctgaccgcatttgttgcctggtatgcggctaattccgcggccgtgatggagctgttgttcactaaccgtgtctttttaatcggtctgatcatcgcgcaattagcattggttattgtgttatcagcgatgattcaaaagctgagcgcaggtgtaacgacgatgctctttatgctttattcggcgctgacgggtcttacgctttccagtatattcattgtctataccgctgcttctatcgccagtactttcgtcgttactgccgggatgttcggcgcaatgagcctgtacggttacaccacgaagcgcgatttaagtggctttggcaatatgctgtttatggcgttaatcggcattgtgctggcatcgctggtcaacttctggttgaaaagcgaagcattgatgtgggcagttacctacatcggcgtgattgtctttgtcggattgacggcgtatgacacgcagaaactgaaaaatatgggtgagcagattgatacccgcgacacgtcgaacctgcgcaaatattccattcttggcgcgttaaccttgtatctggacttcatcaacctgatattaaacggtatatggctcattaccgctttaggtttggtggcaaccgcaggactagcctggggagctaataaggatatcaacaagataaatgccgccatcgcgggcgtaatatatctgtttttactctctttggtggcgattgtcgttgcaagtttagttcctgtatatgccattatcatcgtgttcagcactgcgggcgcgatggttggccctggtaatcatcgtgaatgcggcattaatgagtga

SEQ ID NO: 39074 - DNA, 303 bp, Glycine max
  Peptide Sequence Number=SeqID_130759
atggctcattttattccttgtaggaaatttgatgatgctaatcatgtggcggatttgttcctcaaagaagtagtgaaactccatggattaccaagaagcattatgatgacaaaggtgatgaacaaaaaactcaaaagatcaaagaacaactcaagtgaatcaaagaacatctcaagtgaatcaagaacaagtcaagagttcaagaatcaagaaaaattcaagactcaagaagaaagcctacaatcaagaatcaagattcaagatacaagatctcaagattcaagactcaagattcaagaataa

SEQ ID NO: 39075 - DNA, 177 bp, Glycine max
  Peptide Sequence Number=SeqID_130760
atgtggtaccatggagaccagtcagggtcacagtgttttgcgagaatgctccaaccatatgggatcaacataggcttaaaggagcactcaaatcgggtgactcccaaggcctacactccgaagagtccgtcagggcctctccctcatgattcaggttcaacccagaaaacattttag

SEQ ID NO: 39076 - DNA, 381 bp, Glycine max
  Peptide Sequence Number=SeqID_130761
atgtgccacatggtctatcccatcttcgcacttggcgatcaggatttcttctgccgcgatgtctccctgcttctacttgctcagcctcagcagaaaactcctaacacaaatcaacacctaataagtcacccatatcagacatatctgtgcgatgaccttcaaacggatactgatacatctgtgaatgatactgagaaaatgttggtggcgtgtaatacattccatggccacactcctcaatctgttgggaaaattcttgtgcttcaacagccttccttcgtctgtcaaaacctcgagtttcaacacttgactgaagcatgtgaaactcttgtggtggaaattgacgctttgatgttggaccatgtgccacaggctcagtga

SEQ ID NO: 39077 - DNA, 728 bp, Glycine max
  Peptide Sequence Number=SeqID_130762
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccaggggtcttgctttgttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 39078 - DNA, 171 bp, Glycine max
  Peptide Sequence Number=SeqID_130763
atggggctattgctcaagcaaaggaaccaagatcaaaccataagtccaaacatattttgcgaagatggaaaggagaatgcaacagatcccttcaccaaggcgcttggcataaaggagtttgacaaggacaaatgggaattaggaatgaagttcatgaatgattggctctag

SEQ ID NO: 39079 - DNA, 354 bp, Glycine max
  Peptide Sequence Number=SeqID_130764
atgaccatgattacgccaagctcgaaattaaccctcactaaagggaacaaaagctgtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 39080 - DNA, 231 bp, Glycine max
  Peptide Sequence Number=SeqID_130765
atggcagcggaatggagaaggaagagagagaggagacgccacttcaaggagaagatgagtttagaaaaagctcaccaccataggaggtcatggataagagcctggaggaagaagaagatgaatgaagggagagggagagaagagcaggaaattttgtgctctaaaagagctctaaaatctgaacccactaatccaagatcaattccaagattctccactaagtgtgcttag

SEQ ID NO: 39081 - DNA, 396 bp, Glycine max
  Peptide Sequence Number=SeqID_130766
atgtttgcacattcgattaaaggctgccgtcccttgggacggacgtgtggggtgctaataccttccccggatcaaagggttcccatgaaccctaagagaataaagagtgttgagaaaaaatgccctgagtttgaagaacctcaggatttgaggtcaaatccttttcaagggggaggtgtcgcaacctacccttcggctgaagggcgacgcgggactcacgggtgcgtcttccaagggaggaaggcgcatggagtccccaccaacgtttattcgaggaaaacgtcggaaaaaccgaaaaggtgtggtctacgaactttaatagtgaaaggttcgggagttgtttctacgcatggggaaggtattagcaccccacccgtccgtcacaacagacggtag

SEQ ID NO: 39082 - DNA, 699 bp, Glycine max
  Peptide Sequence Number=SeqID_130767
cggaatgacaccggtaaccgaaaggcaggacagagagcgcacgagggagccgccagggggaaacgctggtatcttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttccggccgccaccgcggtggagctccaattcgccctatagtgagttattacaatctcactggccgtcgttttacaacgtcgtgactgggaaaaccctggccagttacccaacattaatcgccattgagcacatccccctttacgccgctggaatagcgaaaggcccgcactcgatccccttcccaacagcaagggtaagtggtgagttagcgtcagcgtctgaccccaggctacacttgccgcgtgatgtccggctcggtatgttgtgtgcgaattggacggataacacaccccgttcagagctgaacaggagggaacagctgatagaaccagatacgccactggagcctcaaataacccatcactacactaaatcaaaagctggatcaccggcctttgcccaaaacctgaggtcgacgggtgggggtactcacacttttggcgaaaatgagtataacgttgatcggcac

SEQ ID NO: 39083 - DNA, 742 bp, Glycine max
  Peptide Sequence Number=SeqID_130768
gtttgcactcctgaggcctgatcctcaggagttggctactaagctctgtatcccggggaggggatttgagcttaatgttgatgggcagccattgaagatattgaggaagaacatgaccactttagctcagacatggagtgttttttccttttctaacctcattcctacctcccacacatttgatgtcaccttgaacagagccaagttgatttatggcatcattatgaagatggatatgaatttggggtacctcatctcccaccagatctctctaattgcacaacatgatacatccagacttggattccctgccttgatcataactctctacaaggccagaggagtccagtcagattctagatccctggagaacttgagccctgccattaacttggcatatattaagaagaactgttggaatcttgatgatccaatagtgacatttagagggacaaggaaggccaggggtaggagatcagaggtggcctggccagaagcccaaccttctctttttggagggggtgcagcctctgcagcccaggagcctgctcttgaggagccagcagcagtagtagcagtagagggggaggatgagctcacccctcctaagcctttttattttgatgcagatgtacacatggctcaggaggaggagacttctacagaccagatcccagggccatccccaacacccacacctgatgatgccataccatttgcaccaacatctaagttagagtag

SEQ ID NO: 39084 - DNA, 579 bp, Glycine max
  Peptide Sequence Number=SeqID_130769
atggtgaaagttggaacgtcttacgtgccgatcaacgtctcatcttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatggggaggaatcagatcaacggcgttctgctcaaagtcctcaagaacaaccctaattttaacggcacctattcctgctgggagcccaatgcgctggatggccgcgaccctgattatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 39085 - DNA, 910 bp, Glycine max
  Peptide Sequence Number=SeqID_130770
atgaattgtgatttagctggaggagagcatcacaaggacaattgttatttttattctataaataactttgaccggagacaggaattggtcatgtacgactaccatgagaaagaaagagcccctgatcttgaaagtattttggcaaacttcatgacattccaagctagctctaaaggttactgttattctatgcaacaacagggaactcaatttgaaaggaaccagtcttttgaaagttatcaatgggagtcataccggcaaccctattatcacaataaagcagaaggagttcttaatctggatgatttgttaatgcaattcaaagatacggtaaagtcaatgcaacaggcctttagaaggactgaaactcagattagtaagttggtggatgaaatgactaacgctgcagccagaaaagaggaagagcatgcagagattgaaatacatcaagaaagcattcatcaagttacctcaatccatcatcaattgaccaatgaagaggaaaagcctgaagtctccagtactccagaatatccctacttggccactgttggctatgttggagggaaagataaaggtagattagaactcagtgtggaggatcaaaagatctcttttgacctctttgaggccatgaaacacttagatatgggtgatgcccattttgaagaagaagaggtggagcgggaaatagcattatcaacttcaaccatggtggtttttgaagaattgaaaaaattgagaccagcagaaaatcccaaagcagaattaaaaacccttctggcacatttaaagtatgtattcttggaagaagatgagaccaaacctgttataattagcaactctttgaagaaagaagaagaagaagatcaactagtgcatattctaaaacgtcataaagcggctattg

SEQ ID NO: 39086 - DNA, 243 bp, Glycine max
  Peptide Sequence Number=SeqID_130771
gattgcatcactactcctgagagatctcttgaggacacttcagagcctcctacaccagtagtggacctatcctcacctcagcatgcagtagacccctccactcctatactagagatactagaggacccaaccacaccagtcctgactctgaacacttctcccccagctactccagtactttatctgacagatgaggaggatgttcagacacaggatactcaggaccagtcacaggaattctaa

SEQ ID NO: 39087 - DNA, 905 bp, Glycine max
  Peptide Sequence Number=SeqID_130772
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatactttccttcctccctgctccttttcctgctcttctcttagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 39088 - DNA, 444 bp, Glycine max
  Peptide Sequence Number=SeqID_130773
atgaccatgattacgccaagctcgaaattaaccctcactaaagggaacaaaagctggtcgttgatcgcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 39089 - DNA, 474 bp, Glycine max
  Peptide Sequence Number=SeqID_130774
atgttcccaacatcttccactcccaatgctgaagtcctctcttcctccagcaaagagagatcaacagaggaagatgatcaagccacagaggagacccctgcaccacgggcaccagaacctgctctaggtgacctcattgacctagaagaagtagaatctgatgaggaacccattgccaacaagttggcacctggcattgcagaaagactacaaagccgaaagggaaaaacccccgttaagaggtctggacgaatcaaaactatggcacagaagaagagcactccaatcactccctaccacatccagacggagcaaattgacattgaaggaactggaaatcagcaggagatcatttgtcacaaaggcatgctggactgcatcagtttgaaaaactgcaggggccaagctgggcatttgatgtgctatgaggaagttatagcagctacgctgaacgtgctcaaacgtctcacttaa

SEQ ID NO: 39090 - DNA, 188 bp, Glycine max
  Peptide Sequence Number=SeqID_130775
gtagtggtgaacatcaattggatgaggcacaaagattcttgttggatgctctcaatgctcaaatgcaaagactattgagggagaatgatgagaatcctgaaactggccaaatacaggctaaaggcccaagtggagaaggacgaaggcccaaatggagaaggacaaagcccccgagtggagaaggatga

SEQ ID NO: 39091 - DNA, 408 bp, Glycine max
  Peptide Sequence Number=SeqID_130776
atgttgacacatttctgccccatgctaatcctttcattgcctttgagcttccttttatgggtgcacaactcctttagaaacttggcatatcttggaatatgcttgatggcatctagcagaggtgggaatggaagagggataggaggttgtgactctgaatggaggctcttgtctcttgctaaaattgcatattctggatggtcatttgcctcactaactcttctaaggaaggttgaggaggggcctcaattgcttgttgtctttgttgttgctgcattggaggaggaacatgtggcttgcttggaccaacaacattctagaaaggagggacagactgttgttgttgtggaggacttgtccatctcagtttggatgattcctccaacctggattgtatttgttgcttga

SEQ ID NO: 39092 - DNA, 249 bp, Glycine max
  Peptide Sequence Number=SeqID_130777
atgaacaggactttagagttagaccagtttccactgttgaatgaccctaacaaagcatgcatctacgtgatcaaggtacctacagggaaagatccaacagaggatttagctttcgataccaggaagtcttctttacaacaaagagaagaccaagatgaaaagattgcaaaaatacaagtggtgaggatgtctccttcacctttaggatctcacaatcactcacaaactcatctcaagctctcaaactag

SEQ ID NO: 39093 - DNA, 848 bp, Glycine max
  Peptide Sequence Number=SeqID_130778
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcatctcccgcgcgggggcaagctggcgctgctcgtctggggcgatccctcgctctatgacagcaccttgcgcattgccgcgcgattgcagcgcgaaggactcgatcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 39094 - DNA, 147 bp, Glycine max
  Peptide Sequence Number=SeqID_130779
atggggagagttaacctagggttaaatgtgagaatggtagtgatgacttgtgggaaagcctgggctgagcaaaggagaaaaatgagtgacaaaggaaatgcttgtgcattgctggttatgggaaaggtagtacatattgggttctag

SEQ ID NO: 39095 - DNA, 598 bp, Glycine max
  Peptide Sequence Number=SeqID_130780
atggctacgagaaagctttccgcaaagagatccaggaaggacgccgtggctgaagggaccagtgccgctcccgagtttgacaaccatcgttttaggagcgctgagcaccagcagtgtttcgaggccatcaaaggatggtcattccaccgagagagacgcgtccagctcagggacaatgagcacacagatttccaggaggagatagctcgccggcgttggacgtcgctggtcactcccatggccaagtttgatccgaatatagttctagagttttatgccaatgcttggcccacagaggagggcgtgcgggacatgcggtcatgggccgatggatttgacgaggaggccattgcccagctgttatgcataccgggtcaggattttgcccagaccgttgccgggagacgggtgcggatcatgcgcatcaacatgactaccttgacccagacgtggatgacgttgttgcacagcaacatcctgcccatcgatcataactccgacctccctctgccgaagtgtcagctggtgtatgccatcctgacatggatgagcgtccatgtggctcagttgatcactgatgccatttatttatttgcag

SEQ ID NO: 39096 - DNA, 75 bp, Glycine max
  Peptide Sequence Number=SeqID_130781
atgtcccactggaatggccccgaggaagcttgcctcaaagaggtccaggaaggacaaggcggccgaaggaactag

SEQ ID NO: 39097 - DNA, 53 bp, Glycine max
  Peptide Sequence Number=SeqID_130782
atgcgtggctatgattctgctgagggtagctcctgggatattaaccaacactt

SEQ ID NO: 39098 - DNA, 1284 bp, Glycine max
  Peptide Sequence Number=SeqID_130783
atggagttttggttgttttggctagctatggatttccccctgttttttcattgtctttttcatgcgatcctcgtgtcggttaaacccaatgcatgcagctctgttttcgtgttccatgagggaaaatcaagtttgaagatgacacaactgccttttatggcggttgtttgtatagtaatgttgtttgttgtgtataggactctaaagtatcaaagttaccaagaacagatagacaaacagtggaatatcagggaagaggaaaaggcatataccgaaacttctggaaacctgaagggcttaccacaaggtataatacaagctacttcagatcttgagttaaggcgtttatggtcgccaagtaatttgaggtcaaaggctagtgtttactccaatcgcaacttactggcagttgcagttggtattaaacaaaagcataatgtagatgtgatggtgcaaaagtttcttccagataatttcacaattattttattccattatgatgccaatctggatgggtggtgggatcttagttggagtagcaaggccatacatataactgctcaaaaccaaacaaagtggtggtttgcaaaaagatttctacatccagatatagtttctatttatgattatatctttctctgggatgaggatttaggggtggaacatttttctccatcaagatacattgaaattgtgaaggaagaaggattggagatatctcaaccagcccttgacccaaattcgacagagatacatcatagaattacagttagagctaggactaagaaagttcataggagagtctatgaactcagaggcaatactaagtgttcagacgcaagtaaagggcctccatgcactgggtttgtggaaggtatggctcctgttttctctcgatctgcctggtattgtacttggcatcttatacagaatgaccttgtccatggatggggattggatatgaaagtaggatattgtgcacagggagaacgcactcaaaatgtgggagttgttgatagtgaatttgttgttcacaagggaatacaaactctgggtggtagcgacgatccaactaaagtttcaagtcagaaaaggaaaactccgagacacggtgcagcggcctttgatcaacgagttgagatacgaagacaatcaacatgggaacttgaagtcttcaatgagcggtggaatagagctattgctgaggacaaaaactgggttaatccattcaagagtgataaaaaacgcattagacaaaggcagaaaaccaaccggttctcttaa

SEQ ID NO: 39099 - DNA, 360 bp, Glycine max
  Peptide Sequence Number=SeqID_130784
atgggatttattcctatgctctttaattttctgttttttttctctctttctttttgtaatcagccagtaagagtatacaacatgatgaaatatgctgcaatagcttgtggggatgctgaggttttcatgaagtttgcaagggctggttacaaggagaaaatatgggatcatgctgctggtgctatcatcatacgagaggctggaggaatagtaacagatgttagggggcatcccttggaattctcaaaaggtttatatttagaaaggcttgatcgtggcatagttgcttgtgctggacccacattacatgaaaagatcattgatgctgttgatgctagctgggcctcttcttgtctttga

SEQ ID NO: 39100 - DNA, 354 bp, Glycine max
  Peptide Sequence Number=SeqID_130785
atgtacacaactcatcatcttgcaagaagcgcatatataggcaagtgcaaggcatcctccaaagtcagcaagaccatgaattccttatgcagatcaatggttgcagttatgcttgcaatgtcattgatcctttcacttggggtgattatgtcccaagctagggcatacccgtcatccttagtttcaagaatgtcacaatcttcccaatcactttcacgtccactttggcacaaagtagggcaaaaatcaactctggagcctgtggtaactgctaaccttagaaggataccacctagcacaccaaatcctacacagaacatagggttgacgccgccacctggggaaagtgactaa

SEQ ID NO: 39101 - DNA, 1395 bp, Glycine max
  Peptide Sequence Number=SeqID_130786
atgtcggcttccacggtgtccatcacggcggcgaacccggggactcgtcggagaccggtgatcgccactgagaagaaaaccgccactagcctcgaactcctcgccaacgacgtcgccgtctccccggccgtcgccacttccggagacggcgccaccgggcgcgacctcagccatcactcgatccgcggcgaggcgctcctcgaccgggcgccccgtgacttgactccagcgaagaaggtcgccggcgccggcccaaactcggcgtcgggcccgccgcggcggactcggaagcccgccgcaaagtccgagaagccgcggtggctcacgttggtgagcattttcgggaagaatttggtgctcttggtggtgctggctgggctggtccagttgatccggcggatgtcgttgaaatctggcgatgccgcggcaggcgggttcgctgggttttcggaattcgagggccggatttcggatgtggaggggctgttgaagaagacagcaaagatgattcaggttcaagttgatgtggtggataagaagattgaggatgaggttagagggttaaggaaggagctaaatgagaaaattgaggagaaaggggtaattttggaaagtgggttgaagaaattggaggcaaagaatgaggaattagagaagtatttgagtgagttgaagggagagaattggttatcaaaggaagagtttgagaagtttgttgaggaagtaaggagtgtgaaggggagtgggtatgagggtggtgggttggatgagataagagagtttgcaagaggggtgattgagaaggagattgagaagcatgctgctgatgggcttgggagagtggattatgctcttgccagcggcggtggtacggtggtgaagcattcggaggtgtttgatctggggaggggcaattggttcttgaagtctgctagaaatggtgtcaaccccaacgccgagaagatgttgaaaccgagctttggcgagcctgggcagtgtttccccttgaaggatactagagggtttgtgcagatcaggctccgcactgccatcattcccgaggctgtcaccttggaacatgtagcaaagagtgttgcatatgatagatcaagtgctcctaaagactgcagagtctctggttggctgcaggagcataatgctgattctgcaattgatactgaaaagatgcatcttctatcagaatttacatatgaccttgagaagagcaatgctcaaacattcaacgtgttgaattcagcagcttctggtgtaatcaacatggtgaggctcgattttacatccaaccatggaagcccttcacacacatgtatatatcgctttagagttcatggtcacgagcctgactcggtttctatgatggcattggagtcataa

SEQ ID NO: 39102 - DNA, 663 bp, Glycine max
  Peptide Sequence Number=SeqID_130787
atggaggccttgttcatgagtcaaatcaagaagcactatcaaaaggtgggcacaagcattcttggtgttacagagtgtctaggcataaagcggtacttaggtatgcttttgttagtgggatggaagaagaacgatgtttttaatttcgttaaggaaaaggttgggaacggcggagatgggacgtgcgaatggaagaatgtggctcctccaccgtctccggcagctcattacaacccaccaccgccattcccctcctatcaccgatggcggcattttccgttttgtcctcgtcacgcaagcccttccaccaccctggattccaactcagtatcaatatcactctcccaacccaattcgaactcaaaccctaaccctctgaatttcaccttcatcgtcaaagttctcttggtgcctccgactacgtcggcaaccgcgtcagacaatttcaatctctttcctgttgttgatttccatgttattgctcatgatggagcgccaaaacaaacgagacaacaacacagtgaggatcgaaccctgaatcttcacttctcgatggtatcactcactgcgattctcttgtcaatgggagcgacggcggagctccgcttcggtagcgcggtgagcgacggtcggagaacggagcggcagttggagaagggatga

SEQ ID NO: 39103 - DNA, 915 bp, Glycine max
  Peptide Sequence Number=SeqID_130788
atggaccgaggtgttatacgaccattcggccaaggtgaggtatgtgaaccaggtcgtgctcatttgcagggaggtgccactcaggcaaaacagctcgcgctagaaggagctgacaaatatggggtcgcgatcggagatgatgttgcgcgaaaacccgtgatgtttgcacataatgtcgaggaacaaggctgcgactttataagcagtgaaacgggctgtgataaaatccatcgaaatatcctcccagacaccggaaggaggaggaatggggtggagcaggccgacaggctttcgattgactggcttcatttgttggcaaacctggcactggcgcacgaagtccttaacgtttgtggccatatttggccagtagaagctggcttgaaggcgatggagggtcttcctcattcccaagtggctgtcaataggggtagagtggaactctgtaaggagggccaggttgaaggttcctcgcgcacaagcactgcccctcaggtgtcggaatgcgtgaaagggagtcagcgacaacgttcgagggcccagatttgtattggatatcatagtcgaaatccagcagcttggccagatgatactgttgctcggggtcaggatggtgaagcggtggcccaagaggtattggcgccacttatgcacgacgatagtgatggcgtacagctcgcggacgtaggcggaggctcgatggacgcgtgggcagaatgtcttgctaaagaacgcgattgggtgtccttgctggaggaggacaactcccatggcggtgcacgacgcgtcggtcttaacagtgaagggcaggtcgaatcgcagaagggtcaggattggagccgtcgtcatggctgttttgagcaggtcgaaggtggtctgcgactccggcgtccagcggaaggcatctttacgtag

SEQ ID NO: 39104 - DNA, 309 bp, Glycine max
  Peptide Sequence Number=SeqID_130789
atgggagaggagaatgttaaacaaccgttgttggagaggaagtactacaaggactgcccaggttgtaaagtggatcaagccaaagagttgagtgagggaaagggtgtacctgttaaaaatctttttatcatgtggatggtggtgctgtgtgctggcacatgtggagggggtgttgcttatagaggttgccaaatcaaagaccttaaaagttcaaccatgttggcaagaaaattgagttggtgcctaacttcagaactgaaactgaattgcaacactagtctttttcaagttgttcacttcttaacttag

SEQ ID NO: 39105 - DNA, 255 bp, Glycine max
  Peptide Sequence Number=SeqID_130790
atgaaagatgattatattcatttatttgtgagaaggcctgtgaggagatctccaatcattaatcgtggttactttgctcgttgggctgcatttcggaaacttctctatcagtttcttgatgttgagaaaaagacagatggagatgccccaattaagaagcagatattatcacttggagcaggctttgacacaacatattttcagttgcaggtgcctggttttccttgtgagttgtactgtgcaagttgtacttaa

SEQ ID NO: 39106 - DNA, 228 bp, Glycine max
  Peptide Sequence Number=SeqID_130791
atgaagggaagaagtgatggagatgaacacttgatgctagcaagaatggtgaatagcaactatttctccttcttcctccacggcctcctcctcctttctctcaactcctctttcttttctttatcatttttggttttgaatggtggagagaatgagtgtagagaaaggtttagtgtgggtttgtgttgtgtggccgttgggtgcaagctttgggtgactcctaattag

SEQ ID NO: 39107 - DNA, 603 bp, Glycine max
  Peptide Sequence Number=SeqID_130792
atgtctggccaaaccagaatgggtactggtagtggctgtaatagcccggcaggagatagggtttggtacttgtttctttggcagaacaatctttttcatgttcaagttgtgaatggccatgttgaacgaccacaggatgaagacatacaatccaatgtactggaaataattggatcaaatattcagtccacatacattacgtgcccagctgacccagctgcaacacttggtataaaacttccattcttggttttgattgtcaagaatctaatgaagtatttcacatttgagattcaagttttggatgataagaatgtcaggcgacgatttcgagcctcaaattttcaagctgtcactcgggtaaagccctacatgtgcactatgccactgagaatggatgaggggtggaatcaaatccacagtttaacctggctgatttcaccaagagagcatatggtacatgcaaactgtcgcctgagaaggatttacttctctgaccgcctctactctgaagaggaactccctccagagttcaaattgtaccttccaatgcagattaatattgctcgttcaagtaacattaagttgtgtagggtgttctga

SEQ ID NO: 39108 - DNA, 1653 bp, Glycine max
  Peptide Sequence Number=SeqID_130793
atgaggttaccagaagaggtgttggtgagagtgtgtgccaatggaagagggctcacaagctgggtagagccattagaagggagttgggttcaaaggatgaatagtgcatatttcccaacagttaataccatttaccaacagatgaatagaaaactgcaacagcttgagtcttctcctcaagaaccaaacacagtggaaagaatgagattcaatatgaaattattagaacagattttggcaatcttgagagtgaataaatggcagattactactgaattcaaggagaacctagacaaagcagaaaagtttatacaatctaaatttttctctaagaatgtttcttcacatcatcaaggacaacaacgttcagctgatgtgcaatccaggcaacagtctggtccatcacattctagtatttccccattgatgatacttgaaatgaaaccatcaccacaagcattggggtcacagaactatcatccgatgaaggatgtttctcagcaaaacaaaatgtgtttacaagagaagcaagcggcaaaacaatatggtggttcacagcagtctggtccatcacattctagtatttccccagtgaaaacacttgaaatgagaccatcaccacaagcattgggaacacagaactatcatatgatgaaggatgtttctcagcagaacaagatgtgtctacaagagaagcaagtgacaataaaatatcgcaacttacaacaggatgtaaatcaactctctatcataaaaggtgctggcaatactgtacaacagcaaacacaagggacacaaaaagcaactgaagcatttagtgtcagtgtcaacagtcagggtatttcagcttcacccttgattgaaaactgcaataatcttaaagaaatttcccgtaaacctacactcacttctgatgagccaagtgctgcaatgcaatactttcttaaagtgttaacctccatatcacctgaagcattgagtgcatcgcttggtgaaattagagaggtagtctatttgaatgatgcaataccaagtccagaattgatgcatggaccaccagagatggttcaacaacaaatgcaaccatgcctcatctcacaaacagggataaatttagcatcggatattgagccatgctcacaagctagatacatcacttgcaatgattttgttccaacaggaaggaaaaggtcttgcagcatgaattcaatgactgcctttgacacttctagtacttgtgctagttcatgtgacagtaaccagttgactgatactgagaaacctgacttgactttagtcacatcaaagcatcctagaattgtggaaaaatgttctcttttagaagaaataaaggagataaataatctattgatagacagtgagatagttattggagaaaaagacagcattcaaagtgcagctggaggagctgctgaagatggtgaagagcatgcaaaaaccatgcaaaccgccagccctattggcgggtttgctgtgactgtgacacgtggcgaagatgccactggcgggggactagccagtcaaactggcgagttgcaggctagggcgcaggctcagccttttaggctttttcagttggcagcctttttaggtggtaggggcgagtacaggctaaaggggagtaaccactag

SEQ ID NO: 39109 - DNA, 1101 bp, Glycine max
  Peptide Sequence Number=SeqID_130794
atgatgcactttcaacgacggttgctagacaaccgtcttagtaaggcacacggtggcattaacataaataaatgccaactcaataaagatggtgttcaaaaacccatctttaatgcaacatacaacaatggtggatttgaacattgtcttagtacaatgttgattgcaacttatttaggacggtgtttcaaaattggaaaagagcccctcacaccactttcagctgaagttacgattgtagggtattggtccttgctgctgcacctcaatcttgaaggaaagtatctgcttttgcatctcaatttctttcgcatgttgattacaactacttttaaacttgtgtttgctaacattgacaaccaacaaacgcaggatgttgtcacaaaatatggtcttgatctcgaaacttggaaagaacttgcagcaacccgccagacacctaactgggaggattccttagaagatcaaactacgcatggtagctatgtaccccatggtcgtgatgacatactcaacactgccaatgggcgacctgaccatgggggtcgtgttggtgcagcaggggcaggtgtgacaattaatcagtactatggaagggcatcacgtgcatccaataactcctccacatccatcaaccaacaacaattagatgaagttattgctgacatacaacaattaggtgctcatgtcagcccaaagggaagtaatgctgaaactggtgtgcactctttaggggaagatgttgctaatgtcataccaattggtgcattgggaaaagtattgcatgggggttccaccatacacagtgtggcttatgcagatgatgtggtaaaggtcgatgctgaaaaagtaatccatgctggcgttgaagtcgtaccccacgatgcacaaattactccaaacaaagtgatggtacatgtgccaacgcaggttgatgtggacacaaatgatccgatgcgtgggctaataaagttgagttttgatatttacaagcctatagaatttatgtttgatgagagtaaatttggaattgtagatggagctatgttcgctggctcaatcgcgatactaatcaggaagtgtactgagtcactcaagtaa

SEQ ID NO: 39110 - DNA, 609 bp, Glycine max
  Peptide Sequence Number=SeqID_130795
atgtctggccaaacccgaatgggtactggtagtggctgtgatagcctggcaggagatagggcttggtacttgtttctttggcagaacaatctttttcatgttcaagttgtgaatgcccatgttaaacgaccacaggatgaagacatacaatccaatgtactggaaataattggatcaaatattcagtccacatacattacatgcccagctgacccagctgcaacacttggtataaaacttccattcttggttttgattgtcaagaatctaaagaagtatttcacatttgagattcaagttttggatgataagaatgtcagacgacgatttcaagcctcaaattttcaagtgtgctgtcactcgggtaaagccctacattgcactatgccactgagaatgatgaggggtggaatcaaatccagtttaacctggctgatttcaccaagagagcatatggtccatgcaaactgtcgcctgagaaggatttacttctctgaccgcctctactctgaagaggaactccctccagagttcaaattgtaccttccaatgcagattaatattgctcgttccagtaacattaagttgtgttctgatgcttgtctctaa

SEQ ID NO: 39111 - DNA, 603 bp, Glycine max
  Peptide Sequence Number=SeqID_130796
atgacacgtggcatgcaaaccgccaatcccattggtgcgttcgctgcggctgtgacacgtgacatggagttgggagctgcggcctttgacttgggcttcgaggatatcgctgtccctgctggcaatttaagcttggtggattataaaatccccttcaatagagtgaaagtgagttttgagcttttgacggagaaaaccttgtggcgagaacgagagcttcatctctttttccttcgtgttcttccattttctcaaaaccttagtctccgtgttgatggagtaccattaattggtttaacaaatcttgattgtgctgatttatgtgaagaattgttaggagttagatcacaggaaggtgaacttcaaggcagtgtggtggtgcgacgtggaaattatcatattggcaataatgatcgcatagtttttcgtcgcaaattggatatcatgaaacgacatgagtctctgtgggagtcttacacaacaactgttacgttagcgttgcctccaatttgtttggttgaaagtgtagcatggtgtgcggtggtgccactcatttgtttccatgttgttgagtggcaccaacccgatagagttttgcgataa

SEQ ID NO: 39112 - DNA, 63 bp, Glycine max
  Peptide Sequence Number=SeqID_130797
atgaagagaaagaagaagaaaaatgaaagtgtgccggccgtatttattagccgtgtggcttag

SEQ ID NO: 39113 - DNA, 711 bp, Glycine max
  Peptide Sequence Number=SeqID_130798
atggtggtcggagagcagaccaatgggtggccaccaatcggtgctcctctgaacgtccacagagacgagcattggaccaactttgacagctccgtcaacgccgtctccttcggcttcgtcgccaccgccattctcatctccatgttccttgtcatggccatctttgagcgctacctccgccccacctcgccgccactctccccctccgccaccacccgccgacgcagcccctccgacgtcgaggcccagatcggcttttccggcaaactcgctcacgcttcccctaaaatgagtgtatatgccagtggtgtttcagttctaatgcctggagatgagattcctacatttattgcgcatcctgctccatgttatccggaacgaatttcttggccttctcatcagcataacaacacattaccttgttcctcttccaacaccctccctactactactatcaaccaagtggtcaatttgcgccttcatcatgatgcctttgttgacgtcgtcgaaggtgttcgcggaagcactgagttcggaggcgagccattggtggtggtggccgcggcagtggcggtggcggtgggtggagtttcgttttgttggcgtttggctttgccgctttggtgggtgtcacagagagacatggtcgccggagaagagtgtagagaagttgccggaggaggagaggatgaggatgtggttgggattaag

SEQ ID NO: 39114 - DNA, 2664 bp, Glycine max
  Peptide Sequence Number=SeqID_130799
atggcaaagacaggatacaaactacgtatccttttttatatatataagttttgtgcctcagaaaatgctttctgttgcaatgtggaggaatttgcagctcattcagggaatgtaaattgtttaaaacttggaaggaaggcgaaccgccttttcattacaggaggggatgatcacagtgtcaatctatggatgattgggaaaccaacctctttaatgtattcaaagatcgtgtgggcacttgggattgtactaactacatcgacacaatccagtgagatggtgtcagcatggttaacacaaccaacacacctaggaagcaaaagtttgtgtggtcacactagttcagtagaatcagtgacttttgactcagcagaagtgttgattctttctggagcatcgtcaggggtaataaagctttgggatttggaagaagcaaagatggttcgcactcttaccggacacagattgaattgcactgctgttgagtttcatccatttggtgagttttttgcatccggctccttggatactaatctaaatatttgggatatccgaaaaaaaggatgcattcaaacatacaagggtcatagccagggcatcagtactatcaaattcagtcctgatggccgttgggttgtttctggtggatttgataatgttgtgaaggtctgggatctaacaggtggaaagctcctgcatgacttcaagttccatgaaggacacattagatccctagattttcatcctcttgagtttcttatggctacaggttcagcagatagaacagtgaaattttgggatttagaaacctttgaactgattggatctaccagacatgagcttagtcgtcattgtagcatggtttcgggggtacgctcaattgcttttcatcctgatggacagatcctatttgctggatttgaggatagtttgaaggtttattcgtgggaacctgttatatgtcatgatgctgttgacatgggatggacaacacttggtgacctatgtattcatgacgggatgcttttgggttgctcgttctacagtaattctgtgggagtatgggtgtcagatatttcacttatagagccatataatggtggcttggaaactgagaaaaaggaaagcacaaagcagaaacttagtctccagggaagacaaatggagaaagtagaagctggtgtgggaccggcttttgggttgtgcagtatgtctgctgacaatgagtcaaaagagataaagaatatatatatagactcttctggagggaatcctgataccttaataagatccaggtcttataattctccaaaagtagatcttcctgaagaatccaaagaaatgctaaactggagtcctgcaacaagagctcatgcaaaacaaaatgaacaaacacttagaaagtcttacattatgccaaactttgtacctcgggatattgtcaatggtaagaactcagcaaccttttcaaagactaaacctggaatgttgcttaagccagttcatgttcagggagcatccactgacatacttgatgttgatgggttttcatcagatttggattccagaacattttgtgatactggaagcaaatctgatagtccaaaagatcctaacttccaaatgaagcttggatctcagaatgaagtcagagaatctattgaggataagcatcctatcaaaagtgtcacagagaagtttgaaaaaactttaacaccagacagattttctgaccaagataaatgtaatcaatcctctccatacagcaaggagatgagtccagttaaatatgtcaatggagttgctgttttacaaggaaggacccgttctttggttgagaggtttgaaagaagggaaagaactcccaccgatgagaatcaagctaatgcaacccccaccacaatattcgaaaataaggaaaaaattctcaaagaagatcaaactaatgcatcccccatcaccagcataacatctgagaagggtgaaagatttcctttcggcgatgatcaaaacaatatgcccaatgttcccaacacaaccagtgaaactgacaagtctgctaacttcctgaaagttgagcctcaagttcttggaagcgattcaaactctgcaaatgatggagagataattgaagggctgatgcaaactcatgatgtaacattaagtaatctccgttcacgtttgacaaaattacagggttatagaaagaaaggatccggctcccctaaagtagtgcagcatttttgggagcggaatgatactaaaggtgccatcagtgctttgagaaagttgcctgatcaatctgttcaagctgatgttatcagtgtccttgttgataagatggagattatcaccttagatttattttcttgtttacttcctgtgctcacaggtttgttggatagcaacatagaaagacatgtgaaggtgtcactggatatgctgctgaagcttgtggcagtttttggtccaacaatacgttcaaccatttcagcacctccctctgttgggattgatctacatgcagagcaaaggcgagaatgctccaatcagtgctttatgcaactgcaaaagatccgaatgattcttccaatattaataaggaggggtggtatattggccaagtctgcccaagagctgaatttagttcttcaacaaccctaa

SEQ ID NO: 39115 - DNA, 936 bp, Glycine max
  Peptide Sequence Number=SeqID_130800
atgagacaccgtggcgcgccagaggaaccaccgcaaccccaaccttcatttcctcaccggaaaaagaagcgcaagcgcagagccaccgccaccgccaccgtcggttccacttccgtttccttcgaaaccagccacaccgatgcccctgaccagctcaacactcacattcatgacgctgctgttgcgtgcgagcagagtaaagccaccgccgccggcgacggttttcgtttcggtgagctaaggcagagaagcgtgaacggtcgcgatagttttgtagatttggcagttacggcagttggtgacggttacgtgacggagacggtggaatcgttggagctaaagcgtgttttgggaaatgattcgattccaaagaggttgcctgtgtcatcctttttggagaaagtgctccatggaaattctgtctggagcactacaactgttggggatgaaaagggacgagaaagagtgtatgacactatcttccgcttgccatggagatgtgaactgcttatagatgttggtttctttgtctgcttcaattcatttctgtcattattaactataatgcccacaaggatagtgatgaccatttggaggcttctgaaaacaaggaagttcaagaggccatctacaattgagttgtcagattttggctgttttcttattatgatttgtggagtcattgttttgcagcaaatagatatcagcttaatatatcatatgatccgtggtcaagaaacaatcaaattgtatgtgatctacaacatgttagaggcaatcactttatcagcctgtattgtttctcactacaatgctctgccagctttgctggtgtcaaataatttttctgagatcaaaagctatgtgttcaagggatatagtaaggataatgttcacagtatggtgtactctggtgagttatctttcttacagtag

SEQ ID NO: 39116 - DNA, 393 bp, Glycine max
  Peptide Sequence Number=SeqID_130801
gaaaatgtctgcccgctttgtcgaaatgagcaggaggaggcaggccacctatttttcaactgcaatctgactattggcctgtggtgggaatccttgaggtggatccaggtcataggagtccttccagcctctccagcaagccattttatccaattttgtgatggatttggtgaaggtagaaatcattcaagatggtgtgggtggtggattgctttaacttttaccatttggaagcataggaatttactggttttccagggcattccttttgtctctaccaaagtgctggatgatgccttattcctagcttggtcttggttaaaagctagagacaaaggtttcaacaccctctttaatcattggtctaccaatctttcggaggcctttgcttaa

SEQ ID NO: 39117 - DNA, 318 bp, Glycine max
  Peptide Sequence Number=SeqID_130802
atgggaaaaattggaaggaatcttgaagagaaactgtcatgcaagcacgtgcccaacgcgtcatcagctcgcctagcgagtcgtttgtcttttctgacgcttagcgcgcctagctcgctaagccaaagttcacttactcgctctaagcgcgccttcgaagacagaaagtcctttttaaagcctgaagtgaaaaatgaaaaagggggattgagaagagaggttagctctgcatcagtacagttgtgtcttcctatgtttactttacggtgtttatcttctatgtgcgcgattttgaagtccaaaaaactgcatgtgtag

SEQ ID NO: 39118 - DNA, 597 bp, Glycine max
  Peptide Sequence Number=SeqID_130803
ggcaccattgttgatgattggaaatttgattattcaagtcatgatgcttgccgtatggtctgcaatgatcagactgaaatgaccgcacaagcctctgaggaggatttgattcttatgtgggcttttcttaccggtcgtcagatcgactgggctcatttggtttggtaccgaatgcataaggcattacgggccaatgcacctctcccttatccacatttgattactctgtttttgcgtcattttcaaattccacttgatgatgaaccatttgttcaagtcaagtgttcctttgcaattggtgctggtgtcgtgacttcctttgggtaccgtaaagatcggaatggtcaatggctgaagaaggatgcactccctcctcaagatgaacgtactccttcccctcttcctcagcgcgatgattcagcactcatgaatgaagtcctctccgaattacggggtcttcgttcttatgttggtgaccgtttcgactcattagatacacgctttgccggcatggacattcgcctcacacagcttgaagaggatgtaggttacattcgtcagagtttcgatcttccaccaccacctccgccttcttag

SEQ ID NO: 39119 - DNA, 585 bp, Glycine max
  Peptide Sequence Number=SeqID_130804
atggcctctggtaatcgattaccaagggtgtgtaatcgattaccaagggtgtgtaatcgattacaaggcttaaaaaatgaagacaggaagttgagatggcctctggtttccatgttcagaagctgtgtaactcgagtttgggcactgatcacgatggcagcacaattaatccatgatcgcgtggagatggagtgcctagagggagtttgggagaccctcgaaggcaatgagaggtgccgattccgtggcacgattcgactcactgctacttcattggtacatccagaggaacccgcacgcacgcttcagcaaactgtggagtggatactacctacacctactccatatcgactagtggagccagtccaagtgatagaggtttcgtcctctgaagaagatcctgaggaggaccgagaggagttacctcctgagcctgctgtggatgctcttgactttctagagggtgatgaagacccactccctgatgtggattctccagaggatgtcatgtcagcatctgaggcagactctacggaggagagcggccctggagggacagcgactagtggagactcttcatcatag

SEQ ID NO: 39120 - DNA, 201 bp, Glycine max
  Peptide Sequence Number=SeqID_130805
atgaagaaagagtgtcccaagtatgccgcatggcgtgtgaagaaagatacttggtggatagattctggtgctactactcacataagtatgactatgcagggttgcctgtggagccagtcgccaagtgatgatgaaaggttcatctttgtgggtgatggcaagaaggttgcagtggaagatattggaacttttagattgtag

SEQ ID NO: 39121 - DNA, 480 bp, Glycine max
  Peptide Sequence Number=SeqID_130806
atgtcactcgccgtgggtaggatgtattggagtcatagtagtgtgcttgtgcgtacatgtcactcattgtgggtggcatgtactggagacttagtgctaagaggagggctcaccaagggcggtccttggactggctgtgaccctgaatgggccttcccagttggggccaagctttcccactcaaggatcttttctggcttctccttggactcgtcatacgaggtcactaggttgaaaggctcatggttaaacctttgtattgtatttccttgctgctcaaagtttggcagcttcttccatgatcctcgctatttcttggactttgtctgtgatttcaagttctaccctcatattttcttcattttgctattgttggaacaacggtctccttgtcgatggctcctcgacttcaacggggatcatggcgtttgtaccatgtgtgagtcgataaggagtttcattagttgttgtctggggtga

SEQ ID NO: 39122 - DNA, 1046 bp, Glycine max
  Peptide Sequence Number=SeqID_130807
cgatcaatgcttttctcgcctttcatgactacaaggaaagcccggttgtcgctatcctagccgatctatatgacaccttcgaccgaagatgtgaaaagagcagtacaaggattgttttctgtactccggccctctacgtatggttggcttcgcaccttttccgccaagaggtgatacatgcttgcccactagaaagccaccgttcatgcacagagaaaagagaggcaagatttccaaatgttcccttgataggtacaaggggttgcatcagttacaatcccgttcttgccataagacagcttggctaccctatgagaggggcaccactaaaggaagaagagctcgcacctattattgcacgaggcagtaacaatgggcccatcggcggctaccataggtggttgaaagcccacatgcaaggtttggattggctcccgagtttgagaacctctaaagtggtggaagttgaagcaccggaggaagacgaagaggtgcaggcccttagggcagaactcgagaaagcccaaacagtcaaagaaaggttcaaatcagcagctcttaagatccgaaaggagaatgccgaactgagagacgtaaatatagctaacaccaaggccttggaacaagagaccaaaagggctcagcttaagctctggagagaggaaagggaccaatcacgagtagacagtttgatcttgaaggatgggttaaaggtttgcctaaggtccaagagaagcttgtctcaatgtttatgcgagacaaagaccaacatgttagccatcatcagcaagtaccaagaagaattaaatctagccacggcccacgagcacaaagtggcggacgagtatgcccgagtgtacgcggaaaaggaggctaggggaagggtgatcgacacgttacatcaagaggcaacaatgtggctggaccaatttgctcttactttgaacgggagtcaagaacttccccgattgctggccaaggccaaagcaatggtggacacctactccggccccgaaggagatccacggacttctcagctattgtaa

SEQ ID NO: 39123 - DNA, 412 bp, Glycine max
  Peptide Sequence Number=SeqID_130808
atggcatcctttagccagatgcagtcccagatgcagtcccagggacttgcacgacctgccgagcctctggttggtccctctggtcctcgagtaagcacaaaggggagttgtgttgatcccccaggaaacgatcttgagacgggtgactcagataggtgtggcttgtacgtcgaagcagatcttgcccgcctagttgccttggggagagtgagtgtggaggaggttacagatgcagatgctccagttcctatacccactaatgaggtagttgtgtcttcgacaaaaccacctccaaagcccgatccagaggtcgatgatccggttacatgggatgccaccgtgttcggggtctttaatccagatttcctggtctacataaagcacgaagacctctccgaaatcgcacacggtg

SEQ ID NO: 39124 - DNA, 294 bp, Glycine max
  Peptide Sequence Number=SeqID_130809
atgaggtcagacacaaatactagtgttagagaaaaggtctcatttctgttaatagcttgcgaaaggagtggtgagtataggcctaagaagaaggatttggttagaacatgcactggcaatacaaaatgtggatgcctgtttaagttgcgtgtgaagccagttttgggaggagaaggatggatggtgaagagcacaatgccaacaattatacaacaatcaaacaaatttacaatgctagaaatgcttatcgttcttccacaagagggagtaactccaaaatgcaacagctcatga

SEQ ID NO: 39125 - DNA, 387 bp, Glycine max
  Peptide Sequence Number=SeqID_130810
atggcattcttgggagaaacaagcagtcagacaattgtgaactccacattagcttttatttttccaaatgactccattgttcacaatgacaatggtgtttattttcaaacctccactccagtaccttttcggctacctaacgtttgtgattttcaaacgttaaaaaccagaatacacaatacccttcagctaaccgacgaacaatatttggatgaaatttactaccagcagtcattcacagatacagcattggtagaacaccagatggaaaaaatcccaaaaaagtttgacattccttccaaatgtaccatggatgaactgaaggatttggtcaagcaagttgtgcctcaagggattcccccttgtggtattcatgaaatacaaatg

SEQ ID NO: 39126 - DNA, 177 bp, Glycine max
  Peptide Sequence Number=SeqID_130811
atgaagggcatcgtgcatgaacctcaggtgaacataggggcagatcaaaagtcttttgaatttgggatgactggccctctcgatgagtcgatctcttgctttctcataagggtggacctttgggtactagtacctatcgcctttagaggactacacgtcctcgccttcaaagggtga

SEQ ID NO: 39127 - DNA, 186 bp, Glycine max
  Peptide Sequence Number=SeqID_130812
atgcccttttgcgggcgagcgaaggcgaagctcacgggtgcgctttccaaaggaggaaagatgtgcgaagtcgccaccaacgtttatttgtggaaaacgtcggaaaaaccgaaggaaaccggtcgacaaaagcggggcttttgctcctacgtaccctcctttggagaggaaatcagacctacgtag

SEQ ID NO: 39128 - DNA, 465 bp, Glycine max
  Peptide Sequence Number=SeqID_130813
atgtttatctctcgccatctaggtaaactacaaaaacaggacaagaatgacaaggaccgtcgtttatcgcgtcgtgttcagcttgaaggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 39129 - DNA, 658 bp, Glycine max
  Peptide Sequence Number=SeqID_130814
tgcagcagtgctggatcttggccgcaacccgtacgacaaactggggcatttcttccagggattggtgccggcgctggtggcgcgcgagatcctgctgcgcggcggctatgtgcaagggcgcaagatgctgggcttcgtggtgtgctgcatcgcgctggccatcagcgccgtttacgagctgatcgagtggtgggcggcgctggcgctgggccagggcgccgacgagtttctcggcacccagggcgacccgtgggacacccagtccgatatgttctgcgccttgctcggtgcgctatgcggtttgctactggggctgcatttaatcgcgtttaccgccggttcagcgtatttgtgctatatcactggttcggagcggctgtttgaatgcgagactgagtttgatcattacccccttatcccgaaaagcaagttaacgatttccgtcatcaataacacctcgttcgccgatgtcgtcgcctcttacctgagactgattctgtatctacctttcgggctgttggcgatcgtgttgacgctgttgttttgcgcccggcggctatgcgatacccggctctttgtgcttgcttggccgatttctctggcggtcttcttggtcttttggtttgttaatgtcgctttccccggacatctcaatctg

SEQ ID NO: 39130 - DNA, 237 bp, Glycine max
  Peptide Sequence Number=SeqID_130815
gtacaggatgcatcttcagaggccaccattcctgagccatttatttttaaggcaggaggtacacagctagcagaccctcctacaccaatgcatgagatgccagcagacccttctactccattactagagattccagaggaccctgccacaccagtcctgggactgactaccactcctccagccagtcctgtgctacattttacagatgcggagggcactcaggatcaggatacctag

SEQ ID NO: 39131 - DNA, 783 bp, Glycine max
  Peptide Sequence Number=SeqID_130816
aggcatccgaatggcgtcatcggaggttatcatggatggctaagaattcacacgcggggcttagattggctctccaaattgaaagttatcgatgaggagaactttgaagctccggaggaagatgaagaagtccgagctctaaaattagagctagggaaggcgagactcaccaaggagaagttcaaatcagctgctacacacatccggaaggagtgcatcgagttaaaagaggaaaatgcggccactgcaagagcccttgaacaagaaaccaaaagggcccgcaaggaggaatatggccgagagaaattccgaggagcattgtgggatagcaacaatgagctcaagctgcgaagagaagagagagatcggtcacgggtgcatggcatgatcttaaaagaagagttagttgcttgcgcgaggtccaaaaggagtttggctcaacacttggaagccatggagcaaagcatgctagccatcatagggcaatacaaggaagaattgaaccagtccatggcccatgaacaaaagttagtggaggattttgcacaagtgtatgccgaaaaagaagcaagagggagggtgattgatgcgttgcatcaagaggcgactatatggatggataggttcgccttgaccttgaatggaagtcaagacctcccgcgtctgttagccaaagcaaaagccatggccgaagtgtgtactgcccccgaggagattcatgggctaatcaattactgtcagcacatgatagatttgatggcccatataattaggaatcgttag

SEQ ID NO: 39132 - DNA, 252 bp, Glycine max
  Peptide Sequence Number=SeqID_130817
atggaagcacagaagaaagaagcggtagcaaccattgactactcgggcccggccttgctgccagaaaagggacatgcttacttcatctttactgaatgcatcaacctcttggggagatatttattggaaagaattcagcatctacttcactgtatgctatctgggtcagttgggattgggattcttagtgcttttctatttgattttccttctcatctccctttcgctctttctggtgattggattggctaa

SEQ ID NO: 39133 - DNA, 756 bp, Glycine max
  Peptide Sequence Number=SeqID_130818
atgggtgatcaagaggagacacaggaacagatgaaagccgacatgttggctctgaaagaacagatggcctccatgatggaggccatgttaggaatgaggcagctcatggagaaaaacgcggccaccgctgccgctatcaattcggctgccgaagcagacccaactctcttggcaactgcgcaccatcctccctcaaacatagtaggacggggaagggacacactggggcacgatggcaaccctcacctgggatacaaccgagcggcttacccttatggattgccgcccaactactcaccacccgtcttgcaagacgatgcgggccatattgcttctcccgtccttgaaagagagcctcctcaacagcccgacgaggtccacaaagaccctcaagactatgctcgaagggatgtcgagttctatcccccgatccccgaagggccggcacccagcacgttgcctcaacccaacatcacgacacaaccaatagttttgtccacggaaggaccgcccccggcaactgaagaaaagaggaagctcgatctcctcgaggaaagattgagagccgtggaaggatttggggactatccgtttcgcagacatgacggatctttgcttggtaccccgatgttgttattcccccgaagttcaaagtgccggacttcgacaagtataaagggacgacttgtcccaaaaaccatctcaagatgtactgtcgcaagatgggcgcacactctaaggatgagaaactattaa

SEQ ID NO: 39134 - DNA, 221 bp, Glycine max
  Peptide Sequence Number=SeqID_130819
atgtaccctctacttgtaccacaaaggatgtaccctcctgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaactttttagtgaaaggttcgggagttgtatttacgcacggggaag

SEQ ID NO: 39135 - DNA, 336 bp, Glycine max
  Peptide Sequence Number=SeqID_130820
atgagatccatagtggttcacaacatccctttgttgcatggccaagtgaaggttggtgttgacgaggttaaagatgcggaggctcccgttcctgtacccactgacgaggcagctgtgtctccagcaaaacctccagataggccggatcatgaggtctatgatcccctatatctgatgacattgaccatcccacaacttttctcgaagcctctccaggttatgtgggatgctaccgtgttcggggtgtttaatcaagacttcccattgtacatcaagcacgaagatctctccgaaattgcacacggtggtcaatgtcttagcatatctgttatatag

SEQ ID NO: 39136 - DNA, 509 bp, Glycine max
  Peptide Sequence Number=SeqID_130821
ctgggcagaaggaaaagaggctcctagcgtgaaggttgcttgtctcgcccaggaggtgggaacagttgaaaacaaagtggcgaacgggctgaccaagccaatgatgcttagctggtcttttcggatgatcagccacactgggactgagacacggccccggactcccacggggggcagcagtggggaatcttggacaatgggcgaaagcccgatccagcaatatcgcgtgagtgaagaagggcaatgccgcttgtctggctctttcgtcgagtgcgcgatcatgacaggactcgaggaagaagccccggctaactccgtgccagcagccgcggtaagacggggggggcaagtgttcttcggaatgactgggcgtaaagggcacgtaggcggtgaatcgggggtgaaatccgcagatctacgaaggaacgccaaaagcgaaggcagctctctgggtccctaccgacgctggagtgcgaaagcatggggagcgaacgggattagataccctg

SEQ ID NO: 39137 - DNA, 1014 bp, Glycine max
  Peptide Sequence Number=SeqID_130822
atggtatggggggacattttggctaaatttgatatcccagaagctgaaaaggccaagaaaaaagtaatgtccacggtgggcactagatggaggcaatttaagtcttcgctaaccactaaatttgtctatgctgacacacaagccggacaggaagaaaatccttcagcaaaatatggtatggataaacaaacttgggacgaatttgttgcaagtcgcaagaccccggattggcaggaaattcggaaaaaggcaaaggagagtcaaaaatacaatgactgcccccacgtactgtctcgtgggggttatgacttgcttgagaaaaaaatgttagatgagaaaacaaagcaaagacaacagcaggcacttttgactgagaatccattgtctgatctggaggagccgccatctcccattaaaaggcacgtgaagtggaaaatggctagaaccaaacgatatggccagatgacatcaaaggcagcaaaagaaatttcggatagaattgactcgttagaagagcagacgacacagggtagttttgttccccatggtcgggatgacatcttgaatacggcccattggcaaaccggaacatccagggcaacacgtacgtcgagtagttcctcagcaacactaatgcaacaacagtgggctgacattattggaaacataaaggaacaagtaaggaatgaatatgaagaacaacacaagaggagtctggaggaatttaagaaggagttgtccagtcagatcttcattcaattgagtcagatgggatcacaatactctccccttattgaggtggatttacaggcattggctgcacgtcttagcactaaaggaagtaatgtagaaactgctgatgttgacccatcaggcgacaaaaatgtgagcttaaaacccactatggggttatacgtgcaacgacaaaatactacagtgttggtggccttggggaaaatatgtgagggtggatcagccattcacaatgtcacttatgctgatgatgttgtgagg

SEQ ID NO: 39138 - DNA, 423 bp, Glycine max
  Peptide Sequence Number=SeqID_130823
atgattatgagaggtcaagacatttatagtagtcaagagaaaactacttcttccccttcctctagtggaatcgaagatgaaataaggggtgaagagtctacccccatgaagaaggtggccaaagatcaactaactatgaaagataagagagatgaggaagaaaaacttgaaaaacaaaagaaaaagaaggatagtaaggccttgtctacaaaggtcaaggggaaggaaaaagaggaaaaggatttctctaagaagattgttaaaaaggaaaatcattttgcaacaaaatgtgatatcaaaagagcactccttcttaaacaatctttctaccttctcctatcaagggaaacatcccttagcatcgccatacctcttgagcttgaggttattcctcaagtaaaggagttgttggatgagggtttg

SEQ ID NO: 39139 - DNA, 167 bp, Glycine max
  Peptide Sequence Number=SeqID_130824
cagcactcattgagttggtgagaaaccatgttccctcatgggaagatgtccatgaaaggggtgtcgagggaaggagcccagagtttgaagaacctctggatttgaggtcaaatccttttcaagatggaggggatgatgcaatcctatcccccaagggtattggatag

SEQ ID NO: 39140 - DNA, 528 bp, Glycine max
  Peptide Sequence Number=SeqID_130825
atgggtgctaagcacctcacgaggaccaaagaatggtcgcacgtcatcgagcaaaggtccccggacgaaattaggggcgacgcggggctcacgggtgcgtcttccatgggaggaaaatgcgcggagtcgccaccaacgtttattcgaggaaaacgtctgaaaaaccggaaaaggtgtggtctacgaactttaagtgtgaaagctgaaggcactatgatgttcaagagtccggaggaagctattgtgatcattgactccatagcagccaatggccttaagaaagcagattggccaacttcctcagcaatatcaccaaggcgcatcaagcttaccaaaatggtcactgttcaacaccttgtgatggacaacaagaagaggaggcctattatcaatggaaccaagctagaccttaacaaaactttcaaggaagctaccaaggctatagaggtggctcaggatccacgacaacaacaagcccagccagatagaatgtcatatatggaagatactttaacacattttatgtag

SEQ ID NO: 39141 - DNA, 459 bp, Glycine max
  Peptide Sequence Number=SeqID_130826
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatcgccgctgacgcgcaggtgtacgattttcgtgacaacgaggttcctggcaacactgagaaggatgccgactactggcgggacgtgggcaccattgatgcttacatcaagcttatcgataccgtcgacctcgagggggggcccggtaccagcttttgttccctttag

SEQ ID NO: 39142 - DNA, 501 bp, Glycine max
  Peptide Sequence Number=SeqID_130827
atgaccatgattacgccaagctcgaaattaaccctcactaaagggaacaaaagctggtctaaagggctcaaactaaaggacctacgaattcagtccattgggccatccttctcgtacccattcaaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 39143 - DNA, 414 bp, Glycine max
  Peptide Sequence Number=SeqID_130828
atgccatctactatttgtagggatcgcgcccacaagacacccagtggacccggagaagtccaacagggcctcggggtttccagctctggttatgggcctttgtcagtctacagggtgcccgtccccccagcaaggtcacgccatcatggcatagggatcgcgcctgcaagacacccagtggacccgaagaagtccaacagggtcctggggtttgcatctctaattacgggcctctgtcagttctacggagtgtccatcgcccccagcaaggtcatcaggccccctattaaccggactttcatcgagaagtattgcgcccctaagcaggcgcatggcaaggcatcacagcagtgggcaacaggcgcaccgccaccacctctagagttcacctcagctcatccacaaaaaggttag

SEQ ID NO: 39144 - DNA, 163 bp, Glycine max
  Peptide Sequence Number=SeqID_130829
tcgggaaacctgtcgtgccaactgcattattgaatctgccaacgcgcggggagaggcggtttgcgtattgggcgctatcggagtgtatacagtcttactatgttgacactgaaaagggcgtcagtgaagagcttcatgtggcacgagaaatcaggctgcaccg

SEQ ID NO: 39145 - DNA, 1197 bp, Glycine max
  Peptide Sequence Number=SeqID_130830
gaattaaaccgccaaaagcaagtcgaaaatggggtggttggaataccgagaaaatgtttggaggcaaaagcaagaatcttggcaggtaaaggcgaatgggcactgttcatagacattctcgcactattgatctttggaggagtcctctttccaaatgtggacgggttggtggacctagcagcgattgacgcttttcttgcctatcatgaccataaggaaagcccggtcgtttctatgctagccgacctctatgacacctttgaccgaagatgtgagaagagcagtacgacgattttctgctatactcccactctttatgtatggttggtttcacaccttttttgccaagaggtaaggcatgcttgcccattagaaagccatcgttcatgcacagagaaaggaagggcgaattgggaccaactcttagcaaacagagaaggagcatctgtcaattggttccctcgatggaaagaaggaataaccggagttgttatctcgtgcggaggatttccgaatgttccccttgatggggggacaaggggttgcatcaattacaatcccattcttgcgataaggcaacttggctacccgatgagaggggcaccactagaggaagagctcgcacctgtcatttcacgaggtttcaataagaccaacatggagacacttcaaaaggtccgcaaggcatgggaggtggtacaaaagaaggacaaagagctcagaggcagtaacaatgggcccattagtggctaccgtgagtggttgaaagcccacgtgcaaggtttggattggctcccaagtctgagaaccactaaaagggaggaagttgaggcaccagaggaagacgaagaggtgcaggctcttaggacagaactcgagcaagctcaaacagttaaagaaaggttcaaatcagcagctttgaaaatccgaaaagagaataccgaactgagagatgtatatgtggctaccaccaaagccttggaacgagaaaccaagagggctcgtagggaagaacacggccggaacaagttccgaggggctctgtggggcagtaacagcgagcttaagctccggagagaggaaagggaccaatcgcgagtagacagtttgatcttgaaggatgagttgaaaggcttgctcgaggtccaaagaaaagtttgtctcagcggttatgcgagacagagaccaacatgttag

SEQ ID NO: 39146 - DNA, 777 bp, Glycine max
  Peptide Sequence Number=SeqID_130831
gtgttgcaaaggaaggacaaggaactcaggggcagtaacaatgggcccatcggtggctaccgtaagtggttaaaagtccacatgcaaggtttggtttggcttccgagtttgagaaccgataaaagagaggaagttgaggcacctgaggaagacggagaggtgcagggccttagggcggaattcgagcaaacccaaacagtcaaagaaaggttcaaatcagcagctctacaaatccgaaaagagaatgccgaactgagagatataaatatagcaaccaccaaagccttggaacaagagaccaagagggctcgtagggaagagcacggccggaacaagttccgaggggctctgtggggcagcaacaacgagcttaagctccggagagaggaaagggaccaatcacgagtagacagtttgatcttgaaagatgagttgaaggtttgctcgaggtccaaaagaaacctgtctcaacggttatgcgagacagagaccaacatgttagacatcatcaacaagtaccaagaaaaactaaatctagccatggcccacgagcatagagtggcagacgagtatgcccaagtgtacacggtaaaggaggctagaggaagggtgatcgactcgttacatcaagaggcaacaatgtggatggaccgatttgctcttaccttgaacgggagtcaagaacttccccgattgctagccaaggccaaagcaatggcggacactactccgcccccgagaagatccacgaacttctcagctattgtcggcatatga

SEQ ID NO: 39147 - DNA, 681 bp, Glycine max
  Peptide Sequence Number=SeqID_130832
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagatgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 39148 - DNA, 207 bp, Glycine max
  Peptide Sequence Number=SeqID_130833
gagatagctccgaagaagctctccacgaagaggtctagaaaggacgccactggagaagactccagtgccgccttggagtttgatagtcactggttccgaagtgccgagcaccagcagcactttgaggccatcaagggatggtcgttccacagggagaggcgtgtccagctcaggaggatgagtaccctgactactagggtgagatag

SEQ ID NO: 39149 - DNA, 468 bp, Glycine max
  Peptide Sequence Number=SeqID_130834
atggagggcaagtctggtgccagcagccgcgttaaaaagctcgtagttggaccttgggttgggtcgatcggtccgcctccggtgtgcaccggtcggctcgtcccttctgccggcgatgcgctcctgtccttaactggccgggtcgtgcctccgcatgggataacaccacaggattctgatcctattgtgttggccttcgggatcggagtaatgattaacagggacagtcgggggcattcgtatttcatagtcagagaacgaaagttgggggctcgaagacgatcagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 39150 - DNA, 887 bp, Glycine max
  Peptide Sequence Number=SeqID_130835
gtagaggcgaatgggccccgttcatagacattctcgcactgttgatcttcggaggagtcctctttccaaatgtggatgggttggtggatctagcagcgatcgacgcttttctcgcctatcatgaccacaaggaaagcccggttgtctctatgctagtcgacctatatgacaccttcgaccgaagatgtgaaaagagcagtacgaggattgtttgctgtactccagctctttatgtatggttggtttcacacctttttcgccaagaggtgaggcatgcttgcccgctagaaagccaacgttcatgcacagagaaaggaggggcaaattgggaccgactcttagcaaacaaagaaggagcgtctgtcaaatgcttccctcgattgaaagaaggaagaaccggggttcttatttcgtgcggaggattcccaaatgttcccttgatggggacaaggggttgcatcagttacaatcccgttcttgctatatggaaacttggctaccctatgagaggggcaccactagaggaagagctcgtgcctgtcatttcattaggtttcaataataccaacgtggagacacttcagaaggtccgcaaggcatgggaggtggtgcaaaagaaagacaaagaactcaggggcagtgggcccatcggtggctaccgtaagtggttgaaagcccacgtgcaaggtttggattggctcccgagtttgagaaccgctaaaagggaggaagttgaggcaccggagaaagacaaagaggtgcaagcccttagggcagaactcgagcaagcccaaacagtcaaagaaaggttcaaatcagcagctctgaaaatccgaaaggagaatgccgaactgagagatataaatatagcaaccaccaaagcctag

SEQ ID NO: 39151 - DNA, 438 bp, Glycine max
  Peptide Sequence Number=SeqID_130836
atggcttttcactattccttattcctttccagagaaggtagctcatccagcccagcggatccattgtttatgcggcacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 39152 - DNA, 312 bp, Glycine max
  Peptide Sequence Number=SeqID_130837
acatacaactgtcaacaacttcctgtttcagcctctacaccttcactttcccaaataccttcctacaattccctttcagctccctctgttcctcctgatttctctgcaacttccttaaatcaaacctcacctgaatccacttcctgtcatcctcaatcatctaatatagtgtcgtctagtgaatctatacccactgcaccctctcccactcatcctcaatcatcaaatactatgtctcatagtgaatctgtgtctgcatcaactcccattcccatcaacactctcccaatggaaactaggtctaaatcttga

SEQ ID NO: 39153 - DNA, 369 bp, Glycine max
  Peptide Sequence Number=SeqID_130838
atgacgttgccacttagcaacattctgtccaacgaccacaatgccgatctccccctacagaagtatcagttggggtcgcgcccacaagacacccagtggacccggagaagtccaacagggccatggggtttccaactcgggttacgggcctctgtcagtcctacagggtgcccatcccccccagcaagggatcacgcccgcaagacacccagtggacccagagaagtccaacagggtcttaggttctacgaagtgcccgtcgcccccaacaaggtcattaggccccctattaaccgggctttcatcaagaagtactgcgcccccaggcaggcgcacgacgagacaccacagcagcctggggatggctga

SEQ ID NO: 39154 - DNA, 375 bp, Glycine max
  Peptide Sequence Number=SeqID_130839
atgggggagacacatgaaattccccaccacaatctagctgacttcgagccttggctcggatatgccactgaagggcaagcagttggtggtataccctttgaaaacactttggagggccctcagtttcgcccacaaccacaaccattgcattttgcggtgggaagagcccctcctgctatggccgaaaagggaaaggcggatcatctaaaggaaaggctcagggccattgaaggagaacatgtgcaaaaagggggacagatcttcaaagaacacgcccaaaaggtggagggatctggcggcccaggtggtacccccaatgatggaaagggagacgataatcgtgatggtagacacattatcgatactctactataa

SEQ ID NO: 39155 - DNA, 216 bp, Glycine max
  Peptide Sequence Number=SeqID_130840
atgaaggttgaacaaatttttgtttgccatcatattagcaaagagagaaaagttccattggctacccttagctttcaaggggaatggaggattcatggggatcctctagtagagtattggaatgatcttaagagtgcccttaggaagaggcacattccctcctactatgaaggaagtttatggacaagctccaaaggcttagacaagggagtatga

SEQ ID NO: 39156 - DNA, 1098 bp, Glycine max
  Peptide Sequence Number=SeqID_130841
atgtcgttcaccaaaggaaagatgtgtgtaactgaaatagctccgaagaaactctccacgaagaggtctagaagggacgccactggagaaggctccagtgtcgcctcaaaatttgatagtcaccatttccagagtgccgagcaccaacaatgcttcgaggccatcaagggatggtcattccacagggagaggcgtgtccagcttagggaagacgagtaccctgacttccagagagagatagcttgcaggcattgggcacggctagtgacccctatggctaaatttgaccaggagatagtcatagaattttatgccaatgcctggcccactgaggagggggttcgggacatgcgctcatgggtgaggggtcactgggtcccctttgatgcatatgccatcagtaagttcttgggcgaccccctgattttggaggaagaccaacagtgtgaattcagccaaaggaggagccaggtagacggtttcgatgaggaagccattgcccaactgctgtgcatatcggtgcaggatttcacccagaccgctgcagggaagtgggtgtggatcatgcgcaccagcatgactaccttgacccagatatggatgacactattgctcagcaatgtcttgcctagcgaccacaactccgacctccctctgcctaagtgccagttggtgaatggtgcctacctggggttttcggctctgatcacgggcctcttccagtcctacggagttcctgtcacccccagcaaggtaatccaaccaccgatcacccgacccttcatcgagaagtactgcacgcctaggcaggcgcagggcgatgcacatcaggacgcgggcgcaccgccaccacctcggcaggccgattcggctgggccactaggcgtggagcggtatctacaacatttggttcgccaacaagcggccaaccaacgtggacaggtgcagatacatgagtgtctctaccggttcagcctcagccccgatgcccaggcaggggaggagcctgcagggtcccccggtgaggtggatgaatcccgtatggatgaggatatgactgacctgcttggtttcttgggagggagtggagccacatga

SEQ ID NO: 39157 - DNA, 243 bp, Glycine max
  Peptide Sequence Number=SeqID_130842
atgatcatcatcaaaacatcaaagccaattgcatctacagaggccacttcagagcctcctgcactagtggtggacctaccctcacctcagcatacagcagacccctccactcctatgttagagataccaaccacaccggtcctggctatggacacatctcctccagctactccagtacttcatctgaaagatgaggaggatgttcagacaaagaacacccaggaccagtcacaggaattctaa

SEQ ID NO: 39158 - DNA, 484 bp, Glycine max
  Peptide Sequence Number=SeqID_130843
atggtggcccgggtgatattggggaatggctataagcccggaatgggcttaggcaagaacaactgtggcagaatcaacctggtaaacaccagaggaaaccgtgggaagtttggattaggctataaacccacacaagcagacataaggataagtgtcgcgggaaggaagagcagaagccaaggttcgcaattgggacgacaagtcgaaggggacccgccctgccatatcagtagttgcgttataagtgcgggtctaggacacgaaggccaagtcgttgcgatatgcgaggatgactctccgagtggatccgacgacgagtcccttgaaggtactaatacctgggacccgaccatcgatttcaagcaagaagcggatcagacagagagtgaagaggatgaggatgtaggacttcccccagagttggagaagatagtcacccatgaggaccaagagatggggcctcatcaagaagagcacgaaacta

SEQ ID NO: 39159 - DNA, 238 bp, Glycine max
  Peptide Sequence Number=SeqID_130844
atggggcagatgattccagcttgtaagagcttggtcacctcctttttcaccacatctagatcgacggggttgagtcactgctgtggctgcctcactggcttagctccatcctctaaaacactagcaacaacttttcctcttgctcagcagcaaggggaggcagagatgatcactagaaatttttccttgtcctccaaggaagcacatttgagggttgctagtaagggcttcaactctg

SEQ ID NO: 39160 - DNA, 270 bp, Glycine max
  Peptide Sequence Number=SeqID_130845
atgcttcaggataagcatataaactacttgtcacaacctacaatttcgcgggcgagggaggcgaggctcacaggtgcgtcttccaaaggaggaaaatgcgcggagttgccaccaacgtttatttctggaaaacgtcagaaaaaccgaaggaaaccggtcatgaagaatattccagattcgggagttgtatttacgcttgaggaaggtcgacaaaagcggggctcttgctcctacgtaccctccatcgaagaggaaatcagacctacgtag

SEQ ID NO: 39161 - DNA, 312 bp, Glycine max
  Peptide Sequence Number=SeqID_130846
atggggagagtttatcagggatccgctgttgttcataacactcctttgttgcctggccaagtaaaggtgagtgtggaggaggttacagatgcagatgctccaattcctgtacccactgatgaggttttcttagtggggcagacacttcacaccttccttgcttggccgacacatctggtcaagtctttatcacagcaggtagctctgtctctggcaaaaccacctccaaagcccgatccggaggccgatgatctgctttatcttatgacattgaccattccagagctttttcttgaggccttatcaggttag

SEQ ID NO: 39162 - DNA, 210 bp, Glycine max
  Peptide Sequence Number=SeqID_130847
atgttaagagacttttattttcagaacaattacccattgtcgcaacgtgcccttcgcgggcgagcgagggcgaggctcacgggtgcgctttccaaaggaggaaagatgcgcggagttgccaccaacgtttatttgtgggaaacgttggaaaaaccgaaggaaaccggtcaaaatgaaaattctaagttcgggagttgtatttacgcttga

SEQ ID NO: 39163 - DNA, 210 bp, Glycine max
  Peptide Sequence Number=SeqID_130848
atgtgcaacctccgtaagacgaacgcactccctcttcttcgcctcaacgagatgactcctcagccctcatgcatgaagttctttcggagttacgaggcctccacacctatgttggtgagcgctttgattccttggatggtcgtattgatgccattgatgctcgctttgcaggcatggatacccgcatcactcagcttgaagaggatataa

SEQ ID NO: 39164 - DNA, 282 bp, Glycine max
  Peptide Sequence Number=SeqID_130849
atggccacaatgatggaggccatgacgagcatgaaaaagatactggaagccaatgcggttatagttgccgctaccagcactgtcgctaaggcgaacccaatgcccccatctggcctcaagcaaatagcccctcctgctatgcctgaaaagggaaaggtgaatcatctaaaggaaaggctcagggccattgaaggaggtgaagattatgcctttgctaacctagaagagttgttcctaatacccaaacatggtcattcccaagttcaaggtgccggactttga

SEQ ID NO: 39165 - DNA, 870 bp, Glycine max
  Peptide Sequence Number=SeqID_130850
atggcggggcagacggataacgcggatatcgtgggcaaaatatttcccgccaaactgcgcgccgagaccgagattttgcgcttcctgcagcagctcttgctccagctgcacatcgcggaaggcctgaccgtgctcgttgcctgcggtcggcaggtcgtcataatagcgggcggaagccagcttaacggtcttcagcgtcgcttccgcagaggtgccgccaatcacaaaggcgatgtggtaaggcgggcaggccgcggtaccgaggaggtaggttttgttggccgagccgccgccttttgccatgcagaggaatttgtattcgtcgccgtcgacgctgtagagatcgatctgtgccggcaggttggtgccggtgttcacctctttatacatatccagcgcggcgttctgggagtagcgcaggttatcttcgatgtaggtgttgtacacgccctggctcagcgcagcttcatcgccgccgccggtccagacgcgctggccttttttacccatgatgattgccgtgccggtatcctgacaggttggcagcacgcctttggccgcgatttcagagttgcgcaggaattgcagggcgacgtatttatcgttctggctcgcttccgggtcgttgagaatagcggcaacctgcttctggtgcgacgggcgcagcataaaggccgcatcgtggaatgcctgctgtgccagcagggtcagcgcttcaggctcgaccttcaggatctcctggccttcgaactcggcaacggagacgtgctctttggtcaacagatagtattcggtgtcgtcatgggagagagggaaggggttctgataaataaacggtttattcgacatagtattgctccacaaaaataa

SEQ ID NO: 39166 - DNA, 279 bp, Glycine max
  Peptide Sequence Number=SeqID_130851
atgccaatctccccctgcagatgtatcgggatcgtgcccacaagatgcccagtgggcccgaagaagtccaacggggccctggggtttccagctctggttacgggcctctgtcagtcctacaggttgcccattcccccagcgaggtcatgccatcgtgacatacggatcgagcctgcaagacacctagtggacccgaagaagtccagcagggtcttggagttgtcaagctctaattacgggtctctcacctccagcaagggcatcaggcccctctactaa

SEQ ID NO: 39167 - DNA, 717 bp, Glycine max
  Peptide Sequence Number=SeqID_130852
gtacattgagcaactgactgaaatgcctcaaaatgttcttacgatgccattgggatatatcaacggtgttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggacatgtgaacctgactatttctcagtccagagttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 39168 - DNA, 179 bp, Glycine max
  Peptide Sequence Number=SeqID_130853
atggaggatttgattaacaaaacacaattctctcccaaaataatcccaacgtcatcacatcggcttggcggctccacaaaagaatctcacttcacgtactctacaactatcattctactcccacgaacaaaggttcgcgatcatcacaggtccaaccacacggtacaaaaattgcgagg

SEQ ID NO: 39169 - DNA, 702 bp, Glycine max
  Peptide Sequence Number=SeqID_130854
gatggcattattatttctgaggtgcatcagtcactgttctttcctttaactaatttacccagtcaaggtgcaccttttgagggcaccattgttaatgactggaaatttgattattcgagtcatgatgctcgtcgtatggtctgcaatgatcaagctgaaatgatcggtagattgctggccgagtcattaacatttgataatcgcatcatgcactatataattgttaggattttgcttcctcggtcttcaaatttagcacaagtctctgaggaggatttgattcttatgtgggcttttcttaccggtcgtcagatcgactgggcccatttggttcggtaccgaatgcataaggcattacgggccaatgcacctctcccttatccacatttgattactctgtttctgcgtcattttcaaattccgcttgatgatgaaccatttgttcaagtcaagcgttcctttgcaattggtgctggagccgtgacttcctttgggtaccgtaaagatcggaatggtcaatggctaaagaaggatgcactccttcctcaagatgaacgtactccttcacctcttcctcagcgcgatgattcagcactcatgaatgaagtcctctccgaattacggggtcttcgttcttatgttggtgaccgcttcgactcgttagatacacgctttgccggcatggacattcgcctcacatag

SEQ ID NO: 39170 - DNA, 272 bp, Glycine max
  Peptide Sequence Number=SeqID_130855
tccggacacaaggattggattggctcccaaatctaaagactgtgagagacaatgaggttaaagcttcggaagaatgtgatgaggtacaagccctaaaggcgaagcttgaaagagcccgggtagtcaaagagaagttcaaggcagcaatagtgagctcaagctccgaagatgtgaaaggaatcatcatgggtcaaaggcatgatcttgaaggacgagctaaaagcttgcctcaggtcgaaaagaaatttgtcccaacagttaagcgagactga

SEQ ID NO: 39171 - DNA, 201 bp, Glycine max
  Peptide Sequence Number=SeqID_130856
atggtacttgcaagttgtgttagggtcataccactttgggaaagggggttggaggaccttttcgggagttaccacgaccaaatgttccttgttgcgttggaattaccggccaggcgagtcgtgttcggagttggaacttggggagcttccctctgggtgggtgtcttaggctgcataggtgccgaactagaggcgttcccg

SEQ ID NO: 39172 - DNA, 405 bp, Glycine max
  Peptide Sequence Number=SeqID_130857
atggcgagggcgtgtagccctctgaaggtgaggacatgcagtcctctgatggcgagggcgtgtagccctctgaaggtgaggacgtgtggtcctctaaaggtgagggtgtgtagccctacgaaggtgaggacatgcagtcctcagatggcgagggcgtgtagccctctgaaggtgaggacatgcagtcctctgatggcgagggcgtgtagccctctgaaggtgaggattgactatccttttgaaaaaggtgataattcatgcaacctctatcctatctttttgcaaatctctccggggaactcccctcagagtgagggaacctattgggtgaatacttctaatctgcccctaggttcgcttgaggtttttgcatggtgcctttcgttgccccagtgtagggcttag

SEQ ID NO: 39173 - DNA, 180 bp, Glycine max
  Peptide Sequence Number=SeqID_130858
gggcaggatcaccttgggctaccttctggagtggagacaaaacatgaacggcagaaaccaatcaaggtacttaaggatgaacgcaagcggggatggggtcacgaccgaccgatcgttgcccttctctgtgcgaaacaagcagggaatgcctgggcgagccacccctgcaccaaattataa

SEQ ID NO: 39174 - DNA, 321 bp, Glycine max
  Peptide Sequence Number=SeqID_130859
atgtgtaagaaggagcatgaatctttcaaagaatgcgcccaaaggtggagggatctagcagctcaagagaagatgatgggttacatgccttcaagctttgtagatttagtgtttgctggcgaaaagattcaagtgggtctgagaagaggcaaatttgattgtcctgctttgatgaataggaagcctgaggcaaatggagagaataaggagggaggaacccatgtcgtgactgtcatttctacatggccaaatttcccactagctcaacaatatcaatactcagccagtatcatcccttctcattacccaccaccctattaa

SEQ ID NO: 39175 - DNA, 681 bp, Glycine max
  Peptide Sequence Number=SeqID_130860
atggcaacgtttaaggcaaaagacggcacgcagatttactacaaagattgcggcgcgggtaaaccggttctcttcagccacggctggccgctggatggcgacatgtgggacagccagctgaactacctggccgagcgcggcttccgcgccatcgcctttgaccgtcgcggctttggccgctcggatcagccgtggaacggctacgactacgacacctttgcgtccgacatcaacgacctgatcaccaccctggacctgcaggacgtgacgctggtgggcttctccatgggcggtggcgacgtgacccgctacatcaacaactacggcagcgcgcgcgtcgccggtctggcgctgctgggcgcggtaacgccaatctttggtaaatctgcgaccttcccgcagggtgtggatcagagcgtgttcgacggtattcgcgacgggctgcgtaaagatcgcgcccagtttatcagcgactttgccaccccgttctacggcatcaacgccgggcagaccgtctctgccggtgccctgacccagacgctgaacatcgccctgctggcgtccctgaagggcaccatcgactgcgtgaccgcgttcggcgaaaccgatttccgcccggatatggcgaaatcgacgtgcgacgctggtcattcacggcagcacgacagatcgtgcgtttga

SEQ ID NO: 39176 - DNA, 381 bp, Glycine max
  Peptide Sequence Number=SeqID_130861
atgggtgtgaaggctatggacgacatcaaagctgatgtcccactgcatctcaaaaagtcagagtgtgagaaggactttcatgtaaacttcaggtctgaatatcagagagtgaacaaagaaagtgaagttctaagagcagcagatcaaaggacacactgttacctatggacacctcaagaaaccagttactcctccacatgctttctatatcctccaaagaagatgaagtcagaatatggcatcaaagattggacatccttgcacttaagaggcataagaaggtcattgcaaaggtctggaggctttgaaaatagaagaaggcacatgaagaggagatcctctgagcgccttaacaggagaagtcggttttctgaactctaa

SEQ ID NO: 39177 - DNA, 347 bp, Glycine max
  Peptide Sequence Number=SeqID_130862
atggttttagggcgaaagacaaagatgtttgttgacccacaaaatgcaaacatggctacattggctgaagttgcggagacgttacaatacatggtgtctcctcaagggaggaatacatggacagttgatgatctcgtgccttatgtggagaaaattacaattttattcgaagagcaagagagaatcattgagcctgtgtcacatggtcctgcatcaaagcgtcaatttcccgcacaacagtttcacattcttcagtcaagtgttgaaactcagggcacagatagacgaagggaggctgttgaagcggaagaatattcccaacaaatggcggagcgtggccatggaat

SEQ ID NO: 39178 - DNA, 281 bp, Glycine max
  Peptide Sequence Number=SeqID_130863
gaagggaccagtcaccaaagcaatgagcaagaggctccaagagaattgggctagagttactgaagaaggccctaggggttctcatgaacctcagggaagatttcagagcccatgggccaaggtcgagggtgagcttagctatttgatgggtgtgagtagcccccttctagcttctcaaggaagttttcttccttgcatcctaaggaagctaccttccttgcttctcaaggaagcttcccattgtattattttggcatggggtgagcttagctattggagag

SEQ ID NO: 39179 - DNA, 815 bp, Glycine max
  Peptide Sequence Number=SeqID_130864
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgttacttttattgtgacaacagtagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 39180 - DNA, 581 bp, Glycine max
  Peptide Sequence Number=SeqID_130865
ccaaatacaactaccaggcagaatttgaaatcacagaggcttctgtcagtaggacgaaaaggaagctacttcagaccgtgagcgagagatggaggcagtttaaatcagacctcacgaggaaatgggcccttgcagccgatcaggacggtgtggaggacactgtctgtgagaaatacgacatcagcaaggaaaaatgggcccagttttgccagactcgcagagacccttcttgggagaagctcctggatgagaagacgaagaagaagctggaggaagctgcacagtcaggaagcgttgatggcgccatcgaccctccattcccggtcagacgccacgtgaagtggaagatggcccgcatgaagaaaataggggagatgatgattgaggtcgcaaaggaaatcgctgagaagatcgattcctttgaggagcaggcgacacagggatccttagaaaaaacatggacgtcaggatgttctcatcgctgctattggacgtccagagcaccctggatgtgtccgtgctgttggagtcggtgtcaccatcaagcaatactttggattgactccacggatgtcctgtag

SEQ ID NO: 39181 - DNA, 342 bp, Glycine max
  Peptide Sequence Number=SeqID_130866
atgtccaaatcttgtggatttgggatgaccggccctctcgatgagtcgatctcttgctttctcataagggtggacccttgggtacttgtacctatcacttttagaggactacacgtcctcgccaacagagggctgcacgccctcaccttcagaggactacatgtcctcgccttgagagggctacacgccctcaccttggttaccctcaccgttgagaggactacacgtcctcaccttgagaggactacacgtcctcaccatcagagggctgcacgccctcacctccagaggactacatgtcctcgccttgagagggctacacgccctcaccttgggtactag

SEQ ID NO: 39182 - DNA, 177 bp, Glycine max
  Peptide Sequence Number=SeqID_130867
atggcgacaacaaatgcctcagcaacctatgctattctgtttgagtacctaaagcaattggtagtgatcaaggaacccatttttgcaacagaacaatgcatgccctacttaagaagtacggggtggtacacagggtatccacaccataccacccccagaaccaatggacaggcataa

SEQ ID NO: 39183 - DNA, 384 bp, Glycine max
  Peptide Sequence Number=SeqID_130868
atgggtgaagtagaagaggtgcaagagcaaatgaaggccgacatggaggtcatgaaagagaaaatggccacaatgagggaggccatgatgagcatgaagaagataatggaagccaatgcggttgcaattaccactaccagcattgttgctaaggtgaatctgacgcccccatctggcctcaaccaaatgaataatccaacctcagatatggtaggcaaagatttgggaagtacatgcggcccccattatgtgcaaattcaaaacaagcacgccttcccgccatatggcttgcctcccgactatacaccacccaatgtggcatacactcctaataaaaatgtcaataactccactcctataatcattgagagccaacaaccttaa

SEQ ID NO: 39184 - DNA, 333 bp, Glycine max
  Peptide Sequence Number=SeqID_130869
atgggaacaaatcaaaccggcaagaggttttaccaagtcaaggttaaaagcctagataccaccagcatcaaggaattagggcggttgatggaacctctccaaatgcaagcctttcgcaagacttacggaaagatcttagagttgaccatagcagagcagaggggggtgtacttagtaaaaatgggggtgcaaatagcacccaggcccacttgggccctccagaatattcctccagaaggcggttgcttttggaggaagcaaccctgctcgcctgggcgagctgagctcgcctgggcgagctgggcggcaaccacctcccctattttgctataa

SEQ ID NO: 39185 - DNA, 171 bp, Glycine max
  Peptide Sequence Number=SeqID_130870
atgtggtatcattttcagtggaaaaatctcgttggacacctaggagtacatgacaagactggcctcacaatgggtaagtcaggcctagactttgaggagtctgtcagggcctctctgatggaagcttgcttgtggagcttctatggaggctggatctttgagcttcaatga

SEQ ID NO: 39186 - DNA, 492 bp, Glycine max
  Peptide Sequence Number=SeqID_130871
atgagggcgtgtagccctctcaaggcgaggacgtgtagtcctctcatggtgagggcgtgcagccctctgatggtgaggacgcgtagtcctctcaaggcgaggacgtgtagtcctctcaacggtgaggtacccaaggtgagggcgtgtagccctctcaaggcgaggacatgtagtcctctgaaggtgagggcgtgcagccctctgttggcgaggacgtgtagtcctctaaaagtgatcggtacaagtacccaagggtccacccttatgagaaagcaagagatcgactcatcgagagggccggtccacccttatgagatagcaagagatccccagtggagtcgccaactgtcgcaacctacccttcggcgggagggcgacgcgagactcgcgggatgcgtgttccacgaaaggaatacgcgcgaagtcgccaccaacgtttatttgaggaaaacgtcggaaaaaccggaaaagacgcgatctacgaacttttaa

SEQ ID NO: 39187 - DNA, 120 bp, Glycine max
  Peptide Sequence Number=SeqID_130872
atgaaagagaaaaaggaattggtgttgtgggtgctccagaaggttcgtggcggtggtggccagcagcagcggtggagtgaaaatgatgatggtcgccagttggtcggccatgtgtcatag

SEQ ID NO: 39188 - DNA, 456 bp, Glycine max
  Peptide Sequence Number=SeqID_130873
atgacaaggagtaaaaggtttatggaggctgaggatgaggatagtgttgtgcataagaagaaaactgctgacaagaaaggtactgatgacaagaaaaatgaggtgagaggtgaaagtaatcaagaaaaagaggaacaaataatggtcaacaataatgaattgaaggaccaagaaaatgaaaaagaagaaaaaaataataagaatgcaaagaagggtagaagtgaaaaagctgtggacgaaggtgtggaagtaccatatcctgtggaaactggaaataaccatgtgtcgcaacctacccttttgcgggcgagcgaggcgaggctcacgggtgcgtcttccataagaggaaaatgcgcggagtcgccaccaacgtttattgaaaggaaaatgttagaaaaaccaaaggaaatcggtcatgaagaatattccagattcgggagttatctttacgtttga

SEQ ID NO: 39189 - DNA, 886 bp, Glycine max
  Peptide Sequence Number=SeqID_130874
atgaccttcgacacccttgcagggcaggccggcggcgtatcgttcggcccacggccgtccccgcggcccttccctgactcactcggcctggaggccatcaaagtgacccgtactcccaagatcgtgctgctgaccctggccgtttcggccgcgctggtcggctgcggcaagaacgaaaccccggccaaggacgccaccgcctccacgccggctgcggccgaagccacccagtacaccctggacgagagcaagctgccggcctacaacgccttccagcccagcgatctggataccagcaaggacgcctgcggcgccttcggcgactacgtcaacagcaagtggctggccgccaatgaaattccgggcgaccgcaccagctggggcgcgttcaccatcctcgacgagcgttcggtggccgtgcagcaccagctggctgaacaggtcgcgcaggtcaagaacccgaaccacatcgagaagatcgtcggcgacctgtgggccaccggcatggacgaggccaagatcaatgcccagggcatcgagccgctgaaggccgacctgacggcgatcgacggcctgcaggacaaggcggccatcgccgactacctgcgcagcagcgcggccaagggtgacaacgtcctgtttggcttcggcgccgaagccgacttcaagaactcggccgtcaacctggcctacgccagccagggcggcctcggcctgccggacagcacctactacaccgatgccaagaacgccgacaagctgaaggcctaccaggcgcacgtcgccaaggtgctggagctgtccggcgtcgccgctgccgacgctgccaagcaggccgaggacgtggtcaagttcgagacccgcctggccaagcctccaatcgcgc

SEQ ID NO: 39190 - DNA, 1808 bp, Glycine max
  Peptide Sequence Number=SeqID_130875
tccagcccgacgttccaggtcttggtcgagccgatggtgttgtagtccgaatagcggccagccagatccagcgacaggcggcggatgcccgggatgtcggccagcagcgggatgttggtttcggcgaacacttccttgacgttgtacgaaccgccaccgccgttgatggcgttgaggaaggtggcaccggaggctgccagcggatcggtacgctcctggctcttctccttgcggtactcggcgccggccgcaatgccgacatcaccggccggcagcgagaacagcgcgttgttgctcaccgacgcgctgaacacggtctgctgcagtttgccgaagtagtgcgaacgggtattgaaccagtcggccgcattctgcggcacggcgccatcaccgaagatgctgaagggaatgcagcccgaaccgatcaggtcgcggttgtaagcgcggccaccggcattggcgttggtggcattggcatcgcggtcgacacggcagacgatcttgccgctggaatcgcggactgcgtccagaccggcctgccagcgctcgttgatgcggttgttgacgttgacgcggttgatctcggtctcgccatagttgccagaggcctcgtagctccagttgtcaccgaacatgccttccacgccgaagacgaagcgcttggtctcgcgcttgacttcctcgccgcggcggcccgcgtcgacattgaatcgggctatctgcagctgggtcagaccgttggcatccatcagggcgcccagctcagggctgatgaaagcattgtcgcgacggatgcggatggtgttgtcgaaagcgggctggccgaagaaggtcgattccgtcttggtgtacttgccttcgaagaacaggcggtgcttgtcgttcaggtcgaagtgggcgacggtgttgacgctcaggcggtcgaacttcggctgcaggtcggcaacagcgttcagatcggtgaagtcacagttgacgcacgaggaagggctgaccactggcccatcgaaacggttgcggctgaagctgccatccggattgaagtgatagcggtactggtaggtgttgggcttggtgaaatcgaacgtgccaccggcttggaacgaaccgccgtaggaggtggagtagttgccgcccgggcgggccaggacggtctgcgggttgctctcgctcggcggcttggtgcgatcgaaattcggattgggcacggtcacgtcgtagcgtttaccgatcgaacggtcgccacggccgaaacgatcctgctggctgtactcgaccgccacggcgacattgcctcggccgtcggcgaaattggtgcccgcggtagccgacacgaagccgcgattgaagccgccttcgcccgcaatacccttctgcgcgcgggcctcgaagccctcgtagttcttcttcatgatgaagttgaccacgccggccacggcgtcggcgccatagatggccgatgcgccgccggtgatgacttcaacgcgctcgatccactccaccgggatggtgttgacgtcgaccgcggtgctgccgggattggcaccgacatggcgacggccgttgaccagcaccagggtacggtcgtagcccatgccgcgcaggtccatcaggcccaggccggcggtaccgatgtagcgagtggagttgccgagggtgaacgaaggtgccagctgcggcatcttgttcatcaggtcgctgatggtcagcgcgccggtctggcggatttcttcggcggtgatggcggtaaccggcgaggatgtcacgaagcccgtacgcgcgatgcgcgagccggtcacgctgacccg

SEQ ID NO: 39191 - DNA, 462 bp, Glycine max
  Peptide Sequence Number=SeqID_130876
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatactgctcaccgtagagtccttaaaggacgtgcccggaagaaagggcaagccatgcacgggattggacaccattgcagccggtaccaccgccgccacatcaagcttatcgataccgtcgacctcgagggggggcccggtaccagcttttgttccctttagtgagggttaa

SEQ ID NO: 39192 - DNA, 705 bp, Glycine max
  Peptide Sequence Number=SeqID_130877
atgcacgccctcaccttcagaggactacacgtcttcgcctttagagggctacacgccctgaccttcagagggctgcacgccctcgccttcagaggactacacgtcgtcgcctttagagggctacatgccctcaccttcaaagggttacacgccctcgccttcagaagattagacgcccttgccttcagaggactacacgtcctcgcctttagagggctacacgccctcgccttcagaggactacacgtcctcgccttcagagggctacatgccctcaccttcattgggctacacgtcctcaccttcagagggctacacgccctcaccttcagaggactacacgtcctcgccttcagagggctacatgccctcgttttcacagggctgcacgccctcgccatcagaggactgcacatcctcgccttcaaagggcgacacgtcctcgacttcagagggttgcatgccctcacctttagagggctacgtgtcctcactttcagtgggctccatatccatacctcccttggtcacccccctgatctcggaggagggccaactgtgcgagcacaaccaaagggaggctatcgtgcagctactgtgcataccagggcaagatttcacccgtgccgctgcaaagagacgaaggcggatcatgcacaccaacatgaccactcttacacagatatggataacgttgttacttag

SEQ ID NO: 39193 - DNA, 240 bp, Glycine max
  Peptide Sequence Number=SeqID_130878
atggcagtaggatatgatgtatgcatgattcatgaccttgagggggagttgtatgtacacgattttgagggggagactgctgctgatgacgactgttgtaagctactagaagatgctgcaatttttcagaagaagatagatctcctccagcatcaagccgttgcagcccagaaacgcaaattgctatataatcatggaggctgcacgagttctgtaccaagtccgggattgaagtgttag

SEQ ID NO: 39194 - DNA, 255 bp, Glycine max
  Peptide Sequence Number=SeqID_130879
atggtagccataaccctagccaaggttcatcaacctccatttatccgagaatacgactcgaacgcaacgtgtgcttgtcacggagaagccccggggcattccattgagcatggtagggctctgaagcgtaaggtgcaagaatgtgggtgcaagccattggtctgtttgctcaagcgacctgtgctcctgagtttggacttccaagaccgttcaatcagagattactcgtcttgcacgttggtgggggtgccgtaa

SEQ ID NO: 39195 - DNA, 594 bp, Glycine max
  Peptide Sequence Number=SeqID_130880
atggatcagcttcagcggcaagcttttcgcaaagcttacggtaaaatctgggacttagccatggtagaagtctccacaggggccattgcctccctcgcccagtattatgatcagccgatgaggtgcttcacctttggggacttccagctatcacctatggtagaagaatttgaagagatcctaggatgccctctagggggaaggaaaccatacctcttctcaggtttcacacctttttcgccaagaggtgaggcatgcttgcccgctagaaagccactgttcatgcacagagaaaggaggggaaaattgggaccactcttagcaagcaaagaaggagcgtttgtcaactggttccctcgatggaaagaaggaagaaccggggttcttatttcgtgcggaggatttccgaatgttcccttgatggggaaaaggggttgcattagttacaatcccgttcttgttagaaggcaacttggctaccccatgagaggggcaccacaaggggaagagcacggccggaacaagttccgaggggctctgtggggcagcaacagcaagcttaagctccggagagaggaaagggaccaatcatga

SEQ ID NO: 39196 - DNA, 732 bp, Glycine max
  misc_feature (71)..(71): n is a, c, g, or t
  Peptide Sequence Number=SeqID_130881
atgaaggttatgcagaaatcctctttagcgggaagacaatcacaaaatctggagataggggacaacaacanacactatcgccttaactggaggaacaatgccgacattacctccttttatttcacccatttccccgacgaagctaatgaagagttgctatggaggcacttcaaaaactggggtgacgtacgtgaagtatacatcgctaaaagactcaacaaggatggcaggagatacgggttcatgcggttcaagggagtctcggatgcaaaaggattggaggtgagactggacaacatcttcatcaacgattgtaaactatttgtcaaccttcctaggggggggtgccaaggagacaaaagggcagacgaggcacaaacaccaactattctgatcaacccagatgaaggtggggaatattggtgtaacgaaacctgggtgggcatgctaaagaaggtgatggaggtggaaaccttagaggatcgtatcacttgggagttaggatataacgtccgcactaagttcctcggagacgacatggttcttctccctgggatgtccgatgacaaagctcaactcctcattcaatcagagacggaaagcgatgattctctcttttactcactggagaagtggacgccgaaatgtagacccaataacagggttgtttggctccagctgtggggatttctgatacaggtgtgggaaatgaaaaatctcaggaggctgtag

SEQ ID NO: 39197 - DNA, 279 bp, Glycine max
  Peptide Sequence Number=SeqID_130882
atgaccggccctctccatgagtcgatctcttgctttctcataagggtggacccttgggtactagtacctatcaccttcagaggactacacgtcctcgccttccagaggactacatgtcctccttcagaggactacacgtcctcgccttcaagagaggatagtatacgtcctcaccttccaaaggactacgcgtcctcaccttcagaggagtatacgtcctcgccttcagatggactgcacgccctcaccttcaaagggcgacacgtcctcaacttctga

SEQ ID NO: 39198 - DNA, 285 bp, Glycine max
  Peptide Sequence Number=SeqID_130883
atggaggccataaaagagcaaatggccacaatgatgaaggccatgataagcatgaagaagataatggaagccaatgtggttatagttgccgctattagcgctgtcgctaagtacggcccccatgatgtgcaaattcaaaacgagcatgccttcccgccatatggtttgcctctcaactatacgccacccaatgtggcgtacactcccaataagaatgtcaataactccactcctatacccattgagagccagcaaccccaaactgatcatgcacatgtctcttaa

SEQ ID NO: 39199 - DNA, 1893 bp, Glycine max
  Peptide Sequence Number=SeqID_130884
atggcgatggtggttatcgacggcaaccagcgcgtattccgcagcttcggcgaaacccgtccgggtaataatcagcatccacaattggattccgttatccgcatcgcctctctgagtaagctgatgaccagtgaaatgctggtgaaactgctcgatcagggactggttaagcttgacgatccgctgagtaaatacgcgccgcctggcgcgcgggtgccaacctaccagggcgtaccgattacgctggtcaatctcgcaacccacaccagcgccctgccgcgcgagcagcccggcggcgcggcgcatcgcccggtattcgtctggccgacccgccagcagcgctggaactggctgtcgacggctacgcttaaaaccacaccgggttcgcaggcggcctattccaacctggccttcgacctgctggccgatgcgctatcgaccgccgccggtaagccctacccgcagctgtttgaagaacaaatcacccgcccgctcggcatgaaggacaccaccttcaccccatcgccggatcagtgtcaacgcttgatggtggcggagaaaggcgccagcccgtgtaataacaccctcgcggccatcggcagcggcggcgtgtattcgaccccgggcgatatgatgcgctggatgcagcagttcctctcttcggatttctatactcgcggccagcaggccgatcgcatgcagacgctgatttatcaacgtacccagctcacccgagtgatcggcatggatgttccgggtaaagccgatgcgctgggtcttggctgggtgtacatgaagccgaaaaacggccatccgggcattattcagaaaaccggcggcggcggcggatttattacctatatggcgatgaacccgcaggctaacgtcggggtcttcgtggtggtgacccgttccgcgttgacccgtttcagcgccatgagcgacggcgtcaacgacctcgtcagcgccttaagcggcgtgcagccgaatatggaaaccgccagccagcaaaccatgacagatttaatcactcgcccacgccgcctgcgtcaatccgcctcgctgcgcgccatgtttgaagagacaacactgagtttgaacgacctggtgttgccgatctttgttgaagaagaaattgacgattacaaagccatcgaagcgatgcctggcgtcatgcgtattccggaaaaacatctggcgcgcgaaattgagcgcatcgccaacgccgggattcgttcagtgatgacctttggtatttcccaccataccgacgcgaccggtagcgatacctggaatgaaaacggtctggtggcgcgcatgacccgtatcgccaaacaggcggtgccggaaatgatcgtcatgtccgatacctgcttctgcgaatacacctcgcacggccactgcggcgtgttgtgcgagcacggcgtcgataacgatgcgactctggaaaacctcggtaagcaggcggtagtcgccgcggccgccggcgctgatttcatcgcgccatccgccgcgatggatggacaggtacaggcgatccgccgttcgctggatgccgcaggctttaccaataccgcgattatgtcttactcaaccaaattcgcctcatcgttctacggcccgttccgcgaagccgccggtaccgcgctgaagggcgatcgtaaaacttaccagatgagcccgatgaaccgtcgcgaggcaattcgcgagtcattgcttgatgaagcccagggcgcggactgcctgatggtgaaaccggccggcgcctatctggatatcctgcgtgatatccgcgagcgcagcaacctgccgctcggcgcttatcaggtcagcggcgagtacgcgatgatcaaatttgccgcgcaggctggcgctatcgacgaagagaaagtg

SEQ ID NO: 39200 - DNA, 255 bp, Glycine max
  Peptide Sequence Number=SeqID_130885
atggcgaacatggctttagtaaagagacaaaacttccaactgatcagagcaacatatgctttttggatgaaaaacaatgtgtctatcggggaaggagaaggaagcactgggttcaacaaaaatagaagaaaatcactcaaagtgtatcaatctcacacgggcgagaaagtcgctagtgcacaggattttggttggcaatcaaagggagaggaccactttaggtcgtggtttccttttatcttgtttacttggtga

SEQ ID NO: 39201 - DNA, 444 bp, Glycine max
  Peptide Sequence Number=SeqID_130886
atggattatggcctctggcttcaaaaagggaactgggagattgtggaggcctctggtaatcgattaccagtctgtgtaatcgattacacagaggaatgggtcactggtaatcgattaccagatcgtgatggcggcgcagctaatcccatgactcgagtggagatggagtgcctagagggagcttgggagaccactcgaaggcaacacgaggtgccgatttcggggcacgattcgatttacggctacttcattggtgcatcccagatgaacccgtgcgcacgcttccagcgtactgtgagagtggatactaccccacgcctaacaccaataccgtctaagtgggagccagtccaaagtgatcgaggtgaacgtcatccgaggaaagaccctgaggaggatccccgaggagctacctccctgagcctgctatggatgcatttatga

SEQ ID NO: 39202 - DNA, 109 bp, Glycine max
  Peptide Sequence Number=SeqID_130887
gcaggcgcaaggcgagaccccacagcagcctagggatggccgacagcaggcaacagacacactgccaccacctctagagttcacctcagctcatccacaaaaaggttag

SEQ ID NO: 39203 - DNA, 360 bp, Glycine max
  Peptide Sequence Number=SeqID_130888
atggctataacagagtttctgttattcatattaacagctactctaggaggaatgtttttatgcggcgctaacgatttaataactatctttgtagctctagaatgtttcagtttatgttcctatctactatctggatataccaagaaagatgtacggtctaatgaggctactacgaaatatttactcatgggtggggcaagctcttctattctggttcatggtttctcttggctatatggttcatccgggggagagatcgagcttcaagaaatagtgaacggaattgggttcaagctttccccagccccttctcatcaatggactcctgacgtatacgaaggagtgcggttcgttcgataa

SEQ ID NO: 39204 - DNA, 729 bp, Glycine max
  Peptide Sequence Number=SeqID_130889
atgcgcgaaaaactgcgccgctgcggtatccgctcgatcgatccggtagtggatatcactaactacgtgctgctggagctcggccagccgatgcacgccttcgatctcgaccgcattgacggcggtatcgtggtgcgcatggcgaaagagggggaaaccctgacgctgctcgacggcagcgaagcgaccctccacagcgatacgctggtgattgcggatcaccacaaagcgctggcgatgggtggcatcttcggcggtgagcactccggcgtcaacgaagcgacgcagaatgtattgtttgagtgcgcgttcttcgatccgctggcgatcaccggtcgtgcgcgtcgtcatggtctgcataccgatgcttcccaccgctacgagcgcggtgtcgatccggcgctgcagcataaggcgctggagcgcgccactcagctgctgctggcgatttgcggcggcgaagccggcccggttattgatcagaccgatgccagcaaactgccggcgcgcgccaccattacgctgcgccgtgagaagctggaccgcctgattggccacgtcattgcggatgagcaggtgaccgatatcctgacccgtctcggctgtgacgtcaccgtcggcaacggcgaatggcaggccgtcgccccgagctggcgcttcgatatggccatcgaagaagacctggtcgaagaagtggcgcgcgtatacggctacaacaacattccggat

SEQ ID NO: 39205 - DNA, 414 bp, Glycine max
  Peptide Sequence Number=SeqID_130890
atggaaagatatctgccttccaaaggagttgggggatggttatgggctttagcctctactcaagatcagctgtgggctagaattcttatctcaaaatatggtggctgggcagatcttaacaatggcagtgatacaccttggcactctcattggtggaaggatattcgaaaagtaggggatggaagcatagtcaaattctggaaggataaatggcttggggttgattcaaaccttgagcagcagtttaatcggctgtttctcatcagtaaacagcagaccagttctatctccaatatgggtatcatgtctcatggtcattggtgctgggatttaaaatggagaaggaacttatttgatcataaacagggtgcaattgtggcttttatggaaatcattagtaacgttcacatttaa

SEQ ID NO: 39206 - DNA, 354 bp, Glycine max
  Peptide Sequence Number=SeqID_130891
atgggcttacccggcaccacgacgtatcctgctcgcgttcttctcttcggcctgtcatcgagcgaaatcagcgaagcggcgcggcaaatcgcggccgtgacatggcgccggatcgaccgggaccgccgccagcaacgcttgcgccgtcgttggctcatcggcgatcaccacttcgcaggcggcaggagagcgccatggcaatacagatcacccgctggcgcatgccgccagagagctgatgcgggtaacgccaggcgtgttccggcttcaggccaacgcgctccagcagccaggccacgcgacgctgtgccgcgtcgccgtccagcaggttatgtacccgccgcggctccatga

SEQ ID NO: 39207 - DNA, 570 bp, Glycine max
  Peptide Sequence Number=SeqID_130892
atggtggaagcctctggtaatcgattaccagcctgtgtaatcgattacacagaggaatgggtcactggtaatcgattaccaggcatgtgtaatagattacacagggcatttttgcatatttcatgtcctgagatcgtgatggcggcgcagctaatccgtgatcgagtagagatggagtgcctagagggagcttgggagaccctcgaaggcaacacgaggtgccgatttcggggcaccattcgattcatggctacttctttggtgcatccagatgaacttgcacggacgcttcagcgcacggtggagtggatactacccacgcctacaccatatcgtctagtggagcccgtccaagtaatcgaggtaatgtcatccgaggaagaccctgaggaggatctggaggagctacctcctgagcctgctgtggatgccattgactttctagagggtgatgaggatccacttcttgaggtggattctcccgaggaagtcatgtcagcatctgaggcagactctacggaggatagtggcccgggggagatggcgatcagcggaggctcttcatcatag

SEQ ID NO: 39208 - DNA, 237 bp, Glycine max
  Peptide Sequence Number=SeqID_130893
atgagggacggcaagaggtcttcgtatgtcattgggatcggggtgaattccggggttggctttgggggaaagttcctcatcgcgttggaaccggtgccaaagtgggcgttgccggccgggcgagtcgtggttggagccggagcttgggaggcctccctctggatgggtgcgggcgctctaggttgtacaggtactgaattggaagagtccccggtgcgagctgagaagctcgggtga

SEQ ID NO: 39209 - DNA, 204 bp, Glycine max
  Peptide Sequence Number=SeqID_130894
atgaatgttttgagtggtgcaaccctcttttgtaaaatcactcgtgcacccaacatcttcatgatttgtgtacataaggactcattaggtagtgatcaaggggttcccatgaaccctaagaaaataaaggacattcttgagtggcccactccaccaagtgttgagggaaggaaagcccagagtatgaagaacctcaggatttga

SEQ ID NO: 39210 - DNA, 124 bp, Glycine max
  Peptide Sequence Number=SeqID_130895
agattggcccgaggcccaagcaggggaggtgcctgcaggagctcccgacgatgtagaggaggcccgcatggatgaggagatgacggagttgctcggtttcttgggaggaagcagagccacgtga

SEQ ID NO: 39211 - DNA, 938 bp, Glycine max
  misc_feature (88)..(88): n is a, c, g, or t
  Peptide Sequence Number=SeqID_130896
gggcatccgaaagggcgtcatcggaggttatcacggatggctaagaattcatgcgcaagggttagattggctctccaaattgaaagtnatcgatgaggagaacttcgaagctccagaggaagatgaagaagttcgagccctaacattggagctagggaaggcaaggctcgccaaggagaagttcaaatcagctgctacacacatccggaaggagtgcactgagttacaagaggaaaacgcggccactgcaaaagcccttgaacaagaaaccaaaagggcccgcaaggaggaatatggccgagagaaattccgaggagcattgtggggtagcaacaatgagctcaagctccgaagagaggagagagatcggtcacgggtgcatggcatgatcttaaaagaagagttagttgcctgcacgaggtccaaaagaagtttggctcaacacttggaagcaacggagcaaagcatgctagctatcatagggcaatacaaggaagaattgaaccagtctatggcccatgaacaaaagctagtggaggattttgcacaagtgtacgccgaaaaagaagcaagagggagggtgattgatgcattgcatcaagaagcgactatgtggatggataggttcgccttaaccttgaatggaagtcaagacctcccgcgtctactagccaaagcgaaagccatggccgaagaacagatgaaggccgatctatcggccttaaaagatcaaatggcttccatctcggaggtcatgttaaaactccagaaaaccatagaggataaagccacgacaaccgcctccagtacgattagggaagcggagccagtactgcaacccactttaaatccgggccgagatagaaacacggccgtgtttggtcgaaggtatagtccacaagcttatccttatggcttgcctccggacttcactccct

SEQ ID NO: 39212 - DNA, 327 bp, Glycine max
  Peptide Sequence Number=SeqID_130897
atgaacgttcttcccaaaattaaggggatctctgaatcttcagtgatgttcatgactacgacatctgcagggaaggtgaagtgcttcacttggaccagaacatcttcaatcacctcatatggtctggtgatggagcgatctgttagctataaagtaattcttgtgggcattatttccaactcccccaaccttctacacatggagagtggcatcaagttgatactggctcccaggtcaatgagagcttttcccactgaaacttcaccaattgaacaaggaatggtcacactcccagggtctttatgctttggtggaaggatcttctaa

SEQ ID NO: 39213 - DNA, 942 bp, Glycine max
  Peptide Sequence Number=SeqID_130898
atggcaagtcaagaagagtgggtcccgtttgtggatatactagctttgctaatctttggggttgtcctctttccgaacgtggacggtttggtggacctagccgcaattgatgctttccttgcatatcaccatagcaaggagagcccagtggtggctatcttggcagacttatttgatacatttgaccgaaggtgcgagaagaacagcgcacggatcgtctgctgcttacccgctctttgtgtgtggttggtttcgcacctattccaacaagacataagacacccgtgtccgcttcaaatttattgctcgtgcgtcgaaaagagaagagtcgattgggaccaatacttggctgggataggaggcagcacaatcaactggtttcctcgatggaaggaaggaaaggggggagttcttttctcatgtggggactacccaaacgttccgttgatagggacgaggggttgtattaactataatcccgcacttgccataagacagctagggtaccccatgaggggagcaccaacggaagagagcctctcgcctttccttgtgagagatttcggtgtgcaaagtctcaaggttgtacaaagagtccacaaggcgtggaaaagtccgttgaggaaagataaagaacttaggggcatccgtaatggcatcatcggtggttatcatgaatggctaagagttcatacgcgagggttagattggctctccaagttgaaagttatcaacgaggagaacttcaaagctccggaagaggatgaagaagtccaagctctaaaattagagctagggaaggcaagactcgccaaagaaaaattcaagtcagccgctacaaacattcagaaagagtgtaccgagttacgagaggaaagcgtggccactgcaagagcccttgaacaagaaaccaaaagggcccgcaaggaggaacatggctga

SEQ ID NO: 39214 - DNA, 115 bp, Glycine max
  Peptide Sequence Number=SeqID_130899
ggcggtttgcgtatttgggcgctagcggaagtgtatactgggcttactatgttggcactgatggagggtgtcagtgaaggtgcttcatgtggcagggagaaaaaaggctgcaccg

SEQ ID NO: 39215 - DNA, 228 bp, Glycine max
  Peptide Sequence Number=SeqID_130900
atgaccaggaagaccttattgagcaggttaagcgtttactggctcatatggaagcgactgtacaaccatgaaggaaacataaatgaagcgttcaacaatgaaggtgcgcctgcgcaagtctctaacgagggggatgtccgccccttggctgaaagatattccacgctattgaaagataatcgagggaaggggcccatcgaacctatgaagggccttcgttgtgaaaag

SEQ ID NO: 39216 - DNA, 678 bp, Glycine max
  Peptide Sequence Number=SeqID_130901
atggccttcaaacgtaaggtccaaagtttgatagaagccggatggctgacgtttcaagaggaccggcccaacgttaagacaaacccgcttgccaatcatggagggggagctgttaatgctgtcgagtcgggtaggccgtgcaggtccaagcctttgaaggacgtgacgacccccagaaggtttatctacgaggccctacaaaatgggggcatgattccccacggtgggctcgagaagggttcctgtttgatgcatcccggtgcgccacatagcatagaagcatgtttagcagtaggagacctgttacaacaaatgatagaccaaagaggggacacaactccccaaatgtcccggcacctctcggtagttagacctattccatttccatacaaaaacagccacgcagttccatggaggtatgtgcctccaagcaaaaggaaggaaggagccaccgacaccagctcactatcggccaaagtaactaatatcacggggctgagcggtatgaccctcagcggttgcgtattcgcacccccggacctgtcgacacagcccgcaaatgctaaagggaaggcaaggatgacgaaaggacaaaatgtcaaagtgatccccgctccagacgaggatgttccaatgaaaggtctttatgagggaagggatggccgtgacaagaaagag

SEQ ID NO: 39217 - DNA, 703 bp, Glycine max
  Peptide Sequence Number=SeqID_130902
ggactacccaaacgttccgttgatagggacgaggggttgtattaactacaatcccgcacttgctataagacagttagggtaccccataaggggggcaccgacggaagagagcctctcgcctttccttgtgagagatttcggcgcgcaaagtttcaagattgtacaaagagtccacaaggcgtgggaaagcccgttaaggaaagataaagaacttcggggcatccgtaatggcatcatcggtggttatcatgaatggctaagagttcatacacgagggttagattggctctccaagttgaaaattatcaacgaggagaacttcgaagctccggaagaggatgaagaagtccaagcactaaaaacagagctaggaaaggcaagactagccaaagaaaaattcaagttagtcgctacagacatccggaaagagtgtgcaaagttacgagaggaaaatgcggctaccgcaagagccctcgaacaagaaaccaagagggctcgcaaggaaaaacatggccgagataaattccgaggagctttgcggggcagcaacaatgagctcaagctccggagagaggaaagagaccagtcacgagtacatggcatgatcttaaaggaggatttagctgcttgctcaagatccaagaggagtttggccctacacttagaaggcatggagcaaagcatgctagctataatagggtag

SEQ ID NO: 39218 - DNA, 456 bp, Glycine max
  Peptide Sequence Number=SeqID_130903
atgacattgctacttagcaacattctgcccaacgaccgcaacgccaatctccccctgcaaaagtatcagttggtctgtgtcgtcccgacatggggatcgcacccacaagacacccagtggacccggaaaagtccaacagggccctggggtttccagctctggttacgagcctctatcagtcctacagggtgcccgtacccccccggcaagggatcgcacctgcaagacacccagtggacccgaagaagtccaacagggtcttggagttgtcaagctctaattacgggtctctgtcagttctacggagtacctgtcacctccagcaagggcatcaggccccctactaatcgagctttcatcaagaagtattgcgccccagacaggcgcagggcgaaacaccacaacagcattgggatggtcggcagcgggaaacagacgcaccgccatcacctctag

SEQ ID NO: 39219 - DNA, 423 bp, Glycine max
  Peptide Sequence Number=SeqID_130904
atgcaaggtttggattggctcccaagtccgaggaccgctaaaagagaggaagttgaggcaccggaggaagacgaagaagtgcgggcccttagggtggaactcgagcaagcccaaacaattaaagaaagggaagaacacggccgtaacaaatttcgaggggctctgtggggtagcaacagcgagcttaaactccggagagaggagagggaccaatcacgagtagacagtttgatcttgaaggatgagttggaggtttgcctaaggtccaaaagaagcttgtctcagcgtttatgcgagacagagaccagcatgttagccatcgtcaggaagtaccaagaagaattaaatctatccacggcccacgagcacaaagtggcggacgagtatgcccgagtgtacgtggaaaaggaggctagaggatga

SEQ ID NO: 39220 - DNA, 504 bp, Glycine max
  Peptide Sequence Number=SeqID_130905
atggcgcctaccaggcaccctctggacccggataagtccaacaaggccctgggatttcccgccttgatcacaggactcggccagacgttcggagtccccgtcgcacctaacaaggtgattcggccgcccatcacccgagcttttattgagaagtattgcacacagagacaggcccagggggatgctccgcaggctgcagacgcgccgccacctcatcaggttggtccagccggatcgtttgatacggagcagtatttgcggcatttggttcgccagcaggcggccaactaccgggctcatagccagggttttacttctttttcgtgccctactccggaccagttcagggcagaggtcgcatggcctggagattggcctgaggcccgggcaggagaggcgctagcagaggcaccagtagaggctcccgacgaggcagatgaggcccgcgaggacgaggagatgaccgatttacttgatttcttaggaggaagcggggccacatga

SEQ ID NO: 39221 - DNA, 396 bp, Glycine max
  Peptide Sequence Number=SeqID_130906
atgacaccggtaaaccgaaaggcaggaacaggagagcgcacgagggagccgccagggggaaacgctggtatctttatagtcctgtcgggtttcgccaccactgatttgagcgaaagagtatcgaattcctgccccgggggatccactagttctagagcggccgccatccgcggtggcagctccaattcgccactaatcagtgagtcggtattatcatattcagctggcccgtcagctttttttctcacgaacgttcgactgggaaacaccctggctcagttacccaacatagtaatcgccgttgagcacatccccctttacgccagctggcgaatagcgaaaggcccgcactcgatccccggttgccgcattaagcagttgccgcaggtttcctga

SEQ ID NO: 39222 - DNA, 1289 bp, Glycine max
  Peptide Sequence Number=SeqID_130907
aggttctaccaagtcaaggtcaaaagcccagataccaccagcatcaaggaattagggcggttgatggaacccctccaaatgcaagccttccgcaagacttacggaaagatcttagagttgaccatagcagaggtgtccatagaagccattgcatcacttacccaatactacgaccagcccttgagatgcttcacattcggggacttccaattagtaccaaccattgaagaatttgaggaaattctaggatgtcctctcgggggaaggaaaccatatctttcctccgggtgtctcccctctttgagcagaattgcaactgtggtcaaggattcagccagaggtttggaccgcataaaacagactcggaacggcatagcgggcctgccacagaagtacctagaagacaaggcgaggggtatggccaatcaaggagactgggtcccgtttatggatgtgttagctttgctaatttttggggtcgtcctctttccaaacgtggatggtttgatagacctagcagcaatcgacgctttccttgcctaccaccatagcaaggagagtccggtggtagctgtcttggcagatctattcgacacatttgaccgaaggtgcgaaaagagtagcgcacggatcatctgttgcttacccgccctctgtgtttggttggtttcacacttgttccaacaagacacaagacatccatgtccgctcctgagccatcgctcgtgtactgaaaagaggagaatgagattgggaccagctcttggccgggataggaggggttgtattaactacgagggcgcgctcgctataagacaactagggtaccccatgaggggagcaccgacggaagaaagcatgtctcctttccttgtgagggatctcggcgcacaaaattccaagactatacaaagaatccataaggcatgggaaaccccgttaaggaaagatcaagagctcagaggcattcgtaatggcatcattggggggtaccaagaatggctgaaagttcgcatacgaggtttagattggctcgccaagttaaaagtcgtcagcgaagagaattttgaagcaccggaggaggacgaagaagtccaagctctcaagagcgagttaggaaaggcaaaactcgccaaggagaaattcaagttgactgctacacacgttcggaaggagtgtgccgggttacgggaagagaatgcaattaccgcaagagcccttgaaccagagaccaagagggctcgcaaggaagagtatggccggaacaaatttcgcggagctcctatggg

SEQ ID NO: 39223 - DNA, 213 bp, Glycine max
  Peptide Sequence Number=SeqID_130908
atgcctaacaatgctcctttcaaggtctgtcagatttcggatatagttgaagtcgaatcggggacgggagctgcacggatccgcgaaagaagtcagtctttctctctcatctcattgttgattctgagtccaaagctaatgctttctgttccacccgaacttcttcacttgctttctttcacatttcttgttcaagtctatactgtactgtaa

SEQ ID NO: 39224 - DNA, 228 bp, Glycine max
  Peptide Sequence Number=SeqID_130909
atgactggcgctaagcgcaagggtgaattagggtacagagggcacgaaagtttttacaacaattccagagcacactataatgcctattttgagaaaagagctctaaaggcaacaagaggaacaacttttgcagagagacctaggttttgtaatcagagagagattagtgagttgcagagtgattgtgagatgctgaggagaggaagagggatccctcttcttgcgtaa

SEQ ID NO: 39225 - DNA, 510 bp, Glycine max
  Peptide Sequence Number=SeqID_130910
atggcttcccgtaagagaaaagcaccagcttcagtgtctcaggctaggtatgatagatcaagatttgtatcccaagatgcctgggaccgctacatagacaatgtccttggccgaaagatcctcccgaaaggaatgagagaaattgagaggaggaattggcataaggagctcactaacttctctgaagggagcattgacatggcattagtgaaggaattctatcccaacctttatgaccttgaagataaatcaccaaagcagtggtcatcgaggaaaggggagagtttgccctcttactctaggttctacaggttgaggccagatcctcaagagcttgcagcccatctatgcatccctgggaggggatttgagttgcatgcagacgggctgcctctaaagattttgaggaagaatcttactactctggtccagacctggagtgttctgtctttttctaacttagccccgacatctcatacttcagatattactttggacaagacaagttaa

SEQ ID NO: 39226 - DNA, 333 bp, Glycine max
  Peptide Sequence Number=SeqID_130911
atggcagaagaattactacaagggatgatggataaaggcctaattgaagtctgcagcgcgagaaaaggggaaagggatgtgtgcatgcagtcatatgataagagaccatgcaaatccaaaccgttggtgatccacttcaccaggggagtcgccactcagaagccccaaggtttccagcccgtcccgattaagaagcctacgcctttcccttacaaaagtgataagtcggtaccatggaagtacgccacccaagggcctgacagaaggaaagacgcgtctgtcgtacatgttaaggatgatctatcctctgctaaggtcacaaacatggcatga

SEQ ID NO: 39227 - DNA, 209 bp, Glycine max
  Peptide Sequence Number=SeqID_130912
atggagagaaggcaaacaattcgaggcagaggaagacccaaaaatactataagagaggttatcaagaaggatctcgaacttaatgatttggatagaaaaaatccaagccgaggcgcttccgtaacgtttccgtgggtaattacacaaagattttcaaccgttcttcgacattcatcgttcgttcttcattgttcttcggtcttcaaccg

SEQ ID NO: 39228 - DNA, 387 bp, Glycine max
  Peptide Sequence Number=SeqID_130913
atggaggaagctgctcaatccgatagcactgacactgtgattgatcctccatctcccatcagacgacacatgaagtggaagatggctcgcaccaagaaaactaggcaaatgacgtctaaggcagcaaaggaaattgctgacaagattgcctcacaggatttttttgtcacccatggatgtcaagatgtattgactgctgccattgggcgactagaacaccctagtcgtgtgcgtggtgctagacccggtgtaatgatcaagaaatactttggaccggcttcaaggacctctcgcacgtcttcctccatggcttccaaagacctagagaagctgacgcaaaaaatcagggaccagctggaggagtcaatcacaaaaaaagtgacttga

SEQ ID NO: 39229 - DNA, 241 bp, Glycine max
  Peptide Sequence Number=SeqID_130914
gttaattaggcaaattggcaaaaatgttgttttcaccttctcgctaagccaatctgctggcttaaagccaggagaagatgagctgttaggttcactgagcgcaccgctccaggtcatcaagcgcaccgcttcagctcatccgctaagcgagagaaatgcgctaagccaaaatccacttatgcgtgctaagcgattcagatttacgctaagcgcgcgagcacggaccaacccacctatttaa

SEQ ID NO: 39230 - DNA, 819 bp, Glycine max
  Peptide Sequence Number=SeqID_130915
ggtgagtttgtcccccagggtcgtcaagatatacttaacacgaccataggaataccagatcatggaggtcgtgttcgtgcagctgggtctggggtcacaattagtcaatactatgggaggacatcacgtgcctcaactacctcatccatatcattcaccaaagaacagttagttgaaatagtagtgaccattagggaacaagtcaggaatgagattgaagaagaaaagaagcgaagtctacacgcttggaaaaacgagctgaaggatgccatcattactgacatatttaacggagataaggtctcagcaccggctaattttgacttaaatgtgttaggtgcacgcgtgagcactaaggagagcaatgctgaaattgttgtgaacccttctggggaagaacatgttggtcgtgtaacaccgcctatggggttgtacgtccaaagtcaagattgtacaaagctggtggcgttgggaaaaattcatgatggaccatctaccatacattgcgtagcatatgcagatgatgtcgtaagggttagtgtcgaaaaagtaattgatggtgaagctgaagttccattagcgacatcagaaattaagtatgtgagagatgtcgttaacacattcattgcatggccattgcctttgcattcaggaatcactccagacaaagctgccaatgctgccgaattaaacaatgatgttcctaaacaggaccccttgcatgagttgattaagacccttgttgagatttacgacaagcctgtggagtttgtgtgggatcttactaaatttgggattccaaatgtgaaaaatgcttga

SEQ ID NO: 39231 - DNA, 294 bp, Glycine max
  Peptide Sequence Number=SeqID_130916
atgcagacgacgttcgtgtcgcctcaccgcaacacggatcaccatctgcatcaaccaggagggtctggaaggcccgacgacgttcagcctcgcaccggccagtcgcgccgaaccgtcctcacgggcgccgtgtggtcgatgcccatagttgcggaaacggggatgacgcctatcgcagttaagagcaccaccacccggtccctcccatggacatccacgaacacgtcactccccaccctgcagatgctggacggtggtggcaggatcacggcgtcggcactcgtcacgccgccg

SEQ ID NO: 39232 - DNA, 243 bp, Glycine max
  Peptide Sequence Number=SeqID_130917
atgtactctgccaatggtttctcaagatttctcaaggtagagggtacatctacttgggttgttgtaattgagaacaagagagggtacatctcttgtggatcagttcaaatggagcatacatccatttggttgttcaaagagaataagggagggtacatcccttgtggatctttgcttgtaaaggtttttacaaggttgaaaaaagatctcaaggaccgcaggttgcttggggactggatgtag

SEQ ID NO: 39233 - DNA, 1028 bp, Glycine max
  Peptide Sequence Number=SeqID_130918
ttcctgaacgcctgccggaccggacactacgtgctgatctcacgcgaggaggccatctcgaattcgttcgcctcgttagggctgatggccgcgcaggtgcagtcgcagattgccgggcgtccgctgccggaggcatcacggtgatccgcaaagagaaaggtcgcgtggatgtttatggcgaacgttttcgcgcgcgggcgcatcagctgacgccgcgtctgctgcaggtcgcccgctatattcatgacaatcgcgaagcggtgatggagcagacggcaatggagatcgccacgcagcttaaaacgtcagacgccacggtggtccgcgcgatccaggcgctgggctttgccggactgcgcgatctcaagcagaccctggagcagtggtttggtccggtggtgacctcgagcgaaaaaatctcgtctacggtcaatacgctcaccagcgacgtgaatgcgagtatcgattttgtgctggaagggcaccagcacacctgcgaggtattgtcgcaaccgcacaaccgctacgcgatggcccaggcggtctcactgctggcacaggcgaggcaggtcgccctgtttgggattggcgcctccggcattctggccgagtacaccgccaggttgttcagccggatggggctgcccgccacgccgcttaatcgcaccggaataggccttgctgaacagctgatagcgcttcagcgcggcgacgtgctggtgatgatggcgcagaaatccgcgcaccgggaagggcaaactacgctgcgtgaagcgaaacgtctgggcatccccaccattttgctgaccaacgcgctggattcacgtttcagtaaagaggcaagcgtagtgatccacgtcccgcgcggcggtgaaaagggtaaaattccgctccatggcacggtgctgctgtgtctggagatgctcattttatccgtcgccgccaccgagccgcagcgcaccatcaggtccatgaagcgcattaacgagctacaccgtgggttaaaaccggggaagaaaagcagctaa

SEQ ID NO: 39234 - DNA, 141 bp, Glycine max
  Peptide Sequence Number=SeqID_130919
atgaggaaggcgtggagcagttcttgcaatttgcttcagaaagaggtcaactggatgaagatggaaaatattattgtccttgcatcaattgattgggctagagctgttgaagaaggccctagggatctcatgaacctcagg

SEQ ID NO: 39235 - DNA, 78 bp, Glycine max
  Peptide Sequence Number=SeqID_130920
atggacacccgtctccgtgtgattggtgatcccatgaatggaattcaatgggggtggaggtcacatcccactctttga

SEQ ID NO: 39236 - DNA, 282 bp, Glycine max
  Peptide Sequence Number=SeqID_130921
atgcaactcatcaagcatatcatcaagcctaggaatagggtgcctatacttctcaattatgttgttgatggccctacaatctgtacacattctccacttatcatccttctttggcaccaacaacagaggcacactccattggagcttgtaggcctaggatcttcttcatcaatggattcctttgcttcttggattataaatggcagcggaatggagaaggaagagagagaggtgacgccacttcaaggagaagatgagtctagaagaagttcaccaccatag

SEQ ID NO: 39237 - DNA, 181 bp, Glycine max
  Peptide Sequence Number=SeqID_130922
gtgtggaagcaatgccttccaagattattttgatgatgccaaagaatcaagagttaagcaaattccaaagtttcaagaatcaagattcacgattcaagaatcaagtttcaagaatcaagattcaagaatcaagtttcaagactcaagattcaagaatcaagagaagactcaatcaagataa

SEQ ID NO: 39238 - DNA, 201 bp, Glycine max
  Peptide Sequence Number=SeqID_130923
atgtcagccagtgatcatgccattctacgagacggaacccatcaacccacgaagaaaagcttgttacaggttgtaccatctgtggtgaggctcatgaaacaggccgatgtattcccactgaagaaaacactcaagaaattcattatatgggaaatcaacaacgataaaggtatactcaaggagaatttttcaggcttctag

SEQ ID NO: 39239 - DNA, 994 bp, Glycine max
  Peptide Sequence Number=SeqID_130924
agggctacaagcccacgccttcaaaggactacacgccctcaccttcagaggactacacgtcctcgccttcaacggactacaagtcctcgccttcagaggactacatgtcctcccttccagagggctacacgcccttgcttttagaggactacacgtctttgccttcaaaggactacacgtccttaccttcagaggactacacgtcctcgccttcataggactacatgtcctcccccccagagggctacacgccctcgccttcagaggactacacgtcttcgccttcagagtactacatgtgctcaccttcagaggactacacgtcctcaccttcaaacaaatgcacgtcttcaccttcagagggctacacgccctcgccttcagagggttgcatgccctcaccatcacagggctacacgccctcgccttcagaggactacactcactcaccttcagagggctacaagccctcgccttcagaggactacacttccttaccttgagaggactacacgtcctcgccttcagaggagtacacgacctcaccttcagagggctacacgtcctcgccttcagaggacttcacgtcctccccttcaaaggacttcatgtcctcgccttcagaggacggcacgtccttgccttcagaggactacacgccctcaccttcagaggactacacgtcctcgccttcagaggactacacgtccttaccttcagtggactacatgtcctcgccttaagagaattacacgacctcaccttcagagtgctacacactctcgcctttagagagttgcacgctgtagccttcataaggctacatgccctttacttcagaggactacatgtcctctccttcagaggactacacgtcctcggcttcagaggactacacgtccttgccttcagaggactacccgacctcaccttcagagggctacacgacttcaccttcagagggcttcaagtcctcaccttcagacgactacac

SEQ ID NO: 39240 - DNA, 402 bp, Glycine max
  Peptide Sequence Number=SeqID_130925
cgaggtaaagcgccagtggattcaacgatgtttgatctagaaattatcaagactgaaaggaagaataggaagaaaaagaaacaagcaactcctaaaacactgggtttgtctttttcttctgattatctttcaactgataagccacttgtagaaaataacatggctaaaagaggagaaggaaatataccaccaaggaggacgttgggtgactatgcttatcaacaaggaccaaaacattacaatagcatagtcattccttctttcaacaataaggtcatggaattaaagccagcactgcttagtctaattggcttacatccctttggtgggatggatcataaggatccatacacacatttgtctaccttcatgggaactatgcagtactatgggagcttctga

SEQ ID NO: 39241 - DNA, 378 bp, Glycine max
  Peptide Sequence Number=SeqID_130926
atgtgctacatgggcatcgttaaggacctttatcaacagcgcacgatgaggctcggagtttatgagcagttcaagcaaagagatccttgctggagttttattcagttgctcgactaccttaaactcgttttgttggatgaggcggaggaactcatgggcctcttccaaagtcactgtttttccttgaagaccctctttcttttcaacccctcttaccaccggaggatctacttctttcgagggggtagctacatctgtgggctcttggaccatgggcgttttccccttggagggcaactccgccgagcggggggaagtgaacacccggccactgcgggtcacgccactgaggccggtgatgttggtcaccttagctga

SEQ ID NO: 39242 - DNA, 528 bp, Glycine max
  Peptide Sequence Number=SeqID_130927
atgcaacctgtgcttaatgggcttaatgaatggaatagtcgctatgaaaggagagtagagcaaactctgccacaaacaggaacccttagtctgaactctgaatatatgaggtggtacacgcgtaaaataaaagtttatgtcgacccaaaacatgcaaggagaggattattgggtgaaatcgtcgaaacactgtattttatggtgtcgtctgttgggagaagggtttgtacttttgacgatttactgccatgtactgagaagatcactcttttgtatgacgaagaggataggatacttgaggcacatgaagatgctccctcttctcaaccacaatttgaacatcaacagtttaatatactacagcgaagtgtggagactcgaggcttagtgcgatttcaggaaactgttgattcagcactgtacaattttccctccgatgccagaacgacaatatggaatgtattacacattgccggcattcacccaagaaccgtcgtagatgccgtcgatatattcttacccacatga

SEQ ID NO: 39243 - DNA, 528 bp, Glycine max
  Peptide Sequence Number=SeqID_130928
atgattatgaggagcaaagacatttatagtagccaagatgaggctactacatcaccttcctctagtgaaagtgaagaagcaaaaggggaagagtctagtgaagaaatctacccccaagaagaaggacaacctgtaatggttaatgaggagtgtaaggaggtaagtgtctcctccaagaggttagttaagaaggaaagtcattttgaaataaagacaaatattaaagaaacttcccctcttagacaacctccacatcttctcctttgtaaaaagacacttgttagcattgccacacctcttgggcttgaggttattcctcaagtaaagaagttgttggatgagggtttggttcgtaagagcttaaatccttgtgctttgttggtgcccaaaataggggttcccacggaccctaaaagaataaaggtcattcctaattggcccactccaccaagtataagggaaatctggggctgccatgacttaacaaacttttacaaaaggtgtcgagggaaggattccaaagtatga

SEQ ID NO: 39244 - DNA, 222 bp, Glycine max
  Peptide Sequence Number=SeqID_130929
atgacgtattgtaatcgattacaggtatttgtaatcgattacaggaccaataagcctactggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 39245 - DNA, 441 bp, Glycine max
  Peptide Sequence Number=SeqID_130930
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcctatttgttctttgacttgggacaagtcacagatttctgaacgtcaagtccctcatccatgggatgaaatctaa

SEQ ID NO: 39246 - DNA, 135 bp, Glycine max
  Peptide Sequence Number=SeqID_130931
atgggtgttaagtacctcgaggcggtcaatcgaaggttgcatgccaccaaacaatggtccccagatgaaattaggggtgttgcccttgctccctacgtatcctcaaggtgcgatgaggaattcagatctacgtag

SEQ ID NO: 39247 - DNA, 330 bp, Glycine max
  Peptide Sequence Number=SeqID_130932
atgcaaaggatcgacgtgctgaatgtgagcattacttacaagcatggctcaaggaatcgcaacgagaggggccattggcaactggtagtactgtgtcctacgaccaatgttattgcatggttttgttcgttatacgttgatcatgctattattataagcagtgcaatgaagtcagcaaacacaactgcgaaaggtacaaataatccagcaactcctaagtggattgaagtcaagagccatgttcaaagcggagggtatgagtgtggctactacgtgatgcattggatgtggaacatcgtcagtgggggtttaaagaatgattggagcatg

SEQ ID NO: 39248 - DNA, 333 bp, Glycine max
  Peptide Sequence Number=SeqID_130933
atgatcgttttgcgtgcaactaaaattttaacaaaaccaacctctgaaccatgctcagggtttcattttgagcgttttgatatatatattgcctactttcgaaaacgggccccgacgggtgcagagaaacgcgaggaactggaaccagagaagtggcacgttaaccgaggcaggattttagcattcaaaagatttcagaaaaagcttttcctccctcttcccacattgcttttcttcttcctttctcctccaccattgttgccctttgaagctccaaatttgctcatcatttctactccaaattgcaaagggaagccattttcagagtcgtga

SEQ ID NO: 39249 - DNA, 345 bp, Glycine max
  Peptide Sequence Number=SeqID_130934
atggtgtttttgaggtgctccagtggcttctgtttctatcagctgtcctctgttcagctactgacggggtggtgcgtaacggcaaaagcaccgcggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 39250 - DNA, 156 bp, Glycine max
  Peptide Sequence Number=SeqID_130935
atgactgaagcacgtcaaaagggggtacggaaagtaaatgaaaacgagaataaaagggaggagcttgccacccagctcactcaggcaaggaaggttgcttcctccagaagcaactgccttctggaggaagaatctggaaggcccaagtgggcctga

SEQ ID NO: 39251 - DNA, 729 bp, Glycine max
  Peptide Sequence Number=SeqID_130936
atgcggagactgttgtcaacccatgtccgcctaatcatttttgctcctatcgaaccccctatggggttgtatgtccagtgccaagattcaattcagttggtggccttgggaaaaacatatgatggaggctcgaccatacacaatgtggcttatgcagatgatgtcgtaagggttagtgttgagcaagttattgacagtgacgctgaggtcccattcccgacatcagagattaagtgtgttaagcaggcccttcacacattcattgcatggccaacaccactggttaaaaaaatctatattgagcatgagggcaccggtctaactaaagacactgaagctgttggaccgatcaacgatgttgtcatagatgaccccttgcgcgagttgattaagagcctagttgacatttatgagaagcctatagagttagtgtgggatttaactaaatttggaattctaaatgcagctgcatcattgttcgtaacctgtgctgatgtgaatgaaataatatcaggcgtacaatgtttgaacataactatactacaattatggaccatgtatatggacgaattgagtcaaagagatggtctaggatcggtgtatggattccttgagccgcaggctatactaaatgcaaatgatagacgtggacaatgtcaagaatacattgaaaaatggcttaaggaatcgaaccgacatgtctatctaggcgcttatttgaataagtaa

SEQ ID NO: 39252 - DNA, 324 bp, Glycine max
  Peptide Sequence Number=SeqID_130937
atgacggacgtgtggggtgctaataccttcctcgggcgtaaatacaactcccgagcctttcacttaaaagttcgtagatcgcgtcttttccggtttttccgacgttttcctcaaataaacgttggtggcgactccgtgcgtattcctttcgtggaacacgcatcccgcgagtcacgtgtcgccctcccgccgaaggtccctactgctgctgtatgttcttcgaaggggatgatacctctagaaaccatcaagagagatatgactaccttgggggttaccactaaaatcctagttagctctctcccttataggttccttaaatag

SEQ ID NO: 39253 - DNA, 315 bp, Glycine max
  Peptide Sequence Number=SeqID_130938
atgtttgcacattcgattaaaggctgccgtcccttgggacggacgtgtggggtgctaataccttcccctaaatatttattcgatttgatgcacacaaacaccaacacgtatttgcaccctgtgaagaaaaagggccctagtacccgaagtgcttctgtaacgcttccgataagcgattctgtggaggtgaattctgtcatgcttcagtcgttcttcccgttcttcatccgtcttcgttcttcaacgggtaagtttgaaccctcatctagagactttattcatttgaaacttgttgttgctgtactttcactttaa

SEQ ID NO: 39254 - DNA, 291 bp, Glycine max
  Peptide Sequence Number=SeqID_130939
atggataaagttgatatctttgtccctcatcctctcacaaacgcatgtttgcttattcaactttcaccggaatgtgggtgcaagccattggtctgtttgctcaagcgacctgcgctcctgggtgttgacttccaagactgttcaatcaggagattactcgtcttgcacgttggtgggggtgccgtaaaacaacgagaatcctctacaacaagagacccacggtctcttaatcccttttcagaaataagaagaagagaagaagaggtctctcgtaaaagaggtagattgtaa

SEQ ID NO: 39255 - DNA, 304 bp, Glycine max
  misc_feature (178)..(178): n is a, c, g, or t
  Peptide Sequence Number=SeqID_130940
atggccgctttggagagagaaggtagcgacggactcggttccacagaggcgcagctcaccacctcaaaggattggaaagccgtttccaatgattcttccgccgcttctacgtatgccgttgaagggactacttcaccagggcatgaatccaaggccttcccaagaggcagctataggncgggatttatatccatcaacttgaaacaacacattacaagtgtgggggcctatctgaatgggatatcgatttcccccattacttcccgccgagtaccatcaatggctcgcaccaccatcgagctcg

SEQ ID NO: 39256 - DNA, 505 bp, Glycine max
  Peptide Sequence Number=SeqID_130941
atgacattgctacttagcaacattctgcccagcgaccgcattgccaatctccccctgcaaaagtatcagttggtctgtgtcgtcctgacgtgggtaaggatcgcacccacaaagacacccagtggacccgaaaaagtcaaacagggccctggggtttccagctctggttacgggcctctatcagtcctacagggtgcccatacccccccggcaaggtcacgtcatcatagggattgtgctcgcaagacacctagtggacccgaagaaggccaacagggtcttggagttgccagctctaaatacgggtctctgtcagttctagggagtgcctgtcgcccccagcaaggtcatcaggtcccccctaccaatcgagctttcatcaagaagttctgcgtctccaggcaggcgcagggcgaaacaccacagcagcctggggctggccggcagcgggcaacagacgcaccgccatcacctctagagttcacctctgctcatccacaaaaag

SEQ ID NO: 39257 - DNA, 435 bp, Glycine max
  Peptide Sequence Number=SeqID_130942
aaaagctgtgattttggttgatgtgttgagcagagttttctgcctttgctctgttttgcttggctgtgatagcttgtgctgtttgaatgttgttttgctcggatgttgtggaagcttgggaggattgatggggacccggggatggtgggtttatgcgtgcattgtggatgtggaaaacttgttgtgcaccatcgcccgaccgccacctagtaccacatgtgatggggtgaaacttcctgcttttattgttgaccacagagtggtacctggagatatgtcgcgggggtcaggagaccttggggacgtcaggcgagctcctggcagtcaacagataaaaggaacaaagaccacaaagcaaggaggcttgtggtggctggccagctgtgaattttgtgtgatatgtggattatggcctctggtaatcgattaccaagg

SEQ ID NO: 39258 - DNA, 933 bp, Glycine max
  Peptide Sequence Number=SeqID_130943
atgaccacactcgctcagacttggagtgttctttcttactccaacttggttcctacctcacacacttctgacatcacacttgatagggccaagttgatttatgagatgataatgaagatggataggaatctgggctacctcatctcccaccagatctctattattgcccagaatgactcctctaggcttggattcctagccttaatcacaactttatgtaaagctagaggagtcacatctgattccaggactcttaagagccttagccccaccatttacttggcgtacattaagaagaactgttggaatctggatgatccaatagtaacattcagagggcctaagaagaccaggggcaagagattagaggcccctactacttcagcagcaccagagacagccgcaccttcttcatccactcctccagcaccttcttcttctactccatctactcagataccacttccagctcattcatcttttggaccctcaaattttttgtttacttcagagatgcttcattctatgctccagagcttacacagagggcatgtcattatcatgcagagtctccagagctcaggcctgccatttatcatgagcacagatgagttcctgactcaggtggcttcgttaggagtccagccttctccttctggagggggtgggacctctgcagctcaagagcttgaggatgagcctactcctcctgagccctttgaatttgtttctgactcagtggtggctcaagaagaagtaccttcaccagagcctattccagagccatctcctacacctgttcctgaggacaccatgctagctgaggatacccagccatctgaaccagtattggagcatgagcaactcaccattcaggattcatcagcaactccaattctggatctgaatgaagatcaaccacaggaggattag

SEQ ID NO: 39259 - DNA, 572 bp, Glycine max
  Peptide Sequence Number=SeqID_130944
agtgtgccgggttacgagaagaaaatgcagctaccgcaagagcccttaaacaagaaaccaagagggctcgcaaggaaaagcatggttgtaacaaatttcgtggagctttgtgggacagcaacaatgagctcaagcttcgaagggaagagagagaccaatcacgagcacacaacatggtcttgaaagaggagttagctgcttgctcaaggtccaaaagaaacttgtctcagtgtttatgcgagacagagaccaacatgttagccatcgtcagcaagtaccaagaagaactaaatctagccacggcccacgagcacaaagtggcggacgagtatgcccaagtgtacgtggaaaaggaggctagaggaagggtgatcgatgtgttacatcaagaagcaacaatatggatggaccaatttgctcttaccttgaacgaaagtcaagaacttccccgattgctagccaaggccaaagcgatggcggacacctactcctcccccgaggagatccacagacttctcggctattgtcaacatatgatagatttaatggcccatataattagaaaccactag

SEQ ID NO: 39260 - DNA, 492 bp, Glycine max
  Peptide Sequence Number=SeqID_130945
agcctttctcctttccttgtgagagatttcggcgtacaaggtttcaaggttatacaaagagtccataaggcgtgggaaggtccgttaaggaaagataaagaacttaggggcatccgtaatggcatcatcagtggttatcatgaatggctgaaaattcgtacacgagggttagattggctctccaagttgaaaattatcaatgaggagaacttcaaagctctggaagaggatgaagaagtccgagctctaaaaaccgaactaggaaaagcaagacttgccaaagaaaaattcaagttggtcgctacagacatccggaaagagtatgccgagttacgagaagaaaatgcagctaccgcaagagcccttgaacaagaaaccatgagggctcgcaaggaagagcatggccgagacaaattctgtggagctttgtggggcagcagcagtgagctcaagcttcgaaggggaagagagagaccaatcacgagcacatag

SEQ ID NO: 39261 - DNA, 531 bp, Glycine max
  Peptide Sequence Number=SeqID_130946
atggggacaaatcaaatcagaaaaagattctatcaagtcaagattaagggcctagatgtcaccagccttaaggagttgggacggttgatgggacccctccaaaggcaagccttccacaaagtgtacggaaatattttagatttgaccacacacgaggtatttacgaaagtcgttgtatccctcgcccaatactatgaccagccattgagatgcttcacgtttggggacttccaaatagtattgactgttgaagaatttggggagattttaggatgccctcttggggaaagaaaaccgtatcttttctccgggtttcttccctccttgagcaagattgcagctgtggtcggagattcggcgaaagagttggatcatatgaagcaaactcgaaatggcgtagtgggcctatcgcggaaatacttggaaggcaaggcaagggatatggcgaatcaagaggaatgggtcccgtttgcggatatactagctttgctaatctttgcggttgtcctctttccttgcatatcaccatag

SEQ ID NO: 39262 - DNA, 312 bp, Glycine max
  Peptide Sequence Number=SeqID_130947
atgagcgttgaggagttcattcagtcggtggcttggccaggagtccagtcttctccttcgggagggggtaaggcctcagcagcccaggagtcgcaaccaaaggaggaggatgacactatcattctagagcccactccacctgagtcctttacttttgaggctgacacagtagagccatctccatctccttcctctgagcctaagccatctgcactagcaccagtgcctgaccagtctacttctcaggacccatcatctataccgctgttggatctgaacgagcatgcggaggatcattcaaaggatgattga

SEQ ID NO: 39263 - DNA, 228 bp, Glycine max
  Peptide Sequence Number=SeqID_130948
gttagtgtggatacgtggatggatataacggagatgggatatgtcattgcatcaaggtataatgtttatttgaaagaccgttgtcctttatcgcctctagcattgttatggtctaggaattctcatcctcaggcaaagcagtggtcagctccatatattagtagaatgcagaagtacataagcttcatgatgttcaaaagagactatgtcgacataaatgaagactga

SEQ ID NO: 39264 - DNA, 513 bp, Glycine max
  Peptide Sequence Number=SeqID_130949
atgtggatgtgccatgaggagtacccatggtcttccatctccatactggagacaatccacatttttttgcggagacttagtttttcagatcaagggttaagtgagacacaggtgaccataactgaggagatggaaaccatatcgaaacgctttgggcagctcgatgtttgtggtaaaatacatttgaagtcaaagctacgagaaattgcttatcctgatatgaactccatgtgtcctcctctagaaaaggagtatgttgatgcgttacaatttgtgcaaattagtaattcgtcagtgaaacgtagtgcatcatcatttgaggacccaatacagagacagaatattccaatgttgaatgaatttcatccttgcatccaggattctgttgaaaacattattgatgtcatagtaaatgataattatggttatcgtgcaatagctacgttattgggtatgggtgaagaatcatggtcattggtaaataaccatctacataaacaaatgactagctaa

SEQ ID NO: 39265 - DNA, 223 bp, Glycine max
  Peptide Sequence Number=SeqID_130950
aaggcggttgcttctggaggaagcaaccctgctcgcctgggcgagctgggcggcaaccacctcccctattttgctataaataggggaggaaatgaagaaggaagagccgaggcgcttccgaaacgtttccgtaacgttttccgtgaggaatctcgcaaaggtttcaaccgttcttcgacgttcttcattcgttcttcatcgttcttcgatcttcaacggggaa

SEQ ID NO: 39266 - DNA, 324 bp, Glycine max
  Peptide Sequence Number=SeqID_130951
atgactttgagggggagactgctgctgctgatgatgactgatgtcctggagacttgcaactgggttcccacaatcatacagattccgactgttgccacaagttggattcacgatgtcggatacaatgtccagtcaaagcctcccgagaaatactggagttgctggatactagatcaaaagtctcaagtagtggcattgatgatgaagctaagcagtgaggacagagcgaccgaagcagctgaagaagaagaagaagctgctgaggaagaggaagatgcagcagaagagacagaatcagatgatgattctgaagccaccccatga

SEQ ID NO: 39267 - DNA, 399 bp, Glycine max
  Peptide Sequence Number=SeqID_130952
atgccatcgcagaacaaatttgttggatgcgcgttcacaggaaaaaatcctaagaaatttcaaattccttcaacatgtaccatcgatgaactgaagaatttaatcaagcaagttgcacctaaagggattccccctcttggaattcacgaatcacaaacggtaagacgattttttttccgcgaaccagctcggtttgagtattcagatacggttataaaatatgaaataaatgagctgatcaccaacgaagaactgctgaaggtgttagtacaatctaactactggaaaaaatatggaccaatagaaattttagctgtctttacgaaatatgttgaagacgagttgacggaactggggaacgggactattttttttggattctttgacgtccagacatga

SEQ ID NO: 39268 - DNA, 484 bp, Glycine max
  Peptide Sequence Number=SeqID_130953
gagacgacgttagtctctgcgtgctatcaggcttttcgtcttacagatagcaaaaaggtttatacggataaccactcgggtatctccgcccgtcagcgtgactcaaaagtcagtatgacagatcttgtgagcgtggaagatgacgcttttcgtcttacagatagcaaaaagttttatacggataaccactcgggtatctccgcccgtcagcgtgactcaaaagtcagtatgacagatcttgtgagcgcggaagatgacgcttttcgtcttacagatagcaaaaaggtttatacggataaccactcgggtatctccgctcgtcagcgtgactcaaaagtcagtatgacagatcttgtaagcgcggaagatgacgctaaaaagaaggtttatacggataaccactcgggtatctccgcccgtcagcgtgactcaaaagtcagtatgacagatcttttgagcacggaagatgacgtcaatctccgcg

SEQ ID NO: 39269 - DNA, 537 bp, Glycine max
  Peptide Sequence Number=SeqID_130954
atggtgggttacacaccttcaagctttgcggatttggacttcgccagcggaaggatcaaagcgggtctgaaaagaggcaaatttaatcatcccacttggacgaatgagaaaactggggcaaatgaagagggtgagaaagagggagaaacccatgctgtgactaccattcctatacggtcaagtttcccaccaacccaacaatgtcattactcagccaataacaaaccttctccttacccaccacccagttatccacaaaggccatccctaaatcaaccacaaagcctatctaccgcacttccaatgacgaacatcacctttagcacaaaccaagagcaccaaccaagaaatgaattttgcaaacctgtagaattcaccccagttccagtgtcctatgctgacttgctcccatatctacttgataattcaatgggtagccataaccccaaccaaggttcatcaaccttcatttctccgagaatacgactcgaacgcaacgtgtgcttgtcacggagaagcctcggggcgtcccattga

SEQ ID NO: 39270 - DNA, 471 bp, Glycine max
  Peptide Sequence Number=SeqID_130955
ctctaatcctcccccaggaactatgacggatattgatactttccaacaaccccaaaactacattgcggagatggagcgatgccatgaggaagagctcaaaaagctaaaggctaaccgggatcagctgcaagctcactttagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgccccttcccaacagttgcgcagcctgaatggcgaatgggacgcgccctgtagcggcgcattaagcgcggcgggtgtggtggttacgcgcagcgtgaccgctacacttgccagcgctgatgtcccgcggtgcttttgccgttacgcaccaccccc

SEQ ID NO: 39271 - DNA, 396 bp, Glycine max
  Peptide Sequence Number=SeqID_130956
atgaggggagaaacccatgctgtgactgccattcctgtacggccaagtttcccaccaacccaacaatatctttactcagccaataacaaactttctccttacccaccacccagttatccacaaaggccatccctaaatctaccacaaagtctgtctaccgcacttccaatgacgaacaccacctttagcacaaaccaaaaacaccaaaccaagaaccataaccctagccaaggttcatcaacctccatttctccgagaatacaactcgaaacacaacgtgtgcttgtcacggagaaagccccggggcgttccattgagcatggtagggctctgaagcgtaaggtgcaaggtctaattgatgcgggctggctgaaatttgaggagaattgcgtgtaa

SEQ ID NO: 39272 - DNA, 405 bp, Glycine max
  Peptide Sequence Number=SeqID_130957
atggccccgaggaagcttgcctcaaagaggtccaggaaggacaaggcggccgaaggaactagttccgctccggagtacgacagtcaccgctttaggagcgctgtacaccagcagcgctttcgaggtcatcaaggggatggtcgtttctccgggagcgacgcgtccagccccatggccaagttcgatccagaaatagtccttgagttttatgccaatgcttggctaacagaggagggcgtgcgtgacatgagatcctggagggccaggaatgtgagtatggccagaggaggaaccggtctgatgggttcgatgaggaggccatcgcccagctgctatgtataccggggcaggattttgcccggactgctgcagggaggcgagtgcgaatcatgcgcaccaacatga

SEQ ID NO: 39273 - DNA, 717 bp, Glycine max
  Peptide Sequence Number=SeqID_130958
atggctaagtttgaccctaatatagtcctggtgttttatgctaatgcttggcccacagaagagggagtgcgagacatgcggtcatgggtgagaggtcagtggattccctttgacgcagatgccctcagccagttcctgggtgacccgctagtgttggaggaaggccaggagtgcgagttcggtcaaaggaggaacagggccgatgggttcgacgaggaggccattgcccagctattaagcacaccggggcaggatttcgcccagactgttgcagggaggcgggtgcggatcatgcgcaccagcatgagcaccttgaccctgatgtggatgacattgctgctcagcaatgtcttgcctagtgatcataactccgaccttcctctagcgaagtgtcagctggtgaatgccatcctgacacggatgagcatccatgtggctcagttgattgctgacgccatctatttatttgcaggtatgccacccaccaggcaccctctagacccggataagtctagcagggccctggggttttcggcattgatcacgggcctctgccagtcattcggggttcccgtcaaccctagtaaggtgatccgaccgctgatcacccgggccttcattgagaagtattgcacgcctaggcaggcgcagggtgatgcacctcagtccgcagacgcaccgcaccagctcattaggctgatccagttgggtcactag

SEQ ID NO: 39274 - DNA, 516 bp, Glycine max
  Peptide Sequence Number=SeqID_130959
atgaagcacttcactgacaccctcatcagtgccaacatagaagttatttcctttactacggtaggcctcaaagaagtgccattatccccttgcagtttctacaaaaagagtgtttcaaacctgaactatcaaagaaaggttccacactgtgagttgaatgcagacatcacgaagaagagcggccgccaccgcggtggagctccaattcgccctatagtgagtcgtattacaattcactggccgtcgttttacaacgtcgtgactggggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 39275 - DNA, 240 bp, Glycine max
  Peptide Sequence Number=SeqID_130960
atgatgctcgacatagttctctatacaggcaatggtgcacgcaagatgcttagcaaccatgtcagcttcagtgcagctgctttacgtgcattttcgggagggacttcccctagtaagttgtcgcataactcatcccaatataagaagataggtccagccacaacacgaccatcgactctaatgcctagatgcagtgcaacatctttgagtgtgatggtgcactctccctatggcaggtga

SEQ ID NO: 39276 - DNA, 392 bp, Glycine max
  Peptide Sequence Number=SeqID_130961
tgccctcctcatctgaaaaatatatcaaaggagtgtctggaggagtggtagtcagtcccagaactggtgtggcagggtcctctggaatctccagtaatggagttgatgggtctgctggtatctcatgcactagtcctcctgccttacctgatgtaagctccattggagcttgcaggcctaggatcttcttcatcaatggattcctttgcttcttggaagatgaatggcagcggaatggagaaaggaagagagagaggagacgccacttcaaggagaagatgagtcaagaagaagctcaccaccataggaggccatggataagagcttggaggaagaaggagatgaatgagggaagagggagagaagagcacgaaattttgtgctctaaatga

SEQ ID NO: 39277 - DNA, 543 bp, Glycine max
  Peptide Sequence Number=SeqID_130962
atggtggaagaatttgaagagatcctaggatgtcctctagggggaaggaaaccatacctcttctcaggcgagtgggccccgttcatagatattctcgcactgttgatcttcggaggagtcctatttccgaatgtggatgggttggtggacctagcagcgattgacgcttttcttgcctatcataaccacaagggaaagcccgaggtgaggcatccttgcccactagaaagccaccgttcatgcacagagaaaggaggggcaaattgggaccaactcttagcaaccaaacaaggagcatctgtcaactggttccctcgatggaatgaaggaagaaccggggttcttatttcatgcggaggatttccaaatgttcccttaatggggacgaggggttgcatcagctacaatcccgttcttgctataagacaacttggctaccctatgagaggggcaccactaggggatgagctcgcacctgtcatttcacgaggcttcaataagaccaacatggagacacttcagaaggtccgcaaggcatgggag

SEQ ID NO: 39278 - DNA, 714 bp, Glycine max
  Peptide Sequence Number=SeqID_130963
atgaggggagcaccgacggaagagagcctctcgcctttccttgtgagagatttcggcgcgcaaagtctcaagattgtacaaagagtccacaaggcgtgggaaagcccgttaaggaaagataaagaacttaggggcatccgtaatggcatcatcggtggttatcatgaatgtctaagagttcatacacgagggttagattggctctccaagttgaaaattatcaacgaagagaacttcgaagctccggaagaggatgaagaagtccaagctctaaaatcagagctaggaaaggcaagactcgccaaagaaaagttcaagtcagctgctacaagcatccggaaagagtgtgccgagttacgagaggaaaatgtggctaccgcgaaagcccttgaacaagaaaccaagagggctcacaaggaagagtatggccgagataaattccgaggagctctgtggggcagcaacaatgagctcaagctccggagagaggaaaaagaccagtcacgagtacatggcctgatcttaaaggaagagttagctgcttgctcaagatctaagaggagttttgcccaacacttagaagccacggagcaaagcatgctagctataatagggcagtacaaagaagagttaaagcagtctttgacccatgaacaaaagctagtagaggacttcacacaagcgtacaccgagaaggaagcaagaggagggtga

SEQ ID NO: 39279 - DNA, 204 bp, Glycine max
  Peptide Sequence Number=SeqID_130964
atggagaataagatgaagaacaaggaattaaactccattggagcttgtaggccttggatcttcttcatcaatggagtcctttgcttcttgaagtttgatggtagtagaatggaaaaggagaaagatgattggagacgccacttcaaggacaagatgagtcaagaagaagctcaccaccataggaagacatggataagagcttga

SEQ ID NO: 39280 - DNA, 153 bp, Glycine max
  Peptide Sequence Number=SeqID_130965
atgaaagagatttccttgaatgagctgaatcaaggaatgcggcttcaatctccaaatccaatggagctaagtcccctgctaaagttttacctcgcatacaagaagcaagctactacagagtgtgacaccctctacccctcacatatatactaa

SEQ ID NO: 39281 - DNA, 701 bp, Glycine max
  Peptide Sequence Number=SeqID_130966
atgctttacgacgcccttaccgaactcagtgctagagctagagtaatgggtgaagtagaggagatgcaagagcagatggaggccgacatggaggccattaaagagaaaatggccacaatgatggaggccatgatgagcgtgaagaagataatggaagccaatgcggttgcaattgcctctaccagcgttgttactaaggtgaacccgacgtccccatccggcctcaagcaaatgaatcatccaacctcaaatatggtaggcaaagatttaggaagtacgggcggcccccatgatgtgcaaattcaaaacgagcacgccttcccgtcatatggcttgcctctcaactatacgccacccaatatggcgtacaatcccaataagaatacccatgaaattccccaccacaatctagctgacttcgagccttggctcggatatgccactgaagggcaagcagttggtggtataccctttgaaaacactttggagggccctcagtttcacccacaaccacaaccattgcattttgcggtgggaagagcccctcctgctatggccgaaaagggaaaggcggatcatctaaaggaaaggctcagggccattgaaggaggtgaagattatgcctttgctaacttaaaagagttgttcctagaacccaatatcatcacccctcccaagttcaaggtgctcgaccttgacaa

SEQ ID NO: 39282 - DNA, 582 bp, Glycine max
  Peptide Sequence Number=SeqID_130967
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggttaggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagtga

SEQ ID NO: 39283 - DNA, 413 bp, Glycine max
  Peptide Sequence Number=SeqID_130968
aggatcccccgaatcttgattgggctgaattgtgtgaagaattattgggagtcagaccacaggaaggaggagtcatatttgttgataaaagcagcagcaaagtttccctacgcgccaccgattacaaaataaaatcaatcggaggcatgtgcatcttaatccaaatctgggcatgggaacgatgcacgactttggctccaaagaggactcctcccgtgatccaaaataagccactcgaacacaggtggttgcgacgtggaaatcaacatattgggaatgatgatctgattgtatttcgtcgcaagttggatatcatgaaaagacatgagtttctgtgggagccttacacaacaactgttatgtcatcgttgcctccgatatgtttggttggtagcgtagcgtggtgcgcggtg

SEQ ID NO: 39284 - DNA, 472 bp, Glycine max
  Peptide Sequence Number=SeqID_130969
gaattcgatcattctgcacccttgtatcatccagaggcggtgggcccgatgatacgcggagataccttacggttatccgcacccttttgtcatccagaggcggcgggcccgatgacaagcagagaccaaatttggtcattctgcacccttgtatcatccagaggcgagaccaagtttggtcattctgcacccttgtatcatccagaggcggcgggcccgatgatacgcggagataccttacggttatccgcacccttttgtcatccagaggcggcggagcccgatgacaagcagagaccaaagactgacatagtcttctgcaccttttgttcctccgggaacaacaagtcatttacatgtggaaatttcatggtcgcccgcgactctcgtcaaccgagaggagcgaaattagtgtcatacactgattttcggggacctttgcttgatgacatgcgaccactctttggtcctt

SEQ ID NO: 39285 - DNA, 720 bp, Glycine max
  Peptide Sequence Number=SeqID_130970
atggagagaagtatgatagatgctgtcagtggtggaaccattggagacatgacccctgctgaagccaggaatttaattgagaagatggcttccaactcccagcaatttagtgccagaaatgatgctattgtcattagaggagtacatgaagtagccacgaattcatcttcatcagctgaaactaagaagcttgaaggtaaactagatgccttagttaacctggctgaagcttatgctgcaaacatttacaatagacctcttcaacctcaacagcaaaataagccacaacagaacaagtatgacctctccagcaacaaaccatacgttcctccaccagtccagcagcaacaacaacaacagcagcaacagcaacagccccagaaacaacaaacagttgaggctcctccacaaccttcccttgaagaacttgtgaggcaaatgactatgcaaaacatgcagtttcaacaagagaccagagcctacattcagagcttaactaatcaaatgggacaattggctacacagctaaatcaacaacaatcccagaattctgacagattaccttctcaatctgtccagaatcccaaaaatatgagtgccattacattgaggtcgggaaagcagtgtcaaggacctcaaccagcaacatcttcctcatccgcaaatgaacctgcccaacttcactctactccagaaaaagaatggatgacaaaaatttaa

SEQ ID NO: 39286 - DNA, 1650 bp, Glycine max
  misc_feature (40)..(40): n is a, c, g, or t
  Peptide Sequence Number=SeqID_130971
atgacgctggcagtcactttgctagtaatgtttttctccngatatgaaattgaaatccaagttcatttggattggtataggaatagcagcactagttgtaactcaatcaaagacttcgatttctggatttttcttaacattaagcatcgttactgttgtgtatctgagattgtaaattttatgatacacaacctgactgatgacatgttcacaggacgtggaaagctttggcatagcgtattgattatggctaaatcaaatcttgagcagggggtaggtattgcagtgatgtggggggcggaccgagcatcagaaattgcgcaaagtcaaatatatttggagcagtgggttcaagagctcacctcagcagatggtggttacgttgatttaattgggtcattagggtttgtagctatggttgcgagagtgtttggcccagagaacatgggtaggctctctattgttcaatcagcatcagcaatttttattttcttcgcaacgctgggattagatcactttgtagtacgtgaatttacacgcaaacctgatgaccatgagctcaaatgtagcctattaattacccaaaccttaggttggcttttctatgtcgccgctgtggtaatttattttgtgatcaaagggaatttgcagcatgaaatttacttgatagctaacgttacgttgagcactttttttctgcgcgttatctatctaaaactctacctgcaagcaataaatcaagccaaagtgatcgctgtggcagcaaccacctccagggtctttgcgcttatttacctgctgataggcacttttatgcatttcagttatgacatcatgattgtatatttgcctattcaagcttttattcaaaccgtaatgatgtggtttggttatcgtaaggtagtgaaatcatctgagcagccctttacgtattcattcaagagaatgttcccgcttcttcgcgaggcatttccagttttaattgcaactgcagtttattatggatatagccaagccgatgtacttattgtctcttactttatgaatgaccatgacgtaggtatatatgctgctgcgatgcgcctaataccccaggctgcgtttgttggccatattgctgctattactttttacagttcgataagtgtttcctttgataaggatttctcgctctttttgttgcaaactaagcgagtgattaaactacaaataatgctcgccatgtgtttagtgattattggaagcttgctatccacactgattatttattgtttgtatggcgaaaaatttatgcaaagtgcacaaattttatcggttggcgtatgggcttggctcttcatgtttcctgcagcgctattttcccggctgcttgtgctcacaaaacttgcaaaattcgaattaatgaaagctttaattgtcgccccaatcagcctaagcttgaattttgccctcattccgaaatttggcccgattgctgcttcattcgtgactgtgatgacatatttcatgggtgactttctagtttacctacttttcaaaaaaaccagattcatgttttttattggcgtcacggcattcaaagaggttttgttacatccagtcatttctgctagagaaagttttaagttaattactgaaaaacacgtttaa

SEQ ID NO: 39287 - DNA, 273 bp, Glycine max
  Peptide Sequence Number=SeqID_130972
atgaagaacggtggaaaatcttcaagaaatctctcacggaaacgtctcaaaagcgttacggaagggcctcagcttggattttcttcacggaaacaatctttgtcactaattttaagtgaatctcaaatccaggagggggaaaagagggaggtggttgccactcagctgcccaggcgagctgggttccttccaccagaaggcaccgccttctgttggaacatcctggaaggcccaagtgggtctgattgctatttgcacacccctgtttactaa

SEQ ID NO: 39288 - DNA, 402 bp, Glycine max
  Peptide Sequence Number=SeqID_130973
atgggtgcaaagatcacagtggcgaaatattgggcagagttaaaaatcgccaccgccgttcccctctcctgcgccgggaaccaggccgcgacaatacggctgttccccgggaaggaaggcgcttctgccagacctaccaggaagcgcagcgaaaagagcgcgacgataatgccaaaaccgttgaaaacatcgacgaagccctgcaaaagggcccatgagaaacgcggagaaaacgtaacccatgcccaccggatcaaggccgatatcttttgccatttcagagccggcaatcgacagcgtggcgcggtcgccatagttaaaggatgtgacgataaacagcatcaccactatccaatagcgagcattggtgcgcttctcagcgctgctcgctgcgtgacttaa

SEQ ID NO: 39289 - DNA, 399 bp, Glycine max
  Peptide Sequence Number=SeqID_130974
atggagtgcctagagggagtttgggagaccctcgaaggcaatgcgaggtgccgatttcgtggcccgatccgactcacagctacttcgttggtacatccagaggaaccagcacgcacgcttcagcacactgtggaatggatattacctacgcctactccatatcgtctagtggagctaatccaagtgatcgaggtgacgtcatctgaggaagaccctgaggaggatccagaggagctacctcctgagcctgttgtggatgctcttgactttctagagggtgatgaggacccattccctgaggtggattctcccaaggacgtcatgtcggcatctgaggcagactctatggaggagagcgaccctggagagatgacgactagtggaggctctccatcatag

SEQ ID NO: 39290 - DNA, 120 bp, Glycine max
  Peptide Sequence Number=SeqID_130975
atggcaactccccctctccccccccccccccccacggtgattaacctgagtcttaagggagttcccaaaccagggaaaaaccccccaagaccaattttcccccccctgggaaaatggtga

SEQ ID NO: 39291 - DNA, 206 bp, Glycine max
  Peptide Sequence Number=SeqID_130976
gacgaagcccaactctctttgaggtttcgcttgtaatgtggtttcctggcagttttcccttcaccagttatcccaatttcgtgaatattaatcagtgcacgcttcgtgttcgattaattgcctctgagcctaacttgcgttcatgcttaatggacgaagggctaactggttcaggtgcaggtgctgctactggtggaggcacttga

SEQ ID NO: 39292 - DNA, 464 bp, Glycine max
  Peptide Sequence Number=SeqID_130977
atgaaggccgacatggaggccattaaagagaaaatggccacaatgatggaggccatgatgagcgtgaagaagataatggaagccaatgcggttgcaattgccgctaccagcgttgttgctaaggtgaacttgacgtccccatccggcatcaatgaatcatccaacctcaaatatgccgacttcgagccttggctcggatatgccactgaagggcaagcagttggtggtatacccctacaaaaccctttggagggccctcagtatcacccacaactacacctcttgcattccatgacaagtaaaaaccctcatgctatggcagaaatgggaaagctagatcatctagaggaaaggctcagggccattgaaggaggtgaagattattcctttgctaacctagaagagttgttcccaatacccaatatcatcaccccttccaagttcaaggtgctggactttgacaa

SEQ ID NO: 39293 - DNA, 96 bp, Glycine max
  Peptide Sequence Number=SeqID_130978
atggcaaggagcagaatcgtctcaagccacggtcagaagtcaagactagtcaatgatcaaccaaggtacttagggatggaggcaaatggaggatag

SEQ ID NO: 39294 - DNA, 447 bp, Glycine max
  Peptide Sequence Number=SeqID_130979
atggctcacgaaatggttctccgaattgaaagtggatgctctggatctcgaaatggaagctgctctactacctttgctgctagaggatttggaactaggccttatgctgctggtggaggtagtggtggggaagctggttctagatctacttttgctgaatcgacagaatctactgctcggtcgactgactcaaccatgtctttcttcattgactgctttcatcaacagaatcgccggaatcaaccggctctactgaagcaactactcactctggatctgctactggaagatatgaatataggcataggtaaagatacattggttattgatatggatgagactgatctccctaacgcgctacaccatcactacactatagataggtatataggcagcgggaacactggtagaacgttcccatcagcaacaacggaagggagcctctaa

SEQ ID NO: 39295 - DNA, 330 bp, Glycine max
  Peptide Sequence Number=SeqID_130980
atgtcaagaaggaatcaagaacaattcaagactcaagaggaaaagttgaagaccacttcaagattcaagaagaaggatgaattcaagaatcaagattcaaggatcaagcttcaagaatcaagatcaagattcaagattcaagactcaagaatcaagagaagacttaatcaagataaagggtacttctacttgggtttgactgagaacaagagagggtacatctcttgtggatcagttctagtggagggtacatccactaggttcaaagagaacaagggagggtacatcccttgtggatctttgcttctaaaaggatttttacaaggttga

SEQ ID NO: 39296 - DNA, 171 bp, Glycine max
  Peptide Sequence Number=SeqID_130981
atgactgagaacaagagagggtacatctcttgtggatcagttctagtggagggtacatccactagggtttcaaagagaacaagggaggaggcttgtgtggaatcgatgagcacggacaaaaaggaatcttcaagtgacgtgacgaggaatccgcggggtagctcacgatag

SEQ ID NO: 39297 - DNA, 285 bp, Glycine max
  Peptide Sequence Number=SeqID_130982
atgacaactaacactgagtgcatgatcatatcaccaggcatcctgaaccacattattttgctaaaggcatcaaaagcggcggacgcaccaaaaggctatcttgcagtctatgtcggagagaaattgaagcggtttgtgattcccgtatcatacttgaaccaaccttcattccaggacttgttgagtcaagctgaggaagagtttggatatgatcatcccatgggtggcctcacaattccttgcagtgaagatgtcttccaatgtataacttcttgcttgaattga

SEQ ID NO: 39298 - DNA, 246 bp, Glycine max
  Peptide Sequence Number=SeqID_130983
atgtttgaagttgaggaggcttacgatcctatgtctcaacgaggtggacaaaagtgcatcaacttttatcaatacataaatgttgtatacacaaatgatcacatcttacgtgcttactctccatcgtggtggcccttggggaatgaggatgcgattcctccatctgatgcgtcgtggacacttgtgcctgatccaagttttaatcgtatgaaaggaagacccaagatcaacacggctaaggaatga

SEQ ID NO: 39299 - DNA, 126 bp, Glycine max
  Peptide Sequence Number=SeqID_130984
atgaatgatgctctcctacaacctaagacaagctactttcaattaaaacatggccttcatcatcttcaaactcaggcattcattccatattcagagattcatgcaaaaaccattacttactactag

SEQ ID NO: 39300 - DNA, 180 bp, Glycine max
  Peptide Sequence Number=SeqID_130985
atgcatatctatgaagataatgacattcctgtaatattgggaaggccattcatgttaactgcgagctgcatagttgatatggggagaaaaaagctggagttggactttgaagatcagaaaattgattttgatttatttgttgaagacaagcctgctccagaacaaaatgtttgcttacag

SEQ ID NO: 39301 - DNA, 471 bp, Glycine max
  Peptide Sequence Number=SeqID_130986
atgagaacctgtgacgtacctaaacaggcgagctcctggcagtcaaccaataaaagaacaaagtccacaaagcaaggaggcttgtgtggcggctggccagctatgaatcttgagtggtatctggaatttggccctggtaatcgattaccaagggtgccgattccgtggcacgattcgactcactgctacttcattagtacatccggaggaacccgcacgcatgcttcagtagcctgtggagtggatactacctacacctactccatatcgactagtggagccaatcctgaagaggactcagaggagttacctcctgagcctgctgtggatactcttgactttccaaaggatgatgaggacccactccctgatgtggattctccagaggatatcatgtcagcatctgaggcagactctacagaggagagcggccctggagggacagcgaatagtgaagactcttcttcatag

SEQ ID NO: 39302 - DNA, 813 bp, Glycine max
  Peptide Sequence Number=SeqID_130987
atggagtgtgcatgcgcttatctgctgaacggttggggcggaaagctccacgacgaactcgtaccttatatctccctgtccgacccggatatcttgtgcctgcaggaagtggtgcatacgcccgctgcccaagaggattggttgacctatcgtgatcacggcatcgagcttccgcagagagcgaatttcctccgcgatgtcgccgatgccctgccggatcatgtagcgatattctgccccgcggcacagggtgatctctggcacggtacgactagatacttttcccaatggggactggccacattcgttcgcaagtccatcaccatcgttgcccaggcacagggcttcgtccatgggaccttttctgcggacggatatggcgatcatccacggtcacgcaccggccatgccatcagggttttcgactttgccaccggacagccggctgtcattgcccatatgcatgggctacgcgacctcgacggcaaacacgataccgccgcccgcttggcgcaggcaaaacgacttgtgaacctcgtcaagaacattgccgagaatggcgaccgggtgatcgtttgcggtgattttaatgtcctgcccgacagcgaaacctttaccgtgttgaatgaactcaatcttgtcgagctcgtcacgacccgcggtttcacagataccagaacctcacattacgccaagcagaacagatatgccgactacctgcttgtcaatccggctgtgaaagttgatcatttcgacgtcgttaggcagcccgaagtctcggatcattgcccgttgctgcttgaattcagctga

SEQ ID NO: 39303 - DNA, 578 bp, Glycine max
  Peptide Sequence Number=SeqID_130988
atggaaggaaggaaaagaaggagtccttttctcatgtggaagatacccaaacattccgctggtaggaacgagggggatttcggcgcacaaaattccaagactatacaaagaatccataaggcatgggaaaccccgttaaggaaagatcaagagcttagaggcattcgtaatggcctcattggtgggtaccacgaatggctgaaagttcatatacgaggtttagattggctcgccaagttaaaagtcgtcagcgaagagagttttgaagcatcggaagaggacgaagaagtccaagctctcaaaagcgagttaggaaaggcaaaacttgccaaggagaagttcaagttgaccgctacacacgttcggaaggagtgtgccgggttacgggaagagaatgcaattaccgcaagagcccttgaacaagagaccaagagggctcgcaaggaagagtatggccggaacaaatttcgcggagctctatggggtagcaatagtgaactcaagttgcgaagggaagaaagagaccaatcgcgagcacatagcatggttctgaaagaggagttaattgcttgttcgag

SEQ ID NO: 39304 - DNA, 435 bp, Glycine max
  Peptide Sequence Number=SeqID_130989
atgacccaagacctggtagcccgcggagacaccttacggttatccgcacctcatcattcagtgaccccaagtgtgattgacgagcagaggccaatgtggtcatctacgcccttttcggagatgtctgagttcctcattggaggatacgtaggagcaagagccttgttttgtcggccgccccacaatctctgtcatactgaccctgagacacagtcgtgttcgatggcacgtcagagacaaattatggtcattctgcacccttttgtcatccagaggcggcgggcccgatgcacatgcggagacaaattatggtcattccgcacaccttttgccattcagacacagtcgtgtccgatggcacgcagagacaaattatggtcattctgcgcccttttgtcatccagaggcggcgggcccgatgacatgcggagataa

SEQ ID NO: 39305 - DNA, 265 bp, Glycine max
  Peptide Sequence Number=SeqID_130990
atggggatcgcgcccgcaagacatccagtggacccgaagaagtccaacagggtcctagggtttccagctctaattacgggcctctgtcatttctacggagtgcccgtcgaccccagcaagttcatcaggcccctattaatcgggcttccatcaagaaacacaccgccaccacctctagagttcacctcagctcatccgcaaaaaggattagagcgttgcctacgacacatggccgaccagcaggctaccaagtccaaagccaaag

SEQ ID NO: 39306 - DNA, 75 bp, Glycine max
  Peptide Sequence Number=SeqID_130991
atggccagatgccgagccggatccagaggcaaagaccaatcaaggtacttagggacggacgaaagtagaggctag

SEQ ID NO: 39307 - DNA, 621 bp, Glycine max
  Peptide Sequence Number=SeqID_130992
atgctcaagagctggatatcaggtgattgtcaatattatgatgctgtaatgccatatctgaaagctatattggttaatgcaaccgacaagtctaaccatatgctttgtgctacttccatggagtgtataagtttagttggaatggttgttgggaacgagaagtttagggctgatgctaaccaggttatggaagttcttatgtcccttcaagtatctcaaatggagacaaatgatccaacaacaataggttatgggctagactctgcaaatgtctgggacaagattttcttccttacatggagtttgtcatgtctccactacttcaatcaaccctttgttagtgcaacaaagaagcaaaagtatgataaaatatgtgagaagaaagtatcaactccgattgaggtatcatgcaaatctcatcatgtagagtttgcttcatactttcattactgtcaaggtatagtgttcccattttttgtgatgactaatcatcacacttggttgttgatttttctgtttgctgaatctcttgatcacatcacagggtgtcctgctctatgggccatatatgaaaaattggtttctatcaaaatggatctttccattatctgtgaggattag

SEQ ID NO: 39308 - DNA, 138 bp, Glycine max
  Peptide Sequence Number=SeqID_130993
atggcgattttagggtgcgacataaagcgaaaagcaaacagaatggagaaggagaaagatgattggagacgccacttcaaggagaagatgagtctagaagaagctcaccaccataggaagccatggataagagcttga

SEQ ID NO: 39309 - DNA, 192 bp, Glycine max
  Peptide Sequence Number=SeqID_130994
atggatcctaaggcaaaccatgagagtctcacaacttccttgaaaaaagaatgtgccatcttgctaaacctatccaccaccacaaagatagagtctacacctctttggcttctaggaagcccaaggacaaagtccatactaatgtctacccaaggtgcagatgggataggtaagggtgtgtatagcccatga

SEQ ID NO: 39310 - DNA, 792 bp, Glycine max
  Peptide Sequence Number=SeqID_130995
atggccccgaggaaacttgcctcaaagagatccaggaaggataaagcggccgaaggaactagttccgctcccgagtatgataatcaccgctttaggagcgctgaacaccagcagcgcttcgaggccatcaagggatggtcatttctccgggagcgacgcattcagctcagggacgacgagtataccgatttccaggaagagatagttcgccggcggtgggcatcactggtcacccccatggccaagttcgatccagacatagtcctcgaattttatgccaatgcttggcctatggaggagggcgtgcgagatatgagggtcaggagtgcgagtatggccagaggaggaaccggtccgatgggttcgatgaggaggccattgcccatttgttatgtataccggggcaggattttgcctggactgctgccgggagacaggcaccctctggacccggataagtccaacagggccctgggttttcccgccttgatcacaggactctgccagtcgttcggagtccctgtcgcacctagcaaggccgcagacgcgccaccacctcatcaggccggtccggccggatcgtttgatacgaagcagtatttgcggcatttggttcgccaacaggcggccaaccaccgggcacatgtacagacccatgattgtctttatcagatgagtctcagcctgcagagccagggctttacttcttttccgtgccctactctggaccagttcagagcagaggtcgcatggcctggagattggcctgaggcccgggcaggagaggcacca

SEQ ID NO: 39311 - DNA, 501 bp, Glycine max
  Peptide Sequence Number=SeqID_130996
atgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgatatgcggagataccttacggttatccgcacccttttgtcatccagaggcggcgggcccgatgacaagcagagaccaaaggcggcgggcccgatgatacgcggagataccttacggttatccgcacccttttgtcatccagaggcggcgggcccgatgacaagcagagaccaaatttggtcattctgcacccttgtatcatccagaggcggcgggcccgatgatacgcggaaatacccgagtggttatccgtataaacattcttttgctatctgtaagacagaacgcttgatagcctgcagagactga

SEQ ID NO: 39312 - DNA, 282 bp, Glycine max
  Peptide Sequence Number=SeqID_130997
atgtcaggatttacacgcgattctcctcaaatttcagccagcccgcatcaattagaccttgcaccttacgcttcagagccctacaatgctcaatggaacgccccggggcttctccgtgacaagcacacgttgcgttcgagtcgtattctcggagaaatggaggttgatgaaccttggctagggctttctcgctgcaaaattcatttcttggttggtgtttttggttttgctaaagggatggcctttgtggataactgggtggtgggtaaggagaagggttga

SEQ ID NO: 39313 - DNA, 408 bp, Glycine max
  Peptide Sequence Number=SeqID_130998
atggtgaaagttggaacctcttacgtgccgatcaacgtctcattttcgccaaaagttggcccagggcttcccggtatcaacagggacaccaggatttatttattctgcgaaagtgatcttccgtcacaggtgctccagtggcttctgtttctatcagctgtccctccctgttcagctactgacgggggtgggtgcgtaacggcaaaaagcacccgccggacatcagcgctggcaagtgtagcggtcaccgctgcgcgtaaccacccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaa

SEQ ID NO: 39314 - DNA, 354 bp, Glycine max
  Peptide Sequence Number=SeqID_130999
atggcatcgttcagccagatgcagtcccagatgcaatctcagggacttgcactacctcctgagcctctggttggtccctcaggaaacgatcctgagacgggtgacccagataggtgcggcttgtacatcgaagcaaatcctaaccgcctggttgccctggggagagtttatgagggatccattgctgttcataacactcctttgttgcttggccaagtaaaggggggtgtggaggaggttaaagatgcagatgctccacttcctgtacccactgatgaggtttccttagtggggcaggcaattgacaccttccttgcttggccgacacatttggtcaagtctttatcacagcag

SEQ ID NO: 39315 - DNA, 537 bp, Glycine max
  Peptide Sequence Number=SeqID_131000
atgactcaggatgttcctgacatgactgaggatgtccctgatatggctaaggatgcacctgagatgactgcggacgtacagggtgatgatggtgctgaggggtcatatgctgatggattcccaggtgggccacgtgacccatcagtgctgacatcatttgcggaccatgtagcacatgccgtttggagtggacaggaacgtcctgatttgaagttggtgtcacataggaggaaggtgacattgattgggaggccagtgcctgagattaaaggactggttagtgccagtggattaagtccattgattgattgttcaattgttactggcgatcctggacttatatccgcatttgtggagaggtggcacagcgagaccagcaccttccaccttccggtaggagagttgacgatcacattggatgatgtgtcgttactccttcatttgcctatcactggcgcgttgcacagctttcatgctctttctacggaggagacgatatttttgctgaccgagttgcttgaggtgtctgccgaggag

SEQ ID NO: 39316 - DNA, 387 bp, Glycine max
  Peptide Sequence Number=SeqID_131001
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagtgttttccccagtcacgacgttgtaaaacgacggccagtgaattgtaatacgactcactatagggcgaattggagctccaccgcggtggcggccgctctagaactagtggatcccccgggctgcaggaattcgatttaa

SEQ ID NO: 39317 - DNA, 390 bp, Glycine max
  Peptide Sequence Number=SeqID_131002
atgtgtcctcctccagcaaaggtttacacaaagggggcaccgaagaaagctatgagcaggaacccaagcaattcgtcggtgaggcgtactgcatcatcctctgagcaaccgaatcgaagaacgataatgcccatgttggaccagtttcaaccatttatgcacgacttcattgataagattgttgatgtcaaagttgatggtaactgtggatatcagtcggttgccggtttattaggtatgggtcaagactcttggtcggtgaagactatatcaagctctttggtggcatggagagattttaggaattttgaggaattaaggatgtcactacttgttgatgggttaaccaaggtgactacagataagtggatggatataacggacatgtga

SEQ ID NO: 39318 - DNA, 750 bp, Glycine max
  Peptide Sequence Number=SeqID_131003
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatgatcaagcttatcgataccgtcgacctcgagggggggcccggtaccagcttttgttccctttagtgagggttaatttcgagcttggcgtaatcatggtcatagctgtttccttcgggaaacctgtcgtggcagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 39319 - DNA, 354 bp, Glycine max
  Peptide Sequence Number=SeqID_131004
atggcttcagcaactctcagaacaaaaagatctagttacgcactcccaggatcctctgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 39320 - DNA, 1105 bp, Glycine max
  Peptide Sequence Number=SeqID_131005
atgggacacgtttgcccgctagaaggccaccactcatgcaccgagaaaaaagaggcaaactgggaccgactcttagcaagcaaagaaggagcgtctatcaattggttcccccgatggaaggaaggaagaattgagattcttatttcgtgcgggaaatttccaaatgttcccttgatggggacgaggggttgcatcaattacaatcccgtcctcgccataagacaacttggttaccctatgaaaggggcaccatcagaggaaggcctcacaccttttattacacaaggtttcaatagcaccaatgcgggggtgcttcagagggtccacaaggcatgggaaatgtcgcaaaggaaggacaaggaacttaggagaagtagcaacaggcccatcgacggttaccataggtggttgaaagcctacgcacaagatctggattggctcccgggtttgaggaccactaaggggatggagggtgaagcttcgaaagaagatgaagaggtacaggccctcaagacagagcttgagaaagcccaaacagtcaaagaaaagttaaagtcagcagttgttaggatccgaaaagagaacgccgaactgagagacgtcaatatagccaccactaaggccttggagcaagagaccaagaaggcccgtaaggaagaacatggccggaacaaattccgaggggctctgtggggcagtaacagcgagcttaagctccaaagagaagaaagggaccaatcccgagtagatggcttgattctgaaggacgaattgaaggcttgcctaaggtcaaaaaggagtttgtctcagcggttatgcgagaccgaaacaaacatgttagccatcatcaacaagtaccaagaagaattaaacttagccaccgtccacgagcacaaagtggcggacaaatacgcccaagtgtacacggaaaaggaggctagaggaagggtgattgactcgttacatcaagaagcaacgatgtggatggaccggtttgcacttactttgaacgggagtcaagaatttccccgattgctggcaaaggccaaagcaatggcagacgcctactccgcccccgaggagaaccacgggctcctcagctatt

SEQ ID NO: 39321 - DNA, 299 bp, Glycine max
  Peptide Sequence Number=SeqID_131006
atggcaacaactgatctcgatgtattgctggttggtggcggcattatgagcgccacgctggcagttctgctacatcggctagatccaactctgcatgtttgcatggtggaacaattggaagaggtcgcccttgaaagctcagatgcattgaataatgcagggacgggacacgccggttattgcgaactcaattacaccccccaagccaaaaatggggatatccagatccgtcgcgcactggaaatcaatgccgcttttgaaatctctttgcaatgctggtcaacggctggcaaaagaag

SEQ ID NO: 39322 - DNA, 237 bp, Glycine max
  Peptide Sequence Number=SeqID_131007
gagcttaaatccttgtactttgttggttcccaaaataggtattatgaggcaccaaatccctatgatagtgcaccaatcattgagtgggtgaggaaccatgttccctcatgggaagatgcccatgaaaatggtgttgatggaagaagcccagagtttcaagaacctctggatttgaggtcaaagccttttcaagggggagagaatgatgcaatcctaccccacaagggtattggatag

SEQ ID NO: 39323 - DNA, 443 bp, Glycine max
  Peptide Sequence Number=SeqID_131008
ttcctgggccatcccctgatattggaaggcgaccaactgtgcaagcacatccagagagggaggctatcacgcatctactatgcataccggggcaagatttcacccgtgccgctgcaaaaagacgagtgcggatcatgcgcaccaacatgaccactcttacatggatatggatgacgtcgctatttagcaacattctgcctagcgaccacaatgccaatctccccctacagatgtatcagttgggatcgcgcctacaagacgcccagtggacccgaagaagtccaacagggccctggggtttccagctctggtggcgggcctctgtcagtcctacagggtgcccattcccccagcgaggaatcgcacccacaaagacactcagtggacccggagaagtccaacagggccctggggtttccaactctggttacgggcctctatag

SEQ ID NO: 39324 - DNA, 864 bp, Glycine max
  Peptide Sequence Number=SeqID_131009
ttggaactcttacgtgccgatcaacgtctcatttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggacatggatgaagctggaagccattatctccagcaaactaatacaggaatagaaaaccaaacaccacatgttctaacttataagtgggagatgaacaatgagaacacatggacacagggaggggaacaacacagtggggcctatcaggggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 39325 - DNA, 288 bp, Glycine max
  Peptide Sequence Number=SeqID_131010
atgacacgcaaaccgaggcaggattttagcgtttcaaagccccacattttcaaaagctctctctccctctccctcacgttgctttttctttctccttcattctccattgaagctccaaacaaagctccaacctttggccatcatttctgctccaaatcacgaaaggagggcattttcggagtcgtgaagcgcatctctatgtgtgggacttcgaaatttcaggtgaagggtagagttaacctagggttagaaggtgagaatatgttgttgtgggtggaaaaagagtga

SEQ ID NO: 39326 - DNA, 547 bp, Glycine max
  Peptide Sequence Number=SeqID_131011
atggatgccaagcacctcacaaggaccaaagaatggtcgcatgtcatcaagcaaaggtccccggacgaaaatcagtgtatgacactaatttcgctcctctcggttgacgagagtcgcgggaacaaaaggtgcagaagactatgtcagtctctgcatgctatcaagccgttctgtcttacagatagcaaaagaatgtttatacggataaccgtactcgggtatttccgcgtatcatcgggcccgccgcctctggatgatacaagggtgcagaatgaccaaatttggtctctgcttgtcatcggacccgccgcctctgggatgacaaaaggaatgaccaaacttggtctctgcttgtcatcgggcccgccgcctctggatgacaaaagggtgcggataaccgtaagaatgaccaaacttggtctgtgcttgtcatcgggcccgccgcctctggatgacaaaaggggtcagtatgacaaagattatggggcggccgacaaaagcaaagctcttgctcctacgtatcctccaatgaggaactcagacctac

SEQ ID NO: 39327 - DNA, 189 bp, Glycine max
  Peptide Sequence Number=SeqID_131012
atggcagaaatcagccaaggtaagacgatgaccggtcacgattggtcgcatatcatttggcttttacttgataggatcgcgaccgaccgagcgccaccccttcctggcgctaaacaagtagagaacgtcgctgcaaggcagcccagtatcctttgcgttcgcagtttcttttactattgtttgttttaa

SEQ ID NO: 39328 - DNA, 246 bp, Glycine max
  Peptide Sequence Number=SeqID_131013
atgggtagtgggagatcgaggcgacggtgttaccagctaagacaagaaggagggcttcgaaccattgggcgattcgagctggtgtatgttcgagtcgaagtcaaggcagcaagatttctggacttagcacaatttctgacaaaatttcacaaaatcagttcgacttcgagcaatgtggataaccgttctaaggagcagttatgtgcatataaggtgtacgtagcaggacacttggcattaggatag

SEQ ID NO: 39329 - DNA, 348 bp, Glycine max
  Peptide Sequence Number=SeqID_131014
atgctaagcgtagcaggtgcctttagccaggttaagcgtgtgactagcgctaagcccgaatccacttacccccgcaaagcgcgaagaattacgggtacacactttgatgtaagctccattggagcttgtaggcctaggatcttcttcatcaatggattcctttgcttcttggaagatgaatggcagtggaatggagaaaggaagagaggaaggagacgccacttcaaggaaaagatgagtctagaagaagctcaccaccataggaggccatggataagagcttggaggaagaaggagatgaatgaagggagaggaagaaaagagcacgaaattttgtgctctaaatga

SEQ ID NO: 39330 - DNA, 141 bp, Glycine max
  Peptide Sequence Number=SeqID_131015
atggctactctaatgactactgcttcctatctgggtaaagatgaaaccgatcagtcaatagacataaagaaatatagaggtgtgcaagatttcaagcaaatcccaaagaatctcaccttagtgcagttaagagaatcatga

SEQ ID NO: 39331 - DNA, 7359 bp, Glycine max
  Peptide Sequence Number=SeqID_131016
atggcggccaattccggcaccaaatacgtctcagtgaatctgaacaagtcctatggccagcattcctccgccttcggatccgcccggacgccgcgccctgccgccggagccgccgcagctccgtcgtcgtcgcggccccgcagctcgcacaaggccgggcccaagctttccgttccgccccccttgaaccttccttcgctgcggaaagagcatgagcggttcgattcgctgggatcgggaggtgggcccgccggcccgggtggttccggaaccggggccaggcccagctcctccggtttgggctggaccaagcccatcgcagaggatgtgtcgcggccagtcgttaaaccggccgctgctgcggctgctgtgccggtttcgtctgccgttttgagaggagaggattttccatctctgcgtgccaccttggcgcctgggcctggcccaaatcagaagatacaggagaatcagaattcgattcagaatcagaatctgaatcagaagcagaaacattctctgggtgatgagaatgtgtttgtggaggagaaggagggttctttggttactgatcagtttagtgttcctcgcagagtgaatgtggttggtggtggtgatggtggtcgcggttcgcgggtggtgcacccgaagtatgggggtggtcttgggaggaagcaggaggagtatttccctggtcctctgccgctggttcggttgaacccacggtcggattgggccgatgatgagcgtgacactggttacagtttgagcagggagggcagggatcatggttttcggggggaggctttttgggatgttgatatgcctagggttggtggtttgcctcataagcatgaccagaggggacaattgaggggcaatgaagttggaaaggttatgaacagtgaagtggaggcttatgatagaatggggccggaggggaattcttggaggagttcgaatttgtcctttcccaaggatgctggaaatgagagaaatggtgttggtgttggtgtgaggccgtcgagtgggagtagggatgtggggaaggatagtaacaagtatgttccgtcaccatttagagatgaagatgctggaaagagggatggtcagggtgggaaacagcagccttggaataatgtggtagaaccatatggtgatcggaatcatgatcaactcaacaggagtagagctgattctgtccagagctcggtgtccagaacagcttttttgatgggtggtaaggggctgcctgttaatgatcctctgcttaattttggtagagagaagtgggccttgccaaagagtgaaaaaggtttcttggaggatccgtttatgaaagattttggaggttctggttttgatgggagggatttgttgggtggtcttgttggggtggtcaagaaaaagaaggatgtgctgaagcaaactgatttccatgatcctgtgagagaatcctttgaggcagagcttgaaagggttcagaggatgcaagaacaggagcgacagcgaatcattgaggagcaagaaagggcattggagttggctcgcagagaagaggaggaaagattaaggcaggctagagaacaggaagagaggcagaggagattggaagaagaagcaagagaggcagcatggagagctgagcaagagaggattgaagctttgcggaaggctgaagaacagaggttagctagggaagaagagaaacagaggatcgttttagaagaagagaggaggaaacaagctgctaagcaaaagcttttggaattggagcaaaggattgctagaaggcaggctgaggtatccaaaagtggcagtaatgctccagttgttgtggatgagaaaatgcctgcaatattgaatgaaaaagaagcatcaagggctacagatgtgggtgactgggaggatagtgaaagaatggttgacaggatattgacttcagcatcttctgattcgtcaagtgtgaatagggcattggagatgggctctaggtctcacttctctagagatttatcttccacctttgtggatcgaggaaaaccagttaattcatggagaagagatggatatgagaattggaacagctcagcattttatccacaagaccaggataatagtcacaacagtccccgaagagatttatcaattggtggaaagccatttatgaggaaagactataatgctggtgctggatttgtgtcttcaaggccttatcataaaggagaaatttcagagcctcatttagatgaatatgctcatgtaaaaccacagaggtggaaccaatcagcagatggagatcatcttagcagaaatacagagattgattctgattttcatgaaaattattttgaaagatttggtgatggtagaacgcagggtcattcccgtggcaatccatgtcctccattccctgagcgtacttatccaaattctgaatcagagggaccctatgccttggggaggtcgtcacggtattctgtcaggcagcctcgagtacttcctcctccttcactaggttctgttcacagaacttacaaaaatgaaaatgagcaccctggcccttcttctttcctagaaaatgagatgcattataatcaggcaaccaggagtgactctacccttccaactggttatgacaatgggaaccgtggacaacctgaagtagtggatgcccggcaagagactacagagaatgaggaccataaagtggaaatcacgccgaggtgtgattctcagtcttcactctctgtttcaaaccctccaagttctccaacacatctatatgatgaagatgacttggatgactctggagattctcctacaatattgacttctgaaggaagcaaaaatggccccctcacagctccagacaatgaatccattgcaacacctgctggaaatgagaacgtagttactccatgtcctgtctctagtggggatgatgatgaatggactactgagaataatgagcagttccaggaacaagaggaatatgatgaagatgaagattatcaggaagaagatgaagtgcatgaaggagatgatcatgctcaactcaaccaagattttgaagatatgcatttgcaggagaaaggattgccccacttgatggataaccttgtattaggatttgatgagggtgtacaggttgggatgcctaatgaagagtttgaaaggacattgaaagatgaagaaacgacatttatggcaccacaggcttcagaagaatgtgtatcttatgataatgcacgtgataatggcaaggccctccaacctgttaatgatacctctcaagtgaatcttaacagcacttccactgtgttccaggaatcagagaagcctgctcaagatttggtcattcagcctagtaattctctttcccctgtggtgtctgagagtttagttaatgaggaagcatctaatggcctgttgacccaacatagtacaacaccgagtccagttactgttgcccctcactactcatcttctaatgctccaagtcaagctgaggtacccattaagcttcaatttggtctgttttctggtccatctttgataccatcacccgtacctgccatacagattggttctatacagatgccactgcatctgcatccacaggttggtgcacccctctcacacatgcatccatcgcagcctcctttgtttcaatttggccagctaagatatacatctcccatatcacaagctataatgcctctgggtcctcaatccatgtcatttgttcagcctaatataccatctagtttctcttacagtcataaccctggaggtcaaatgccagttcaaactgctccagaaacttctgattcctttatgaaaaatgagatcaggcatcattctgttgacagccaaccaggtaattcaagaaacttaccacaaagttcactgccaagtgaagatgcagaaaatattgctggaataaagggtcgatttgaggctgctcatgatcctaataatagcagtaggacttctagtttccaattggataagaaggggaatcaaaatgtagttggtaagagcagcaatatttcatccagtgcaaaagaatcagaagttcagcctgtcactagagatgcatcacttcatccagtttcaaaagagaattttatggagtcaaaaacacaattttgtggcaggggaaagagatatgccgttactgtaaaaaattcaaacccaagatcatcaggtccagctacaagggttaatcgcccagactctggaggatttatgaggaggcctcgccggaatatgcagcgcactgagtttcgagttcgggaaagtgctgaaaagaggcagtctactagttctgttttgaccgatcagtttgggttggataataggtcaaatatcaatgggaggggagcaggtgtatctggaaggactggacataggaaggctatggccaataaattgggaaaacagacagtagagtcagctacagaaaattcacaaggaatggattctggaagcagaggtgaaaaagttgatggaaaagaatcagcaaagactcagggcttctcacattctggacagagtaatctcaaaaggaatttgtgttctgaggaagatgttgatgctccattgcaaagtggaattatacgtgtgtttgagcaacctggaattgaagttcctagtgatgaagatgactttatagaagtaaggtcaaagaggcaaatgttaaatgatcgtcgagaacagagagagaaagaaatcaaggccaagtctcgggttgcaaaggcgcaacggagaccccgttccggttcgcaaagtgttgtggcagtggccaattctaccaaaggatccataactgcagttgaagtggcaaacagtatccatgccgattttgttgctgctgatgtgcggggaatgactaagatggatgcctcatctggatttaattcaagtttactgtcccaagcattacctccgataggcacacctcctttgaaaattgatgcccagcccgatttaagatcacagatgagcaggtcacataagacaagtctcccagcagtttctggtggtgaaaaggaccctgggtctggtgtgatatttgaaagcaagaacaaggttctagataatgttcaggcatctctgggctcttggggtaatgcgcaaattagtcaacaggtaatggcacttacacagacacaacttgatgaggctatgaagcctcaacagtttgattcacaggtttctgttggcaatatgactggtgctgttaatgaacccagtttgccaacatcatccattttgacaaaggagaaaatcttttcatctgcttccagcccaattaattccttgcttgctggagagaaaattcattgccttactgatggaggatattgcactttgtattcaggggcagtaacatctccaactgttcttccatccaacagccgtgttgtgtctcatggcattggtccacctcgatcatctagatcagacatgcaaatgtcccacaatcttactggatctgacaatgactgcagccttttctttgataaagagaaacatggtaatgaaactcatggtcacttagaagattgtgatgcggaagccgaagccgaagcagctgcttcagctgttgctgttgctgccattagtagtgacgagattgttggaaatggattgggtacttgttctgtccctgcttcagatggtaaaagttttgtagctgcagatattgatagggtagtagcaggagtaggttgtgagcagcaattagctaatcaatctagatccgaggagcctcttagcgtatctcttccagcagacttatctgttgagactctgccaatttccttgtggcctcccttaccaagtacacaaaattcttcgggtcaaatgatttcacattttccttctgtccctcctcattttccttcaggccctccttctcattttcctttctatgaaatgaatcctatgatgggtggtcctgtctttgcttatggacctcatgatgagtctgcatctacaacacagtcacagcctcaaaaaagtactacatctgcatcaaggccaattgggagctggcaacagtgccattctggtgtggaatctttttatggacctccgacagggttcactgggccttttattgctcctcctggaggcattccaggagtccaggggccaccacacatggttgtttataaccattttgctcctgttgggcaatttggtcaagttggcttgagtttcatgggaaccacttatatcccctctggaaagcagcctgattggaaacacattcctacatcttctgctgcgggggctggtgagggggatataaacagtatgaatatggcatcttcacagaggaatcctgctaacattccttctccaattcaacatcttgctcctggttcaccacttatgccaatggcttctcctgtggcaatgtttgatgtttctcctttccagccctctactgagatgtcggtacaagctcgatggtcacatgttcctaattcacaacttcctctgtcaatgccattgcagcaacaagaagggatacagacttctcagttcagccatgtcccttctgttgatcagccattaaatgccaaaaggtttaccggttctcgagcttcaacatcttctgagggcgataggaattttcctagagccactgatgtgaatgtcaaccaattgcccgatgaacttgggttaggggacacttcaaactcaactcctaccaagacttcagcacagagtgttgtcaacaagactccatctgtgatccccattacagatactttgaaggttgatgttctgaatggcaatagccatagtagtaataaccagaatgcaagttcttctttcaagaatcagccctcacaatttgaccattcctcagggcatggtaattatcagaggggtggtatttctcagaggaataattctgggggtgaatggtcccatcgtagagggtaccaaggtagaaatcaatctctgggttcagacaaaaacttttcctcaacaaagggtcagcgaagaaacagaaggaaggggaaagagggcagcaccgtcgagaaagaggaactctttggagagggaaggagagagagagcaaacttaaaggagagtgggagaaggatctttgccttgtgtgctcttagtttcatttctcatggcctcaccatccgtcttcctctcactctcgtcgcgcgtcatcgttaccccattgtcatccttggcccttcgttggttttcactcactgggaaaggatgcgatgtgaatttaatttggaatggggaaaggatggggttttaaggagaagtaataatagtaatagtaatacaggaaaagaggaagggcttttataa

SEQ ID NO: 39332 - DNA, 261 bp, Glycine max
  Peptide Sequence Number=SeqID_131017
atggacgatctagatttcttcttgaagatccacttgcacctcactactcgacttctttcagacatatctgtggaagcaatgttttccaaggttattttgatgatgccaaagaatcaagagttaaacaaagtttcaagcaaagattcaagaatcaagtttcaaatttcaagaccaagtttcaagtttcaagaatcaagaataatcaagatcaagattcaagactcaagattcaagaatcaagagaagactcaatcaagataa

SEQ ID NO: 39333 - DNA, 279 bp, Glycine max
  Peptide Sequence Number=SeqID_131018
atgtttgtattcaatagtgctttaaaaggacttaacgatactccacaaagtaaatctaaggttgttgttaggtggattgttgttaaatgtaatagacaaaaaggaagcactgagtgtgggtattacgtcatgcactggatgtcaactataatcttaggaagtttcaagaataattggaaaatgtatttcaatgatgctagaccattggaaccaaagagattgaaggcgcttcgcatccagtgggcaaagtattatttgaaaattaaaaatgaaacctag

SEQ ID NO: 39334 - DNA, 519 bp, Glycine max
  Peptide Sequence Number=SeqID_131019
atgagggaatttgggactatagcagctcatccaggcgagctgatgcttagtcctgaagaaaatggctcgcccaggctagttggtcccttcagccctaagcaattcgggggcccaggtgagccagaggctagcctgggcgagctaggtcaaacccaagtagatgtaccttctacttataccacaaaggatgtaccctccaatgtgttaagacaaagatctcaggcggttaaacctttgatactttgtgaatggggatacaaaagaattctcaggcgggagaagggagacacaaaagaattcaggcggttagtcctttgttcttttggaaaagggagaagagagacacaaaaagaattcaggcagtcagtccttggcgaattctttttggcaaagggagaagagatgaaaagaatgaatagcacaagttttcaaggtttagaaaaacagaaaactttggaaagcttttggcacaaagaagaagaagaagttcaaagagattcaaggcttgtaaaggattga

SEQ ID NO: 39335 - DNA, 675 bp, Glycine max
  Peptide Sequence Number=SeqID_131020
atggggtcaggttgtgatgggggagttgcaactgcaattcttgcaaactctggtcataaagtaatagtctttgagaaaggagagtattttgtttcacatgactattcttcccttgaaggtccattcatggatgagctatatgaatcggggagcattatgctaagtcttgatgggaagatgatgatcctggatggctcaacatttggtggaggctctgctgtaaacaggtctgcaacatttgggtttgtctacaagggatggatagatgagaacacatacactccaacaaaaccagggattggaattgtagtggccatcaagaaacttaaaccagaaagctttcaaggccacagagaatggcttgcagaagtcaattatctaggccagcttcaccatgaaaatatggtgaaacttattggttattgcacagatggtaaaaacaggctactaatgagagggcctctgtttgtgtctatttccaatcctctaatgtttgtgcttgtggctattgccagttctttgatgttgaatgagaacttatatgtaggaagtgtggttggagcagtgctgattgtgtgtgggctgtacatggttttgtggggtaaaagtaaagagatgaaaaatattactcagctggtgccatcagaaaccatccgagaagctgaatttgggtga

SEQ ID NO: 39336 - DNA, 273 bp, Glycine max
  Peptide Sequence Number=SeqID_131021
atggctccaaagaagcttctcaataaaaaggctaggaaggacatagcaggggagggatccagtgcagctccacaagcgaagattgagtttgacagacaccgtttccgaagcgaggagcatcagtgccgtttcgaagcgatcaagggatggtctttcctcaaagaaagacaggtccaactaagagaaggggaatacacaaaattccaagaggaggttgctagaaggcagtggacccagctgacagagccatggctaaatatgaccccaagatag

SEQ ID NO: 39337 - DNA, 1251 bp, Glycine max
  Peptide Sequence Number=SeqID_131022
atggctccgagaaagcttcctgcaaagagatccaggaaggagaaagcggctgaagggactagtgtcgctcctgagtatgacagccatcgcttccggagtgctgagcatcagcagcgtttcgaggccatcaaaggatggtcattccaccgagagagacgcgtccagctcagggacgatgagtacaccgacttccaggaaaagatagcttgccggcggtggacatcgttggttacccccatggccaagttcgacccagacatagtcttggaattttatgccaatgcttggcctacacaggagggcgtgcgggatatgcgatcttgggtgaggggtcagtggattcctttcgatgcggatgccctcagccagttcctgggataccctttagtactggaggagggcccgaagtgcgagtatggccagaggaggaaccgggccgatgggtttgatgaggaggccatcgcccagttgctgtgcataccgggacaggattttgcccagaccgctgccgggagacgagtacgaatcatgcgtaccagcatgactactctgacccagatatggatgacgttgctgctcagcaacatccagcccaacgaccataattccgacctccccctgccgaagtgtcagctggtgtatgccatcctgacacggatgagcgttcatgtggctcagttgatcgctgatgccatttatttgtttgcaggtatggcgcctaccaggcaccctctggacccagataagtccaacagggccctgggatttccagcattgatcacaggactctgccagtcgttcggagtccccgttgcacctagtaaggtgattcggccacccatcacccgggcttttattgagaagtattgcacgcagacacaggcccagggtgatgcaccacaggccgcaggcgcgccaccaccacctcatcaggctgacccagctgggtcatttgacacagagcggtatttgcggcactcgatgcgccagcacgtggccaaccataagggactggggcaggtccatgagtgtctttaccagctaagcctcagcatgcagagccagggcttcgctcattttccgtgccttactccagaccagttcagggcagaggttgcatggcccggggattggcccgaggcccaggcaggggaggcacccgcagaggctcccgacgatggagaggaggccggcatggatgaggagatgtcagatttgctcggcttcttgggagggagtggagccacatga

SEQ ID NO: 39338 - DNA, 369 bp, Glycine max
  Peptide Sequence Number=SeqID_131023
atggatgaacaagagaaaagagctcaagaagaagaatttggtgttgctgctactacgaaggaacaagttgttacaatccaagctaaagcttttgttaaagctgtggacgacaacattgtgtgtaaggtcattattgatctcacaaacactggtgtcatggaagaaactccaaaggcatccaatgcagttgtagttgatgagattgtccatcaagataaagaacttagttatgctgcccttgcacctattgctcctacacccccaactcttgtccatcaactgccactccttgaaccaacacaaccatcaccaccaccctcttcacctccacctacacaacctccaccaccacctcaagttcaagactga

SEQ ID NO: 39339 - DNA, 396 bp, Glycine max
  Peptide Sequence Number=SeqID_131024
atggagactaaaatagagaaattggccaagcaattgcaaacctcttcaattggcttttccacaaccaccaaggagaacccaaagggtcattgcaaggctattatctccaccatagagtgtgacgtgggaggtgaagaagaagaagaggtagaagaaagcaccatgctagaggaagagatgaaagcacaagccaacccttcaacccaagaggatgaccaacaagttccaatcattctaggaagatccttcataagaatcgctcatgtaaccatcgatgttcgtaaaggagtctacacacttagagagagcaagaaacaaatattcttctacattcaaggcattgaagattttcccaatgtatcggctcaccaacaacaccatcatacaacaccttga

SEQ ID NO: 39340 - DNA, 408 bp, Glycine max
  Peptide Sequence Number=SeqID_131025
atggatgctagtaaaccacacatggttgttgttaggaatttgtgtgtgggacttagcgtccaagattcaatgtcaagtatgccgtcgaaaccctctttcttcattgatggcattgtgacaccattagaacacactgatgcgctccatcccactctaccgtactatcactttgttgtgctcatgctaggggttgttattccttctgaatcgcattcaccgcctgcagatgattctcgggtatcacccagggtagacttggtggatctcgtgtcaaaggatgagggagaggagttggaggaggacacgccctttaaggaggatccttggatggatgaggagaaccccgtcacagggtcggagtttatggaggaggattctttggaggattcctctcatgagtcttgctag

SEQ ID NO: 39341 - DNA, 387 bp, Glycine max
  Peptide Sequence Number=SeqID_131026
atgaagatgcgcacttgtgacctcgagaaaatttctcgtcacagaattgatgaaggagtccttaccggagttggtagcaaggattgcgtagagttgcttgatgatgaacgtgtgttagaagatcctgtggatactagtgaacgatacggcggtggccggcgagcatcgagaaacaatgatatcggttgtaagacctgcacttctctgcgaatcgttgggttcaatcctgagatgaagcaactcaagacgaacggagccgataaccctactatcttgttggccaatgattcaaattctgaaagatacgccgataccgaagaacgctattgcaatttgcagagtaatcccgtgggatcttcatatgttgatgttgcaaagcgtgaatga

SEQ ID NO: 39342 - DNA, 420 bp, Glycine max
  Peptide Sequence Number=SeqID_131027
atgggggagaagcttgccacccagctcgcccaggcaagcaaggtggtttcctccaaaagcaaccgccttttgggggaatcttctggagggcccaagtgggcctgcatgtcacggaacttcacgaattgcctaacgatgggtgccaagtacctcaaaatggtcaaacgaaagttgcatgccaccaagcaaaggtccccggacgaaattaggactcttagggctcgtgtggttgctaagacagaagaaaagaaattgaagctattgtttcttcggtggagtgagcctcataaaagactaagcaattttataagtactaaagtagagccttcaatctatactattttcctagcaagcccttggatgaagatcctatatcacttgagaagtgcaaagaagaggttgtcaaacttagatatctga

SEQ ID NO: 39343 - DNA, 117 bp, Glycine max
  Peptide Sequence Number=SeqID_131028
atggggggtgcagtgaccttgttggatatccctggtggcgaaaatatagtgatgaggggtgtagtgatcttgttggatatccctggtgggggaaatagagtggttaaagagttttaa

SEQ ID NO: 39344 - DNA, 1335 bp, Glycine max
  Peptide Sequence Number=SeqID_131029
atgactttgagccaggttcaaaggccttacaatttgtctcagaagaagtcctacgtccctcaagctaatgttccaacaaacaagtggtttcgaccaaggaatgaaggatccaaatcacattttaaggagtttaaagtgaatagtttagagcttcgaaggggaggaatcattgagggttgttcaaggaaaggatattatgactatcaaaatcctcattggagagatgtgatattagaaatgcaacataaaaatgcagcaagattgccattctttgacagaattagtgaaggtctacctcctgggttcgaaaagaaaatgtcaaccaaggaccgagaggagaaagaaatgataacagagtctttcaagtttgggtttgaggactcactggaagccatacgaggagtcatttcaatcttacccacagaatatgcagaagactatcaaaacaggaatatcttgagtgattatgctagggaggattactttgatgatccttatttatgtcccaaggttgtttgggttacacaagtttcttgtttcacaccacatcgaaatgttgcagctttcgatccatccactaatgatataagatgccatatgaagccactccatttgattgctctggtggaggaccaaattattaataagatcttagtcgatggaggggacacatttaatatcctgcccaggtctatgctatgcagtaggaggaggcctatggtgtttttggatggcaaactcataatggtcggaggggatcaatcatcgtatggaatctgtgttgcctttgcaagtgaagctgatcaagcaatggcaaggaccactccgttcgaaattgaagattcattctatgtgaataacatattaggtgacgaaaaggaccaattcttttattgggatacgaataaaggtttcttgttgattaacaagcagttcttgaggcacgatgtcaataggaggcctactagatctaccttccgccaggacacggctgctaaagttcacgaggatgtgggagatttcagtcatgatgaagatcatacgtcatccgagatcgccttctaccaggatgttatcggtgaagagctacttgagggagagatgctttcatctgacgaggaatatgattccttgggagacgagaacacgactgctaaagttcacgaggatgtgggagatttcagtcatgatgaagatcttacatcatccgagatcgccttctaccaggatgttattggtgaagagatacttgagagagagatgctttcatccgacgaggaatgcgattccttgggagacgagagtaacccttccaaagatatgacttcaccctag

SEQ ID NO: 39345 - DNA, 399 bp, Glycine max
  Peptide Sequence Number=SeqID_131030
atgttgcggcggcaggtagctgggtctcgatgctgtttgtttgggccttgcttctgcggtttcgggcccagttctggtatccacgaggtgattgctatcatacgccgtccactcccccgctgtcttaggaggatattcttgcgaagtggtggaacaaggatgaaattcgaagcgtgtaagaaggctacaagcggattaagcgttgcttgctttggaaagacgctcgctcctccatgtctgaactccaacagagttatctcactccgatcacttcttccggagattaccaaaatgaacaggatgaaaaagccaactacagaagtggtatccattaagaatatggtgatatgctttgaagatcaggaaacagggagatgcttgaaagagattcccacttaa

SEQ ID NO: 39346 - DNA, 684 bp, Glycine max
  Peptide Sequence Number=SeqID_131031
atgtctctctcctattcccaatgtctcatcttcctaggctctcgagaagacgagaagatgcgtccaccttcgaaaccaaacccgcggaggcttttaggccactccctccatgacttcagcggaacaacctatgaagaagcgaaagctctacgagcctttaccagaaccgccaccgtctttgtcgctggaatccgaatcaacgcctccctctccgtaaaccctacctacgctgttaggagcagaggtctcgtgaggggaagagagggaatgggtaaccttgcttcgagggaaggtagctgggtctcgatgttgttcgtttgggccttgcttttgcggtttcgggcccagttctggtatcctcgaggtgattgctatcaataccctcacccgcgaagaccaccttgtcctcaaggtggtgaaggtctcgaacttctgaccactgttcccaggtggtgtcctcagggggttgaccctaccattgcactagcacgagtcgcgttggtggagacgatgatgtgtcaagaccatgatgctcgcgtaggagtgaacaatggaatacggggtggatccttgcctcctcagcttaacatagacccactggccgatgctgaaggtcatgtcgcggcgcttgttatccgccaatctcttcatggtgtcttatgccttttgaagacgatgttgtag

SEQ ID NO: 39347 - DNA, 288 bp, Glycine max
  Peptide Sequence Number=SeqID_131032
atgatgataacaaaagatgatgacaaaggtgatgacaaaactctcaaagatcaatcaaagaacaactcaagtgaatcaaagatcaatcaaagaacaactcaagtaaatcaagaagaattcaagactcaagaagaaagtttagagtcaagaatcaagattcaaggttcaagatctcaagaatcaagattcaaggttcaagatctcaagaatcaagatcaagcgataagcaacgacggctcgtgggggccactggtggtcatgggtggtggagaaggtgttagggtttga

SEQ ID NO: 39348 - DNA, 324 bp, Glycine max
  Peptide Sequence Number=SeqID_131033
gctactttggctaaggcatatagtcaagtgtataatgggaagtctagacacttgggtgttagacacaacatggttcgggagttaatcatgcatggtgtgatatcagtggagtttgtgagaactcagcataatttggacgatcatttaaccaaagggttaagtagagatctcgtgaaaaggtcgactagattggaacacatcatcgaaagtatcccaaaaggtgcaagaaagaaaatgactacctatataagcatgaagtttagccgcttcaagaagctgggacttggctttgatatgcttatgaaggatagggacacaggctag

SEQ ID NO: 39349 - DNA, 333 bp, Glycine max
  Peptide Sequence Number=SeqID_131034
atggcatgtttgttattaggtttcatttgcgagatgatgtggttatggttagattctatctatgagataatgaggccttactttgttattcctgataggctatcaatggtgcatgtggtgtcagtagataaaccaaatgtcatgcccatcactatcaatcatcgtcggtactcctatattccttggggatttacatcttgtcgacaactagagtggtttgaagatatcagtttttatctgggtatggaagtgcctcacgatgctcaagaatttgaagtgaccccagtgaggtttgatgtgagaggtaatgttctaagttggagattcaagtta

SEQ ID NO: 39350 - DNA, 252 bp, Glycine max
  Peptide Sequence Number=SeqID_131035
atggcagatccgtgccttctcctcagccttctcacggccccatgccttccttctattcctccaagtcttgtaggaagggtgtgcatcaaagttggaggaattactgacatcacttttgtgcctaatgatgatactgggaagattgagtgtaataaatggcttcacggagatgttgaaacagatgaagctgagggggcatcgtctgataaggtgatttttctttggttacctacttaccataggaaggaatga

SEQ ID NO: 39351 - DNA, 141 bp, Glycine max
  Peptide Sequence Number=SeqID_131036
atggccttttatcatggtggtcatctggtctttcatggccttcatctgctcttgcacctcctctatttcactcattactctagctctgacacacgttcgtggaaaatgcaaggatcattcatgagtgaacataacatgtga

SEQ ID NO: 39352 - DNA, 714 bp, Glycine max
  Peptide Sequence Number=SeqID_131037
atgttaaaacctggagattcagctacagaaaataagctctctcaactactgcaggctcaaagtgctttggaaacaactcagtccttctatgattcgggcaacttctcaaaatctttggaatacattgataaagttgttcttgttttttcttcaacttgcaataaggctaagcttcttaaagtgaaagtgttaattgctgataaagagtatgagaatgctattgccgagtctggttttcttcttaaggaagatgaaaataatttagaggcatttttgttacgtggtcgtgcacattactatttagctgatcatgatgttgccacgaggcattttcataaaggtctccgcctagatccagagcatagtgaactaaaaaaggcatattttggattgaaaaatctactcaaaaagagtaaaagtgctaaagataatgctagtaagggtaaactacgcatggcagtggaggaattcaaagctgcacttgctgttgaccctatacatcttgcacacaatgtacatcttcatcttggcttatgtaaagtgctagtcaagcttggcagaggaaaagatgccttggacagttgtagtgaagcttttaagattgatgaggagcttgtggaagctcttgttcagagtggagaagctaaactcttaacagaagattgggagggagctatggaggatctgagatcagctgctcaaaaatcgccttag

SEQ ID NO: 39353 - DNA, 315 bp, Glycine max
  Peptide Sequence Number=SeqID_131038
atgtgttttctactagtgtcgtcgaatgtggaccacaatctggattcccttcgcatgatacagagtgaaactgttgtagggaaagccggcgttgatggcgttgctgccaccaagaacgtggccacacgtgttggggattccctcctcggaaatgaaagtttgggcgggagagtctctggtttcggtgttcaagaggttggccaagaagccttcttggttgatcaaagttggggtcgttgtgaccaacactttgacgttccagcaaaagcacccgaaacgacttcaagattagagagagaaagagaaaacgagtag

SEQ ID NO: 39354 - DNA, 270 bp, Glycine max
  Peptide Sequence Number=SeqID_131039
atgcccagggcacaaaattccacagcacaccatagtgcctatttcgggaaaagagctctggaggtagcaagaggagcagcttttgcagagatacctaggttttggcattctcatatagaacctgttgaagatacaatcatggctgaagagccaagaagattaaccctagaggattattcaagttctaatgtgccacaatttttcaccagcattgcacaatcagaagttcaagcacaaaccattacatatccaccatcattaatcagctaa

SEQ ID NO: 39355 - DNA, 216 bp, Glycine max
  Peptide Sequence Number=SeqID_131040
atggagcatatcagggtgatgcctcctgttggaaatgcacaggaaggcgatactgatgaggacataaccaagggcaaggaccatgaagcacttgaagggcccatgaccagaggcagacttaaacaagcccaacacgtcatagagacaaggctggtcatttgtatagctgccattgatgatgatagaaggcccaagtggagaaagatgaaggcctag

SEQ ID NO: 39356 - DNA, 535 bp, Glycine max
  Peptide Sequence Number=SeqID_131041
atgtcgcaaggacaagcagttccgtttgttgggaagtggcaacactttacagtcaggaatgatggagaaaaggtggttccagaaccacatggtgacgcagaacagacagaaacctgggaatcagaggtgatgatcccttttgcagtggaaagaacggtttacgcttttggtggacccctgccagaccaagcatcactttcgagtaaaatgagtaaggtatttccctgctaccaaacttgcgaacctaggatttttgatagtgagccttacaactttaattgtttaagcaaacccaacaaactctttcgatccaccccgtcaatagcccatagggattacctgccttggcttgatcgagtcgaacaagcgtatgaggatttctggaagacatatggcatctttgatttgatacaattctctcgatctggtcctgaatatcgaccagaaatgctgatagcagctatgcactttgttgagtcttctaccaaggactttcagtttaagtgtggtatgatgacccccaagtctcttagat

SEQ ID NO: 39357 - DNA, 366 bp, Glycine max
  Peptide Sequence Number=SeqID_131042
atggacttaggtggaaagcaaaaaagcatgcatccttcgcggtgtggttatatcttcagttctgtgcgtgttttattcttagtgcaatatctacaagcagctatattgcgacaacacatttgccagtggaaggaaaataatggccacttattgctctttgatttacatcctacagcaagagaactcggtttccagcgagtgagtgattggaaagatgcaaattgggtcacgacgctctcttctccacgtgcaaactcgtccaccgcaacgacttggaggatgtccgacgacaccctttttcacatcgatagagatgaagtgagagacagagaagaaaccattttcatttctgagaagccattttag

SEQ ID NO: 39358 - DNA, 378 bp, Glycine max
  Peptide Sequence Number=SeqID_131043
atgtcagtagagcagttcattgagaaggtatcctggcctggaaccttaccttctgttgtgagagagggagtagagatgagacctgatgaggatgttcttcctgagccaattgtgccagaggctgctactcctgagaggacaccacagacctcagaaggtccactctcaccatggatggacctatcttttgctcagcaggtagcagatcctcctacaccagtacatgagagacaagtagatcctcctacacctatcatggagatgccagaagaccctaccacgccagtcctgagactctcagccactcttccagctaccccaattttacatctgacaaatgaagaggatatgcaagatacacaaggcacacaggactag

SEQ ID NO: 39359 - DNA, 336 bp, Glycine max
  Peptide Sequence Number=SeqID_131044
atgaaacttctctctctccccgtgtttgcgcttctgcttcttcttctttcggatcacctcttcttcttcctgcttcttcttcattctttgggcgtcttcttcttcattccttgcgcgtcttctttgtgcctcttcttcttcttcgttgaggaggttgccgaggtagcttgcggtggtgctgcgaggaagcttccgcgaagagcaacggtcgttgaggaggttagcgcgtccaccgtcgaggtaagcaccgtgaaccttagctttttatggtctagtgttgccgacgatggcggaaaccgctgtcagaaatcgttgggagctttacggatcacttaa

SEQ ID NO: 39360 - DNA, 1957 bp, Glycine max
  Peptide Sequence Number=SeqID_131045
atgggacaagcaccgtccacgccggtttcttcgacggacctgagtcaccgggatattttcaccaccgacgaatccatcggccgcgactacaccgccgacatccccgacgagtgcctcgccggaatcttccagtttctaagctccgtcgaccggaaaacctgctccgccgtgtgtcggcggtggctgcgcgtggacggcgagaaccgccagcgcctctccctgaacgcgaaggcgagcctggttgacttcgttccgtcgctcttctcgcggtttgactcggtcacgaagctcgccctgcggtgcgaccgcaagtccacgagcgtaaacgacgacgctttggtcctgatctcgctgcggtgcaggaatctggtgcggctgaagctgcgcgggtgcagggaagtcaccgagcacggaatggccgacgtggcgaagaactgcacgaatctgaagaagctctcgtgcggttcgtgcgcgttcggcgcaaagggcgtttacgctttcgttaacaactccatcgttcttgaagaggtttctatcaagaggcttcgaggggttgaaaaagataataacgatggcgttgacggcgccgaatcgcttcctctttccgttacttcctcttcgttgagatcgatttgcctcaaggagctcgttaacggccactgtttcgcgccgttaatagttaattcgaagaagcttgaaacgctgaagctgattcggtgtttgggggattgggatgtgactctggaaagtgttggaaagttgaattcagggttggttgagattcatttagagaaggttcaggttagcgatgtgggacttttgggggtttctaagtgtttgaagttggagtctttgcaccttgtgaaaacacccgagtgttccgacgtgggactttgcgaagttgcggagaggtgtaagatgctgaagaagcttcacattgatgggtggaggaccaacaggattggggattgtggcttgatgtctgttgccaaacactgtcctaacttgcaggagcttgtgctgattgctatgtatcccacgtctttgagtttggctgcgattgtttctggttgccagggtttggagaggtttgcactttgtgggatttgtacggttggtgatgcagagatagagagcattgtggcaaagtgtggggcactgaggaagctgtgcattaaggggtgccccgtgtcgaatgctgggattgcggctttggcttcagggtgtcccaatttggttaagctcaaggtgaggaagtgcagaagggttaatggtgaagttgtggagtggctgcgtgagaggaggagttctctggtgtttagtattgattacagtactgaagttgaggctttggatggaagtggtagtgatgttggcgctcaggaaagtagcatggcgtctcctccaatcgacacaacacaagtgtccatggttgatgatcctccttcaagcagtaataatagcagcagcaacaacaacaacaacagattgtctatgttcaggaacaagtttggatttttggctggtaggaatttgggtgacaagtttagggaagctgaagaattgtttgacaacctactgaatgatgaaaattcagctttgaaaccagacccgaagatgtttaatatgatgatttatatacataagaaggctggaagttatgaaaaggcccgtaagacatttgcactgatggctgaactgggaattcaacaaactacaggtctagtcacaactgagaggaacagtctagacccagctgcagctccgtttgctaaaaatccaagagacatagaagggcttactgagggtgctagtataattgaagtggttaagaagattaggtcacatgtgctccttggtttgtctggcgttggtggtatttttaatgaggaggctcgtgaggctgctatggcagttcaaggaaagatggtagattctcagtgtaagaagagcaaag

SEQ ID NO: 39361 - DNA, 213 bp, Glycine max
  Peptide Sequence Number=SeqID_131046
atggatgaagaatgggaagttggatcctgtagcaatgtacaagaggactttgaaggcattgatgaagaatctggatatgaatggtgcagcaacaaacaagaagagatggcactgggagatgaggacatgtcagtgtactccaatgatcagtgttggagtggtgatatgttgattgtgatgatgaggtttcttctcaatatgaatgtgaagtag

SEQ ID NO: 39362 - DNA, 237 bp, Glycine max
  Peptide Sequence Number=SeqID_131047
atggatgaggcagtcggtgtttcaaagaaagcaaaggtggatccaaaaattgaagaggatgcctcctcaggctttggcaagtgtgacactaatgcccattcgaatgagattgaagcactggatgaacgattgaagcaaaaaaaagaagcaaacaatgtagccatggcatggattggtggatggtcaaatgaattcaaaggcatgctcctcacgagagtccttataaagttatggtaa

SEQ ID NO: 39363 - DNA, 975 bp, Glycine max
  Peptide Sequence Number=SeqID_131048
atgaagctctcggcgttgcagcagagctacctcaaccgccggagcaacagcttcagaggatcgctgccgttggactcctccggcgagcaccttttggctcctcctccaagctgcgtgctgcatcgtcagcgtcgtcatcggcttccgcttctcccgtctcgtcttcctcttcctcttctccgccgcctccctcggcggcgaaatctccgctctgctcgtcgtgcattcagccctcgccaccgcgagcccgatcgcgaagagcgtgtccgccgcgtgtcctccggcgaatcggaccgccgccggaagccgcgtggtggtcgggcggcacgggatccgtgtccggccgtggccgcatccgaatccggaggaggtgatgagggcacaccgcataatcgagagaatccagagggagcagaggatgctgttcggagtgaaaaagccgaaaatggttattgcggtcacgccgacgcaggtgcgcacgttccagaagcttcacttgagcagcgtcatgcactcgctcatgctcgtgccgccggaagagtcaccaatgagaccgcttccattatagccaagtcagggctcagaaccatccacgttggcttcaatcaccgaatgacgatttcgtggagtgatagacacaaattggaggctatgatgcgccttcatgctttgaggatagtgagaaaagagagacttgatggaattgtgatatttgcggatgatagcaatatgcataggaagcttgagtgggctgggtttgtgttgaattccaagttgctttggaaggatcttgatgataagccggagtggattaaggatcttgaagtgttcgatggggttgatgatatagagagtccactgtatctgctcggggacacttctgtggttgaaccacttggaagttgtggccgccaggttttgctttggtggctgcgggttgaagctcgcacagacagcaaattccctgctcagtga

SEQ ID NO: 39364 - DNA, 183 bp, Glycine max
  Peptide Sequence Number=SeqID_131049
atggtggtgagactgagcacgaggaccttcgcgaaggagaggactgtcacgagggtgagagtgagagctctggtgaagggtgagagtgagagcgagactgaagcgccatggacagagagagcgaatgttgatggtgttggatcgagtggcctcagaataattaagaagggagggttgaattaa

SEQ ID NO: 39365 - DNA, 192 bp, Glycine max
  Peptide Sequence Number=SeqID_131050
atgagggcacttggtggacttgtagctcgcccaggagagctaatgcttcactctgaagtaaccttgctcgcccaggcaagctggtttcgaccacaaaaagagcaagacaaaactcaaaggaacctaaactcaacacaattcatggttcaagaacaagaacaagaaatttggaccatagaaaatcaaatctag

SEQ ID NO: 39366 - DNA, 99 bp, Glycine max
  Peptide Sequence Number=SeqID_131051
atggcacatcaaggggcaagacctgcaacggcccctggggacgacggaggagctcaagaggatgacgatatggctgacttgtttgttatctcattgtga

SEQ ID NO: 39367 - DNA, 1481 bp, Glycine max
  Peptide Sequence Number=SeqID_131052
gtgttgagggaagaagcccaaagtttcaacaacctctggatttaaggacaaatccttttcaaggggtggggttgatgcagttctatcccctaatggcattggatagaagactccaagaagattgggccagagatgcaggagaaggccctagggttctcatgagccttagggggggtgagcttagctattggaggggtatgtgttcccttgggggtgagcttagctattggaggggtgtaacacttgcttcccaaggaagcttctcaaggaagccttcttccttcatgtattttggcatggtggtgagcttagctattgaagagctcaaagatccagcctgcatagaagcttctcaagcaagcttccatcaatggctacatcacaatcccgaatttgggagactagtcgctcatggccatgggaaaattagaaatcctaataaagaacacaaacatgccaaaagagaagaagacttcgttaaaattcatcctaattgtgatcttcgcactcctctacagctgagactcccagatgaccctcttctctgtcaaaactctcaagaactgcatgcaaaccaagtccaaaatccaccactgcagtacgaacctaatattgacaagatattccagaaacttcgtgcaaagattagtgaagacagggaaaaagtaatggtagctaatcagtctcatacccttatggattaccttgcttctacctttggggaagccaataccatccaccttcttgatctacctgagggagtcacatttgacatcaagcagggtttcctaaaaatgctagagaacaacccattcgatggtgtttcccatgaagatcttatgcaacacctaaggaagttcatcaagtttaccaacatgaatgaagttgttgtcccaattgaccaacatacaatccctcttatcacaaagaaagtcaagcaaccttcacaacctaaaccaaatcctaagaaggaggatgtcaatgctgtgatgactagaagcaagatgattcaaaaggactccgaggagaatgaagcaactaggaaagttaaggttcctactgatgggaatccagtggcaagcaagaagggtgagaaggagaccattgtgactgagcctcacccaagtgtggggaaggaagatcctccaaggaagaaagtcattccaaaagaccctagatggagtaagaaaaatggagatagcatcaccattcaaactcttggctatggagtagatgattatcttggaggatcaatgcaaaaagggaaaatcaccatgttcgagggttccttctttgagaattctagcagaatcggagtgaaaaatgctttcgacaagagggtgcaccggcgtaagttcagcaaggggaaccttgttctaaagaaggctttcttgggaggagcgttgttgcttatgaacatggatgacgaagatctgccttcacctgtgaactctgacatcgtcaagcggtattacaaatga

SEQ ID NO: 39368 - DNA, 213 bp, Glycine max
  Peptide Sequence Number=SeqID_131053
atgccagctggtctacactatccttacctaggtatcacgcctccaaggcacccagtggacccagaaaagtccaacagagcactgggatttctggccttgatcacaggtctctgccagttctatgcggtgtcggttatgcccataaagctcattcgacctcccattaataggtcattcattgagaaatactgcatgccaaggcaggcacaatag

SEQ ID NO: 39369 - DNA, 168 bp, Glycine max
  Peptide Sequence Number=SeqID_131054
atggcacgcaaaccgaggcaggatttaagcgtttcaaagacagctttctctctccctcacgttgcctttcttctccctcattctccattgaagctccacacaaagcttcaacctttggtgctcatttctgccccaaatcgtgaaaggagagcatttttggagtcgtga

SEQ ID NO: 39370 - DNA, 448 bp, Glycine max
  Peptide Sequence Number=SeqID_131055
atgcaaagaaggtcttctgcaggtgttttgattcccatagacttggaaattaacgcaacttgcaagaaaaggaacacagaaagaaatagaaagattttgcaggacattgaggcagcagcaattcaggaagaacctctatcttctgaggcatcttctagttttccaaaacaaagggaatctcacacagtattaattgaagacaatatcatggctgatgagccaagacgactgaccctggaagattactcaagtacttatgtgccgcaattcttcacaagcattgcatggctagaggtacaagctcagaatataacctatccacattcattaattcaattgattcagaacaatttgtttaatggtctgcccaatgaagacccgtatgcacatctagctacctatattgagatatgcaatactgttagtatagttggtgtgcctgaggatg

SEQ ID NO: 39371 - DNA, 288 bp, Glycine max
  Peptide Sequence Number=SeqID_131056
atgggtgatcaagccacaaatatgaaaaagagtttacatcaactactcaataagaatccccaactgagggttttagcctttcatggcaaggaagctccttttacactgaagaagaggaatcaagagaaattgcttgcttacaaaggagtggggatgtaccctccacctctaggaatctcacaatcacttaaaaactcactaatctccctaaaagatgaaaacttggccccttgctctactctacgctatctgaaattcacactcttcaagcctctgagtagtgaatag

SEQ ID NO: 39372 - DNA, 156 bp, Glycine max
  Peptide Sequence Number=SeqID_131057
atggataagagcttgaaggtaggagaagatgagtggagggagagggagagaaggagcacaaaattttgggcctcaaatgagtctaggtgccctaaaatacaagggctgaaaaatcctacatttctagggtaccctacctacattatggagccctaa

SEQ ID NO: 39373 - DNA, 114 bp, Glycine max
  Peptide Sequence Number=SeqID_131058
atgcgctacgcgccaacatcattatgctttgaagtcattggaagtgtgcttagcgtaggtagtggcgctaagcctaaatcactcactaaagtgctaagcgttgctgctgcgtga

SEQ ID NO: 39374 - DNA, 396 bp, Glycine max
  Peptide Sequence Number=SeqID_131059
atgagtattctgcatgaattggtcatgtacgattaccatgagaaagatagagcccctgatcttgaaagtaatttggtagacttcatgacataccaagctagctctaaaggttactgttattctgtgcaacagcagggaactcaatttgaaaggaaccagtcttctgtaggttatcaatgggagtcataccaacaatctgattatcacaatgaagcagaaagaggatccaatctggataaattgttgatgcaattcaaggaaacaactaaatcaactcaacaagcactccaaagtgtagaaatccaggttggtgtgctggcagaagaagtaactcaatttatgaccagacgagaaaaatactttgtaaaggttgaagctcagaggaaaaccctgtaa

SEQ ID NO: 39375 - DNA, 144 bp, Glycine max
  Peptide Sequence Number=SeqID_131060
atggacaacacgtttgacgatgaagttgaatcggctgttacaatcgacgaatacctcgaggaagttgaggaacgggaactgggtagcgtgacagtccagtcacctagtggaccaaagcagccgaatcctatagcaccattttga

SEQ ID NO: 39376 - DNA, 216 bp, Glycine max
  Peptide Sequence Number=SeqID_131061
atggatgttgtagacaacattaagacaactttccctaagattgaaagtgctaaagaatttatcggattatttgatggttcacatgttatacatgagcacatcattgagatgataaacattgcaacaaggcttaagatcttaggaatggtggtgagtgggaactttcttgtgcagtttattcttaactcattactgtctgagtatgacccattttaa

SEQ ID NO: 39377 - DNA, 225 bp, Glycine max
  Peptide Sequence Number=SeqID_131062
atgactaagaggaaaatgcaaggatcatgcattagtgaacgtacaatggaaatggaatatatgcaattggcagaacaaaagcatggactatcagcgacaatgcatcaccaaaagagaaaaaatctagatgaggcttcactgtcatcaagcgagtcagagacccaacataaccacaaattgacctccattccttatggctcagatagacccgggtatagggcctaa

SEQ ID NO: 39378 - DNA, 255 bp, Glycine max
  Peptide Sequence Number=SeqID_131063
ggtacatcctttgtggtacaagtagagggtacatctacttgggttgttgtgactaagaacaagagagggtacatctcttgtggatcagttcaagtggagggtacatccacttggttgttcaaagagaacaagggagggtacatcccttgtggatctttgcttgtaaaggtttttacaaggttgaaaagaaatctcaaggaccacaggtcgcttgcggacaggatgcagacacaggttgtttccaaaccagtataa

SEQ ID NO: 39379 - DNA, 594 bp, Glycine max
  Peptide Sequence Number=SeqID_131064
atgaaaagatggtgggctatgcaccttcaaagctttgcggatttggtctttgccagtgaaaggatcgatgtgggtccgaaaagaggaaaatttagtcatcctgcttggacgaatgagaaaactggggcaaatgaagagggtgaggatgaaggagaaacccatgctgtgactgccattcttatatggccaagtttcccaccaacccaacaatgtcattactcagccaataacaacccatctccttacccaccacccaattatccacaaaggtcatccctaaatcaaccacaaagcctgtctacgacacaaccaatgctaaacaccacctttagcacgaaccgaaacaccaaccaaaaaggaattttgcagcaaaaagcctgtaggattcaccccaaattccgatgtcatatgctaaacttgctctcatatctactcgataattcaatggtagccataacccctactaggtttcctcaacctccatttttcagaggatacgacttgaacgcaacatgtgtatatcatggaggatccctggggcattccattgagcactgtatgaccctgaagcataaggtgcaaagtctaaattga

SEQ ID NO: 39380 - DNA, 328 bp, Glycine max
  Peptide Sequence Number=SeqID_131065
atgtcgcaaaacccttcagaatgcgcatcaattggtgttaagcagctcaattggggtggaaagaattcaaatgtgtcgcaacctacccttttgcgggtgagcgaggagaggctcacgggtgcgtcttccaaagaaggaaaatgcacggagtcgccaccaacgtttatttgtggaaaacgtcgaaaaaaccgaaggaaaccggtcatcaagaatattccagattcgggagttgtatttacgtttgaggaaggtattagcacctctcacgtcaacaaaagcggggctcttgctcctacgtaccctccatcgaagaggaaatcagacctac

SEQ ID NO: 39381 - DNA, 258 bp, Glycine max
  Peptide Sequence Number=SeqID_131066
atgaatagcacaagttttcaaggtttgcaaaaccagaaaacttcagaaagcttttggtacaaagaagaagaagatgaagttcaaagagattcaaggcttgtaaaggattgtaatgaaatgattggaaaatttgaaaactttttcaaactcattttgctactggtaatcgattacaacaatatggagcttctatggaggctggcttcaatgagttccttcaatggtgatttcccaccatggagatgcagtagaggataa

SEQ ID NO: 39382 - DNA, 210 bp, Glycine max
  Peptide Sequence Number=SeqID_131067
atgcatgatggcattgttagaaccttaatcgatgtttgtcaagttccaaagcttaagaaaaatctagtctttgtggatgtcatggattcaaaaggtttttcttgtaaagttaaaggtggagttatgaacatcaaaaggaaagggaagtttgtggtaatgcagaggactaagcaaggaaatttgtacatcattcaaaggttcactagatag

SEQ ID NO: 39383 - DNA, 147 bp, Glycine max
  Peptide Sequence Number=SeqID_131068
atggcagcggaatggagaatgaggaaagataatgacaaaggtgatgacaaaaagctcaaagatcaatcaaagaacaactcaagtgaatcaaagatcaatcaaagaacaactcaagtgaatcaagaacaattcaagagttcaagataa

SEQ ID NO: 39384 - DNA, 147 bp, Glycine max
  Peptide Sequence Number=SeqID_131069
atggctaatccagacaatgtcgcaacctacccttcggcgggagggcgacgcgtgactcgcgaatgcgtgttccaagaaaggaatacgcgcggagtcgccaccaacgtctatttgaggaaaacgtcggaaaaaccggaaaagacgtga

SEQ ID NO: 39385 - DNA, 453 bp, Glycine max
  Peptide Sequence Number=SeqID_131070
atgggtgaggaccctggtgtgcttgaggttgttagacaattggataaggcttgttcagaagcagggttcttgtacgtgaaaggacatggtgttcctgaggctctcctcaaagaagttagagatgtaacacgcagatactttgaacttccatacgaagaaaaggcaaagatcaaaatgactcccgctactgggttcaggctcatcttagtgcaatttaaaatcgattactttatttccctagaagtgtgctatagagaagtgagcaagggcatgtatggagatcttggcaaagttatggaaggaagcaaccagtggaattattctttccaaaacagagacaaaattacaacaattagaatcagaatattcactcaaacaagccaagatttcaagagcttggttctctccctcccaaggtctaaaccacacttcttcaggataaccagaatatga

SEQ ID NO: 39386 - DNA, 717 bp, Glycine max
  Peptide Sequence Number=SeqID_131071
atggcctttggaaccatggcagctcccccaggcgagctgatgcttcatcttgaaattcaatatccaattaacacaaaaccattaatcctgcagttcacagcaatattccataatgatatggacatgatagaagtgtcttctttttaccaccgacaatgggcaccagaataccctgagtttgtgaacttcaaatatgatggaacaacataccaaatcaggctaaggcagcatcgggcaaaagtctactttgcagaagggttgaacaaattcagaaaagatttatcaatttttgaatctatgatcattaaattcttggcatgcaacaacaaatccatgtttgatctttatttcattccctcactggaatgcaagacttgcggaagaccacaattgatgtcaagacaacatatttggacacttgaaatcacacaatcaatgcttggtgcaccaggaccactgagactcccctactgtgccatcacacatgcaaatgcctgcagtcaacagatgaccattctcagaagatttggacctccattacagtggaatgttgtggtagttgacaatggagttgcgcgcagatatgttgtacaaccatggtatcaattccttgcagataatgatttctcccatggtgatgaagtctccttctattacaggagcattgacaaaatatgggaaattgtcatccgccggaaaaagaattgggactattag

SEQ ID NO: 39387 - DNA, 270 bp, Glycine max
  Peptide Sequence Number=SeqID_131072
atggaaaaccatagatttataagcaagtctgattcagcaaaagtcaggagcaacagaaagcgtattagacaacaaaaggtccatcttaatgctcaggatagtgtccatgcaagtgtcaatccagcttcatcccatactgaagatcattataaccaaccaaagacaccaccgcatagtgtccatgcaactgtcaatcgggcttcacacgatgctgaaaatcattttgtttggttattcatattttttcctggtattgatttcttcagctag

SEQ ID NO: 39388 - DNA, 276 bp, Glycine max
  Peptide Sequence Number=SeqID_131073
atggggctccgaataaaagtggagaatggaggagaggcgaagagtgctaggcaatcaatacgtggggctcatcaagcttatcgataccgtcgacctcgagggggggcccgctgcattaatgaaatcggccaacgcgcggggagaggcgggtttgcgtattgggcgctagcggagtgtatactggcttactatgttggcactgatgagggtgtcagtgaagtgctttcatgtggcaggagaaaaaaggctgcaccggtgcgtcagcagaatatgtga

SEQ ID NO: 39389 - DNA, 246 bp, Glycine max
  Peptide Sequence Number=SeqID_131074
atgtcttttcctcaatttatggttctttttgtagttaatgtcttgctaagcgagacatatacccttggcgagcaacatccgctaagcaagatattatcctgcttagcgagtgaggagaatctggaagagaatctaccacgcatgcacgcgctcagtgcaccatcaactcgcccagtgagtagtttgtctcttcaggcgctcagcgcatctgacgcgctaagccataattcacttactcgcgcttag

SEQ ID NO: 39390 - DNA, 246 bp, Glycine max
  Peptide Sequence Number=SeqID_131075
atggggggtgcaagtagaaatttggaattgggccttccagagtgttttttgaagcaggattgcttctggaggaagcaacccagctcgcctgggcgagctgggcgacaacctcctcccttttttcctataaaaaggcaaaaggggactgttctaagggtccctgattccccttggctatgcatttcagctattttgggtgaaaaaatgatttccgtgaagaaaatccaagccgaggtgcttccgtaa

SEQ ID NO: 39391 - DNA, 51 bp, Glycine max
  Peptide Sequence Number=SeqID_131076
atggaggaggagaagaagaaggagaaaatggtggaggatgacaaacaactg

SEQ ID NO: 39392 - DNA, 979 bp, Glycine max
  Peptide Sequence Number=SeqID_131077
gcgagggatatggcgaatcaagagaagtgggtcccgtttatggacgtattagcattgctaatctttggggttgtcctctttccaaacgtggacggtttggtggacctagccgcaattgatgctttccttgcatatcaccatagcaaagagagcctggtggaaggaaaggagggagttctcttctcatgtggggactacccaaacattccgttgatagggacgaggggttgtattaactacaatcccgcacttgctataagacagttagggtaccccatgaggggagcaccggcggaagaaagcctgtctcctttccttgtgagagatttcggagcgcaaagtttcaagggtatacaaagagtccataaggcatgggaaagcccgttaaggaaagataaagaacttaggagcattcgtaatggcatcatcggtggttatcatgaatggctgaaagatgaagaagtccgagctctgaaaatcgaactaggaaaagcgagacttgccaaagaaaaattcaagttggtcgctacagacgtccggaaagagtgtgccgggttacgagaagaaaatgtagctaccacaaaagcccttgaacaagaaaccaagagggctcgcaaggaagagcatggccgtgacaaatttcgtggagcattgtggggcagcaacaatgagctcaagcttcgaagggaagagagagaccgatcacgagcacatagcatgatcttaaaagaagagttagccatttgctcaaggtccaaaagaaacttgtcacagcgtttatgcgagacagagaccaacatgttagttatcattaccaagtatcaagaagaactaaatctagccacggcccacgagcatagagtggcggacgagtatgcccaagtgtacacggaaatggaggctagaggaagggtgatcgactcattacatcaagaggcaacaatgtggatggaacgatttgctcctaccttgaacggga

SEQ ID NO: 39393 - DNA, 136 bp, Glycine max
  Peptide Sequence Number=SeqID_131078
ggcattagagaccgtgggtgacttcttgacggccctatgtagaggatcggtgcctgacacaagggaagggttgataccatcgtgtgcatttcgttacatgccgaaaagagagaggatagtctcaattggggaatag

SEQ ID NO: 39394 - DNA, 226 bp, Glycine max
  Peptide Sequence Number=SeqID_131079
atgatcggccctctcgatgagtcaatctcttataagggtggacccttgggtactagtacctatcgccttcagaggactacacgtcctcgccttcagagggttgcatgtccttgccttcagaggaatacacgtccttaccttcaaagggttacaggtcctcgccttcagaggactatacgtcctccccttcagaggactacacgtcctcgccttcagagaactacac

SEQ ID NO: 39395 - DNA, 177 bp, Glycine max
  Peptide Sequence Number=SeqID_131080
atggaggttcgtgccttcgacggcacccgccgagagggagttgttccctcaacactccaccaaaagttgaaattcgtagtggaagggcatctggtcatcgtatcaggcgaggaagacatcttggtgagctgcccatcctctatgccttatgtgggaagccgcagaggaattcattag

SEQ ID NO: 39396 - DNA, 276 bp, Glycine max
  Peptide Sequence Number=SeqID_131081
atggttgccgcccagctcgcccaggcgagctcagctcgcccaggcgagctaggttgcttcctccagaagcaaccttctggagggcccaagtgggcctgggtgctatttgcaccaccatttttactaagtacacccccctctgcttttttttgcatgtcctggaatttcacaaattgcctaatgatggatgcaagcacctcacaaggaccaaagaaaagtcgcatgtcatcaagcaaaggtccccggacgaaattagggtatgacaatggggaatga

SEQ ID NO: 39397 - DNA, 444 bp, Glycine max
  Peptide Sequence Number=SeqID_131082
atgtatggctggtctcccacatttttcgtcatgaaagtagacctgtctgtcccctacaaggtcatcgcatgtgtgccgagaaagggaaaacaaattgggaggaacttttggcagagagtccaaaaagcatggaatgccgtggaaagaaaagataaggagcttagaggaagcaacaacggtgttatcagcgactatcataaatggttaaagctaaagatttcaagtggggaagaagctgaagtccctgcggagagagaggaagtgcaagccttgaaagcgaaactggaaaggacgagagtggtcaaagaaaagttcaagatggcagccactagggtcaggaaagagtatgacgagttgagggatgtcaacatggccatgaccgaagctttggagcgagaaacaaagagagcccgaaaagaagagtggggccgaaacaagttctga

SEQ ID NO: 39398 - DNA, 471 bp, Glycine max
  Peptide Sequence Number=SeqID_131083
atggccccagctgcctcaaagggaaaaagaaataggaaaactggccttgactcctttcatgcatgctcccactcggctcggggggatatagctcagttggtagagctccgctcttgcaattgggtcgttgcgattacgggttggatgtctaattgtcccaggcgtaatgggaaagaggaccgaaacatgccactgaaagactctactgagacaaagacgggctgtcaagaacgtagaggaggtaggatgggcagttggtcagatctaggtttcctcatttgggatcctggggaagaggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccaggggtcgcggaccgaccatag

SEQ ID NO: 39399 - DNA, 396 bp, Glycine max
  Peptide Sequence Number=SeqID_131084
atgtgggttttcttaaccggtcgtcaaatcgactgggcccatcttccctttgtcaaagtcaagagatccttctctataggtgcaaatgtagtttcctccttcggttaccgcaaagagagggatggctcttgggtaaagaaggatgctccagtacaagccgctgaagactgctctccatcaccacattctcagagagatgactcatcatctcttttgcacatcattcttgaaaggtttgatggacttcaaacctatgatggtgagaggtttgatgctttggaacgacaagtggacacgcgattcgatgaaatggactcaaggatcacaaaggttgaagaagatgtcaccatcattcgcgactgccttgatttacctccaccaccaccattagtttag

SEQ ID NO: 39400 - DNA, 297 bp, Glycine max
  Peptide Sequence Number=SeqID_131085
atggtgcaaaagaaggacaaggaactcagaggcagtaacaacgggcccatcggcggttaccgtaggtggttgaaagcccacatgcaaggtctggattggctcccgagtttgagaaccactaaaggggtggaagttgaagcaccagaggaagatgaagagctaccaccaaggccttggaacaagagaccaaaagggctcgtagggaagaacatggccggaacaaattccgaggggctctatggggcagtaacagcgagcttaagcttcggagagaggaaagggaccaatcacgagtag

SEQ ID NO: 39401 - DNA, 452 bp, Glycine max
  Peptide Sequence Number=SeqID_131086
atggcgaatcaagaggagtgggtcccgtttgcggatatactagctttgttaatctttggggttgtcctctttccaaacgtggatggtttggtggacctagcctcaattgatgctttccttgcatatcaccatagcaaggagagcctgatggaggcagcacaatcaactgatttcctcgatggaaggaaggaaagggtcttcgcatgggaaagcccgttaaggaaagataaagaacttaggggcatccgtaatggcatcatcggtggttatcatgaatggctaagagttcatacacgagggttagattggctctccaagttgaaaattatcaacgaggagaacttcgaagctctggaagaggataaagaagtccaagctctaaaatcagagctaggaaaggcaagactcgccaaagaaaaattcaagtcagtcgctatagacatccggaaaaa

SEQ ID NO: 39402 - DNA, 654 bp, Glycine max
  Peptide Sequence Number=SeqID_131087
atggcaaagtttgatatcgcagaagctacgaaggtgaagacgaaggttatgtcaacagtagcgacgagatggcggcaatttaagtccacattgactagcaaatttgtgtttgctaagactgaaggtcaacaaacacaggatgttgtgacaaaatatggactagatcctgaagcgtggaaacaatttgaagaaacccgcctgacacctaactgggagaaattgttagaccagaaacgaaaaaggatacaagaggaagcattgttgagtgaaaatccagcaagtgttgatgaacccccatccccaataaaaaggcatgttaagtggaaggttgctcggactagggctgttggcaatatgacatctgactccgcacaggaaattgcagataaaatagtaacgcagggttcgtttgtaccccatggtcggcaagacatactgaacactgccattggccgacctgaccatgggggtcgcgttcgggcagcaggctcaggtgtgactattactcagtactacggaagggcatcaaggacatgcagcagctcatccacgtccatcagccaacaacaactagatgaagttgttgcaaggcttagggaagacatgactggccagattagggaagaattgaggactcaaattaaggaagaatag

SEQ ID NO: 39403 - DNA, 399 bp, Glycine max
  Peptide Sequence Number=SeqID_131088
atggataatgaagagggcgtgcaggaacagatgaaggccgatctatcggctttaaaagatcaaatggcttccatctcggaggataaagccacggcaaccgcctccagtacggttagggaagcagagccggtgctgcaacccgctttaaatccgggccgagacagaaacacagctgtgtttggtcgaaggtatagtccacaagcttatccttatggcttgcctccggacttcactccccgtgccaccccggaagatttaagccaagcccctacttttgaggggcaactcccgccttatgacgactatcccgggcaagacgatgaggaaggagatacccatcttggccccctgctccacctcaaagatccgtccccacatgaactaccccaaccgaacata

SEQ ID NO: 39404 - DNA, 375 bp, Glycine max
  Peptide Sequence Number=SeqID_131089
atgactatgcagaacatgcagtttcagcaagagaccagagcctccattcagagcttaaccaatcagatgggacaattagctacccaattgaatcaacaacagtcccagaattctgacaagctgccttctcaagctgtccaaaatcccaaaaatgtcagtgccatttcattgaggtcgggaaagcagtgtcaaggacctcaacccgtagcaccttcctcatctgcaaatgaacctgccaaacttcactctattccagaaaaaggtaattctgatttgcagaagcagcacattccccctcttccattccctccaagagccccccaatttccacaaaaaaatggaagaggcagagaaagagatcttggaaacatttag

SEQ ID NO: 39405 - DNA, 897 bp, Glycine max
  Peptide Sequence Number=SeqID_131090
atggcccagaagaaaagcactccaatcactcctaccacatccagaaggagcaaagttgcaatcccttccaagaagaggaaagaaatttcctcatctgattctgatgatgatgttgaactggatgtctcgacatcaaagagggccaagaaatcagggaaaaaggtgcctgaaaatgtccctgatgcaccattggacaacatctcattccactccattggcaatgctgaaaggtggaaattcgtgtatcgacgtagacttgccttggaaagagaactgggaagagctgccttggattgcaaggagatcatggacctcatcaaagctgctggactgctgaagagtgtcaccaagttgggagattgttatgaaagcctagtcagggaatttattgtcaacattccctctgacataactaaccgaaagagtgatgagtatcaaaaagtatttgtcagaggaaaacctactgatggagtgatagatattgctgtttctgagcatcaaattgccaaggaaatcactgccaaacaagtccagcattggccgaagaaagggaagctttcagcagggaagctaagtgtgaagtatgcaattctacacaggattggtgctgcaaactgggtacccaccaatcatacttccaccattgccacagaatcttttgctgtcaaattacccattgccttccctactgtattgtgtggcattatgttgagtcagcatcccaatatgttaaactacactgactctgtgatgaaaagagaatctcctctatccctgcattacaaactgtttgaggggacacatgtcccagacattgtctcgacatcagggaaagctgctgcttcaggtgctgtgtccaaggatgctctgattgctgaactcaaggacacatgcaag

SEQ ID NO: 39406 - DNA, 450 bp, Glycine max
  Peptide Sequence Number=SeqID_131091
atgacattgctacttagcaacattctgcccagcgaccgcaatgccaatctccccctgcaaaagtatcagttggtctgtgtcgtcccgacatggggatcgcacccacaaagacacccagtggacccggaaaagtcaaacagggccctggggtttccagctctggttacgggcctctatcagtcctacagggtgcccgtacccccccagcaaggtcacatcatcatagggattgcgcctgctagacacccagtggacctgaagaagtccaacagggtcttggagttgtcaagctctattacgggtctctgtcagttctacggagtgtctgtcgccccagcaaagtcatcagaccccctaccaatcgagctttcatcaagaagtactgcgcccccaggcaggcgcagggcgaaacaccacagcagcattgggatggccggtagcgggcaatag

SEQ ID NO: 39407 - DNA, 537 bp, Glycine max
  Peptide Sequence Number=SeqID_131092
gactacacgtcctccaccgtcagagggctgcacgccctcacctcagaggactacatgtctcgccttgagaggagctgcacgccctcaccttgggtactagttaccttcaccttcagaggactacacgtcctcgccttcaaaagggtcatgtaccttcaacttcagaggactacacgtcctcgccgtcaaagggtcatgactacacgtcctcgccatcagaggactacatgttcccccattttcaaaggggggcatgccctcaccttcagaggattgcacgtccttgccatcataggactacactccctcgccttcgaaaggcgacacgtcctgaacttcagagggctacacgccctcgcctttagaggactacgcgtcctcactttcaggaccagtagtttccttttaacggttcctgggccaccccctgatattggaggagggccaactgtgcgagcacaaccagagagggaggctatcacacagctactatgcatactggggcaagatttcacccgtgccgctgcaaagagaaga

SEQ ID NO: 39408 - DNA, 393 bp, Glycine max
  Peptide Sequence Number=SeqID_131093
atgtcacgatggtatgaccttgctaggggggacgggcaccctgtaggactgacagaggcccgtaacccgagctggaaccccagggccctattaggctccttcgggtccactgggtgtcttaccaaccgatactttcgtagggggagatcgacattgcgatcactgggcagaatgttgctaagtagcaacgtcatctatatcaatgtaagagtggtcatgttggtgcgcatgatccgcactcgtctctttgcagtggcacgagtgaaatcttgcctcggtatgcacagtagctacgcgatagcctcctcctctggttgtgctcgcatagttggtcgccctctaatatcagggggtggcccaggaactgataaaaggaaactattggccccttaa

SEQ ID NO: 39409 - DNA, 454 bp, Glycine max
  Peptide Sequence Number=SeqID_131094
gttgtaccatttatggtgaggctcatgaaacaagccaatgtattcccactgaagaaaacactcaagaaattcattatatgggaaatcaatagcgacaaggaccagagtgggccttcaaacaggccaatccaagaaggacctaacatattccagaggactactaagctggaggagaccttgactcaatttatgcaagtaacaatgtcaaatcataaaagctctgagtcagcactaaagaaccttgaggtccaggcgagacaactggccaagcagatagttgacaagtcatccaacaattttgtggcaaatatagaacagaatcccaaggaggaatgcaaagctgtgatgacaatgagtaaaaggtttgtggaggctgaggatgaggatagtgttgtgcataagaagaaaactgctgacaagaaaggtactgatggcaagaaaaatgaggtgagag

SEQ ID NO: 39410 - DNA, 444 bp, Glycine max
  Peptide Sequence Number=SeqID_131095
atggaatccaatttttcccataattttcgtatccgtaatagtgtgaaaagaaagcctaactccaagaagtgtttaagaatagtggcttctattctcgatggaggcaagggatataactcagcggtagagtgtcaccttgacgtggtggaagttatcagttcgagcctgattatccctaaacccaatgctcgtgggattacacgaggggtgggggggctatatttctgggagcgaactccagtcgaatatgaagcgcctggatacaagttatgccttggaatggaagagaattccgaatcagctttgtctacgaacaaggaagctataagtaatgcaactaggaatctcatggagagttcgatcctggctcaggatgaacgctggcggcatgccttacacatgcaagtcggacgggaagtggtgtttccagtggcggacgggtga

SEQ ID NO: 39411 - DNA, 343 bp, Glycine max
  Peptide Sequence Number=SeqID_131096
atgaccaaatccacctatgatatggtgtgggggaaaacatctgaacaacaacaggatggagtatttaaggagtcgtggaagatcaagctgccacctaaaattactatgttcgcatggaggtcatctattctttcattgtggcaagataactccagtatggtgggagtccttgtcttgggtgggtatgtcgggtgtcttcccaaaacacccaatgcaacactttctccaacatatacatggagtgaaagagggaatgaggacaaggctattaaagaggtttctggtgagaactatattgaacaggctgccatgagagatgttcagaaggcttatgtctatgaac

SEQ ID NO: 39412 - DNA, 59 bp, Glycine max
  Peptide Sequence Number=SeqID_131097
gtttccttatgattgtgtctattgtgaatttgaattttggtgattcaattgctggctga

SEQ ID NO: 39413 - DNA, 540 bp, Glycine max
  Peptide Sequence Number=SeqID_131098
tatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggcaggcgtgctctcggtcctaatggcttcgggcgcaacttgcgtcaaagactcgatggtcacggattctgcaattcacacaagtatcgcatttcgctacgttcttcatcgatgcagagccgagatatccgttgccgagagtcattgtatgtaaatgtgtgtcgtgacgactcccgcgggacaccgtctccgggcccccgggagtcgcacttaacagatttgagttccttggcgcacgaagcgccggggtttgtgtttgtcgcgaggacgaggaggccgggcgcacggggcgccgtggtcatcccctccctcccgacggtagatgaataa

SEQ ID NO: 39414 - DNA, 378 bp, Glycine max
  misc_feature (5)..(5): n is a, c, g, or t
  Peptide Sequence Number=SeqID_131099
atggnttttccagcaaaccggatttcccttgaacatatttgtaccaagaaaaagtggaccaaaaaaagatctactgcaggtgatttgattcccattgatttggagattaacaccacctgtagtgggcgtaattcagagagaatcagaaaattcttgcaggatttagaagcagcaacaactccagaagaagaacttcgatcttctgaggcatcttctagttttcctattgtagggcattctcatatagaacttgttgaagacacaatcatggctgaagagccaagaagagtaaccttggaagattattcaagttcttctgtgccacaatttttcactagtatagcacagccaaatacatatcctccttctttgatatag

SEQ ID NO: 39415 - DNA, 489 bp, Glycine max
  Peptide Sequence Number=SeqID_131100
gaaggcaaggagggagttcttttctcgtgtgggaactaccctaatgttccgttgatagggacgaggggttgtattaactataatcccgcacttgccataagacagttggggtaccccatgaggggagcgccaacagaagaaagtcactcgccgttccttctgagggatctaggcgcgcaaagtctcaaggtgatacaaagagtccacaaggcgtggagaagtccgttgaggaaagacaaggagcttagaggcatccgaaatggcgtcatcggtggttatcatggatggctaagagttcacacgcgagggttagattggctctccaagttgaaagttatcgatgaggagaacttcaaagctctggaggaagatgaagaaggtagcaacaatgagctcaagctacgaagggaggaaagcatagggcagtacaaggaagagttgaaccagtctgtgacctatgaacaaaagctagtggaggattttgcacaa

SEQ ID NO: 39416 - DNA, 372 bp, Glycine max
  Peptide Sequence Number=SeqID_131101
atgtcgcttactgcgctgcgctatttcagccatagcggcggccatcggcctgtgtccggcgggaaccagcagaaagtggcgattgcgcgcgggctgatgacgcgcccgaaagtgttgatcctcgacgagccgacccgcggcgtagacgtgggggcgaagaaagagatctatcagctgattaaccagttcaaggccgacgggctgagcatcattctggtctcttccgagatgccagaagtattaggcatgagcgatcgcattatcgtcatgcatgaagggcatctcggcggtgaattcactcgcgagcaggccacccaggaagttctgatggctgccgctgtgggcaagcttaatcgcgtgaatcaggagtaa

SEQ ID NO: 39417 - DNA, 375 bp, Glycine max
  Peptide Sequence Number=SeqID_131102
atggctgagaagacaaaaaaaaaactggaggaagctgctcaatctggaagcactaagggcgtgattgaccctccatctcccatcaaacgacacatgaagtggaagatggcctgcaccaagaaaactgggcagatgacgtctgaggtagcgaaggaaattgctgaaaagattgattctttggaggagcaggcgtcacggggttcgtttgtcccccatggacgtcaggatctcctggctgctgccattgggcgaccagaacaccctggccatgtgcgtgctgttggagctgatgtggccataaagaaatactttggatcggcttcacgaacctcccgagttcttcctccatggctcctgaagaactcgagcagctga

SEQ ID NO: 39418 - DNA, 249 bp, Glycine max
  Peptide Sequence Number=SeqID_131103
atgccttacacttggctatactcatacggccttgttttggacggtagaacgaacggggagagggggaagggagaagcagggctcgaagaacgagccgtgcaagaacgcggggatatagcaagtaagcagcaagttctcccttcacggccttactcaacaagctacaacaagctcgcgactctaatagaagaaagagacgttggcgaacgcttctgtaaccttagactcgttacgctgttcgcccactga

SEQ ID NO: 39419 - DNA, 146 bp, Glycine max
  Peptide Sequence Number=SeqID_131104
atgggtcgtaagcaacgctctaacctttttgttgatgagctgaggagaactccagaggtgatggcagtgcgtctgttgcccgctgccggccatccccaggctggtgtggtgtttcgccccgcccctgcctggggacgcagtacttc

SEQ ID NO: 39420 - DNA, 714 bp, Glycine max
  Peptide Sequence Number=SeqID_131105
atgaaggccgacagggaggccatgaaagagcaaatggccacaatgatggaggccatgatgagcatgaagaagataatggaagccaatgcggttgcacttgccgctaccagcgctgttgataaggtgaacccgacgcccccatctgggctcaaccaaatgaatcatccaatctcagatattgtaggcaaagatttgggaagtacaggtggcccccattatgtgcaaattcaaaacaagcacgccttcccgctatatggcttgcctgccaactatacaccacccaatgtggcatacactcccaatgagaatgtcaataactccactcccatacttattgagagccaacaacctcaatctgatcatgcacatgtctctcaacccatgggggagacacatgaaattccccaccacaatctagccgacttcgagccttgcctcggatatgccactgaagggcaagcagttggtggtatacccctgcaaaacactttggaggggcctcaatttcgcccccaaccacaacacttctatgggaaaatggtgggttacacaccttcaagctttgtggatttggtcttcgttggcgaaaggatcaaagtgggtctggaaagaggcaaatctgatcaccctgctttgatgaatgcgaaaactggggcaaatgaagaggatgagaatgagggagaaacccttgctatgactaccattcctacacgg

SEQ ID NO: 39421 - DNA, 123 bp, Glycine max
  Peptide Sequence Number=SeqID_131106
atggtggaggctctacaacatcagcacaagaaggtctatgctctgagcggaggagttggaggatgctgggctaagggactcgaaggtcaacgagtctggaacaagcgatgcataaagcagtga

SEQ ID NO: 39422 - DNA, 207 bp, Glycine max
  Peptide Sequence Number=SeqID_131107
ttctttgcctataggtgtggaagaatgattgaagaagtttggggatgtcttccccaaagacaaccctcatgggttacctcctttgagagggatagagtgatgcaatcctacccccctagggcattggatagaagactccaagaagattggctcaaagattcaagagaaggccctagggttctcatgagccttagggtagatttctga

SEQ ID NO: 39423 - DNA, 186 bp, Glycine max
  Peptide Sequence Number=SeqID_131108
atgggggtgcaaatagcacccaggcccacttgggccctccagaatattcctccagaaggcgaaaatctaagccgaggcgcttccgaaacatttccgtacgttttccgtgaggaatctcgcaaaggtttcaccgttcttcgacgttcttcattcgttcttcatcgttcttcgatcttcaacgggtaa

SEQ ID NO: 39424 - DNA, 225 bp, Glycine max
  Peptide Sequence Number=SeqID_131109
atgcataccagggcaagatttcgcccaggctgctgcatggagacgaggatcgcgcctacaagacatccagcggacccgaatcagtccaatagggtcctagggtttccaactctgattacgggtgatgagaatcctgaaactagccaaatacaggctaaaggcccaagtggagaaggacgaaggcccaagtggagaaggataaagcccccaagtggagaaggatga

SEQ ID NO: 39425 - DNA, 231 bp, Glycine max
  Peptide Sequence Number=SeqID_131110
atggctatgcttcactgcttttcaagattctcagagcagaatccctctaggccaaccttggatggggtccagtttccttcccttggccaagggaagaaggaaagccttgtagctagattctctgaagtggaaatgaaatcagcagtatggacaatgtcccctctgttagccagctggtggtttgctttctttatggaacaattcagcttttcatgtggaaaggagaattaa

SEQ ID NO: 39426 - DNA, 195 bp, Glycine max
  Peptide Sequence Number=SeqID_131111
atgggtgacatattaggtgttgatttgcgtcacgagttttctgcagaggctgagcaagaagggcggagacagcgcgcaagaagaaatccggatcgtcaagcccgaagacttaatttatggtatctgattctacttgttatggaattgctttttcaatcaccatttgttattgaatcaccatcgtggacaccataa

SEQ ID NO: 39427 - DNA, 399 bp, Glycine max
  Peptide Sequence Number=SeqID_131112
atgactagaggcaatccatctaacttacaaccctttgatcctgagatagataggtcatttcatagattatttagacatcatttagtaccttttgagcatcctgagcattctgttattggtgattttgaacattatagatttgaacattctgatttagaacattctaagaacatggcacaacctccaccctgtgagaggactctaagggaaatggctgcacctgatttcacctacgagagcttgtgcatccaataccctgatgaggatgtcccatatgttcttaaaactggactgatccatttgcttccaaagtttcatggccttgcaggtgaagacccgcacaagcatctgaaagaattccatattgtttgctccaccatgaaaccaccagatgtctag

SEQ ID NO: 39428 - DNA, 1306 bp, Glycine max
  Peptide Sequence Number=SeqID_131113
cccgattgatattctcaaccgcgccgcaccggtggcgctgctggcgattggtatgacgctggtgatcgccaccggcgggatcgatctgtcggtgggtgcggtgatggcgattgccggcgcgacggcggcgacgctgacggtggcggggcacagcctgagttttattattctggctacgctcgggaccgggctgctgtgcggcctgtggaacggcgtgctggtagcgctgctgaagattcagccgtttgtcgccacgctgattctgatgcggttcgctgtggctgctgccggtaccggtgtggattaccctgctggtggccgtggcggtgtggctgctgacgcgcaaaaccgcgcttggcctgttcatcgaagcgtagccgggctgattgtcgccgccgatattcgcggtgccgatgccaataatgccgggttgtggctggagctggacgccattctggcggtggtgattggtggcgcctcgctgatgggcgggcgttttaacctggtgctgtcgctggttggcgcgctgataatccaagctgaaccaggtggtgaaagcagtggtggtgatgtgcgttctgctgctgcagtcgccgcgctttatcgccatgctgaaggggagacccagtttcccggctttgcctcaacgcgggtgatttgcaacatcctcactgataatgcgtttctcggcatcatcgccgtcggcatgacgtttgtgattttgtccggcggcatcgatctgtccgttggcgcggtgatcgccttcaccggcgtgtttctggcgcgcatcatcggcgactaccatgtcgatccgctgctggcctttgccctgattctggcggcaggcgcactgtttggtgccatgatgggctggctgattgatgcgttaaaaatcccggcctttatcatcacgctctgccgggatgtttttcctgcgcggctgcagctatctggtgtcggagaactcgattcctatcgatcatccgctgtataccacgctgtcgagcctggcgtggaaaattcccggcggcggacgtctcagcctgctggcggtgattatgctggtggtggtagcggggggcattctgctggcgcaccgtacgcgcttcggcatcgtattttccatttacacctcggccggctacgcgctggccgggctgggcgtcgagctggatgccatcgcttaggtggtgattggcggtacgctgctgtcgggaggcgtcggtacggtgctgggcacgctgttcggggtgttgattcagggcgtctgctgacggtgaagtgggaccgccagcagaacgcgccg

SEQ ID NO: 39429 - DNA, 315 bp, Glycine max
  misc_feature (21)..(21): n is a, c, g, or t
  Peptide Sequence Number=SeqID_131114
atggagaacaatgatggtttntggtggctaatggtgactgtgggtgatggagaaactacacgaaagcaaaggcaaaaatgcttaaataagagatgctctcgggaatggaagcttctagcacactccagacatcttctcaaagatcccaatggtcagatcatgtacaagtgtcatgtgaagttgcagaccaaatgtcgagaagatccagcggttaacaaaggctgggaagcgtttttaccgaggaagcttcatgtagctttctctagaagcttcattaagaggcttcttccagaagcttcctcgtggcttctttga

SEQ ID NO: 39430 - DNA, 231 bp, Glycine max
  Peptide Sequence Number=SeqID_131115
atgggggtgcaaatagcacccaggcccacttgggccctccagaatattcctccagaagggtgttgcttctggagtaagcaacctggctcgcctggaaaatctaagccgaggcgcttccgaaacatttccgtaacgttttccgtgaagaatttcgcaaagggttcaaccgttcttcgacattcttcattcgttcttcatcgttcttcgatctcaacgggtccaacggcttaa

SEQ ID NO: 39431 - DNA, 315 bp, Glycine max
  Peptide Sequence Number=SeqID_131116
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacagtttggtgactgcgctctccaaggcagttactcg

SEQ ID NO: 39432 - DNA, 156 bp, Glycine max
  Peptide Sequence Number=SeqID_131117
atggcagaaatcaaccaagggacggatgcaagtggggctagggtcacgaccgaccgatcgttgccccttcccggtgctaaacaagcagagaacgtcgctgcaaggcagcccaatatcctttgtgttcgcagtttcttttactattgtttgttttaa

SEQ ID NO: 39433 - DNA, 413 bp, Glycine max
  Peptide Sequence Number=SeqID_131118
gattcttgaacataagggatgggttgtccatgtgtggttcagaagttgtaaaggattttacaaagataacggaaaactcaagtgggttgcttgagtactggactggtgagggttatcattattggaaaacccgaatgcagatctttaaagaagccatagatttaaagatatgggaagccattgaatttgattcgtttattcctacaatgaatgaaaaatctgacaagaggaatttcaaagagaatgaagaaaagaaaggatacatcacttgggaagataatgccataaattcttcaagtgatttagagaataaaatcataagtctgggtatcatgatgaaagagtatgaaaacggagaagagcaaagtcgatacattgatagcaatttctccataaacacatggcatgcataa

SEQ ID NO: 39434 - DNA, 186 bp, Glycine max
  Peptide Sequence Number=SeqID_131119
atgccaccccagacgcatgagatggctccgaagaagctctccacgaagaggtctagaaaggacgccactagagaaggctctagtgccgccttggagttttatagtcacctgttccggagtgccgagcaccagcagtgcttcgaggccatcaaaggatggtcattccacacggagaggcgtgtctag

SEQ ID NO: 39435 - DNA, 213 bp, Glycine max
  Peptide Sequence Number=SeqID_131120
atggcacgcagcgtgtccgctccgtgcccctattcaacggacctatatgggagggagctaacaaggcttttagtgataattcccaaggtggtcatatctctcttgatggtctctagaggtatcatccccttcgaagaacatattgcagcagtagggactactagcaacaatacattttcaaagaggaaaactctagatgagggttcactgtaa

SEQ ID NO: 39436 - DNA, 198 bp, Glycine max
  Peptide Sequence Number=SeqID_131121
atggtttggcagtctccaaatcaaaaatcaatcttttccaaactcgaattcgattccttggtcacaatatatatcaagatatcaagggcacaccgaagaccggcttacaaaccccaggttttcataaacaaagaaaccgaagcggcggcagagccgcacaggatcggtgaagggagaagagagaaggatgaaaaatag

SEQ ID NO: 39437 - DNA, 107 bp, Glycine max
  Peptide Sequence Number=SeqID_131122
gtgtcgagggaagaagcccagagtttcaagaacatctgaatttgaggtcaaatccttttcaagagggaggggatgatgcaatcctaccccccaagggcattggatag

SEQ ID NO: 39438 - DNA, 300 bp, Glycine max
  Peptide Sequence Number=SeqID_131123
atgaggcaccaaatccctatgataggtggtatgatgaatgtgttgagtggtgaaaccctcttttgtaaaatcactcatgcacccaacatcttcatgatttgtgtacatagggactcattaggtaggaataatcaacatgaaaataaagaaaaaggtatgttttattccattactttccttgactttttaaatagtgatcaagggcttcccatggaccctaagagaataaaggtcattcctgagtggcctactccaccatgtgtagggtaccctagaaatgtaggatttttcagtccttga

SEQ ID NO: 39439 - DNA, 784 bp, Glycine max
  Peptide Sequence Number=SeqID_131124
ggaggggtcgaaggtggtgggttcgaaggagggtgtgtgtgtgggttcgggttcggggtgggaggggtccgcgatgaagaggaggacacggcctttgcagcgatgggaagaattccacttctcatcgcaattgtagcaaagccccttttcacggcggagggcaatttcgtcggggcgtggggggcggaggaaatgtgggaaggggaaggggcgagaacctcccgacggatctccggtgacaacccggagatgaaacagctcagcaagaaaggtggaggaaggccaataacgcggttggctaggcgctcgaactcggtgagcaaaacgggactccaaagcctgcaagaacccggaccaggaagtgatgaatccgttgcggaacatccactggtaccagctaagggcggcgccgtcgaggtagaaggaggcgacagtgatgcgctcctcttccggagtgttctgatagtcaaagagctgggatatcttgaatatccagccaagcgggtcgcggccatcgaagcgtgggatgtccagcttgacgggactgcggtgagagggctgggtactagcgctggaaggggaagggttgggggagtggttggaattaagttggtggagctgggcgaggatggcgtcgaccttgccggaaaggtccatgtatttatcggcgaggtcagtgtgcttgtcgagaagagaagaatggtggatggaaaggcgagagatggcgtcctcaagcctatccgtggtggtcttgcgagtaccatggtcggccatggcacggcag

SEQ ID NO: 39440 - DNA, 114 bp, Glycine max
  Peptide Sequence Number=SeqID_131125
atggcgtgtgaagaaagggttgcctgtggagccgaccgccaaggtaatgatgaaagattcatctttgtgggtgatgggcaaaaaggttgcagtggaagctattggaacatttag

SEQ ID NO: 39441 - DNA, 475 bp, Glycine max
  Peptide Sequence Number=SeqID_131126
atgcctcctaaggtgtctagttcctccggcagaggaggaagatccagtacaaaaggtaaagaagttctactggctctaccagagccaataaccaaaaaggcaactacaacatcttctgggtcacctacccagactgggtcatcgacccataaaggaaaacttgaagggtcattgacccagacaactaccatcaaatctgagtcatcaactcaggaatctccaaaaccaacaacaagcaaacagactgtggctgactatgcctggtcaatacaaactctcttggccttagaagatataggcctcaccaaaataccaaaattagcaaaaaagacctgggcagaaatggcctcagaatcagacgataattctgaaacagatctacaaaaacaaatccaaaaagccaaacagaccaaaatcgtctgtaaccaaaaaccaagccaatcattgactaaacaagaatcaacaccacaacccg

SEQ ID NO: 39442 - DNA, 216 bp, Glycine max
  Peptide Sequence Number=SeqID_131127
atgacattgcgcttagcgccaccctcgcgcttagtgcgagtaagtggatttaagcttagtgccaaccggcacattttgttgggtagaccatggcaatttgacaagaaagcaatccacaatggtctcactaatgaaataaccctcacccatggaagcaaaaagttcaaacttgttcccttgaaccttcacaagtggctggggatcaagtacaaataa

SEQ ID NO: 39443 - DNA, 345 bp, Glycine max
  Peptide Sequence Number=SeqID_131128
gtggaggaatgtatggtctgcttgggccagcaacattttggatggaaggagcaggctgctattgttgttgttgagggcataagcttcaagctgcttaattgctccaggttaaccaaggcatctagtttaccttcaagcttcttagtttcagctgatgaagatgaattcgtggctacttcatgcactcctcaaatgacaatagcatcatttttggcactaaattgctgggagttggatgccatcttctcaattaaattcctggcttcaacaggggtcatgtctccaagggctccacctcaggcagcatctatcatgcttctctccatgttactgagtccttcataa

SEQ ID NO: 39444 - DNA, 973 bp, Glycine max
  Peptide Sequence Number=SeqID_131129
gggtggacccttgggtactagtaccctcaccttcagaggactacacgtcctcaccttcagaggactacacgtcctcacctttagaggactacacgccctcgccttcagagggctacacgcactcgccttcagaggactacacgtcctcgacttcagagggctgcattccctcaccttcagaggactgcacgccctcaccttcagaggactgcacatcctcacctttagaggactgcacgtccttaccttcagaagactgcacgtcctcaccttcagaggactacacatcctcatcgtcagaggacagcacgtcctcgccttcagaggactacatgtcctcaccttcagagggctgcacaccctcgccttcagagggttgcacaccctcaccttcagaggactacacatcctcaccttcagaggactacacgtcctcgccattagagggctgcacgccctcaccttcagaggactacacgtcctcacctttagagggctacacaccctcaccttcagtggactacacgtcctcgccatcagagggctgcatgccctcaccttcagagggactacacgtcctcgccttcagaggactagacgtcctcaccttcctgggccaccctctgatcctggaggagcgaccaattgtgctagcacaaccagagagggaggctatcgcgtaactactatgcatatcggggcaagatttcacccgtgccactgcaaagagacgagtgcggatcggatcgtgcccacaagacacccagtggacccgaaggagcccaacaaggccctggggtttccgactttggttatgggcctctgtcagtcctacagggtgccagtccccccagcaagggatcgcgcccacaagacacccagtagacccggaggagcccaacagggccctggggtttccggctctggttacgggcctctgtcagtcctacagggtgcccgtcccctaagcaag

SEQ ID NO: 39445 - DNA, 576 bp, Glycine max
  Peptide Sequence Number=SeqID_131130
atgccgaccagggatcagcggatgttgcttttaggactccgctggcacccttatgagaaatcaaagtctttgggttccggggggagtatggtcgcaaggctgaaacttaaaggaattgacggaagggcaccaccaggactctttcttgattctatgggtggtggtgcatggccgttcttagttggtggagcgatttgtctggttaattccgttaacgaacgagacctcagcctgctaaatagctatgtggagatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaacacaaaccccggcgcttcgtgcgccaaggaactcaaatctgttaa

SEQ ID NO: 39446 - DNA, 195 bp, Glycine max
  Peptide Sequence Number=SeqID_131131
atggactacaatcaatggacgtatgaccatacgatgtctcaagaagttgatatggattatgaaaataaacaagaatgtggtgtgaatcaaccacctcatgttgattgttcggaagcttttaatacttctcaagtcttcggtacccgagatgatgttttgctgtgggctggatcaattgcccatgaaaacggattt

SEQ ID NO: 39447 - DNA, 752 bp, Glycine max
  Peptide Sequence Number=SeqID_131132
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcttttgttaagagacaacttttagttagtagtgtctcagtttctcttagcctctatgccgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 39448 - DNA, 345 bp, Glycine max
  Peptide Sequence Number=SeqID_131133
atggaagctcccgggaaattaaaatattcattacttttcactcggatgtctgattcaggcacatcagatatcgagacactcgaaattgaacaacggaagctctcgagaaattcaaatggtcataccttttcatacggatgtccgattcaggcacatcacatgtcgagactctccaaatttaacaacgtgcataatatatcgagacgttggttattgaacaacggatgcactcgagaatttcaaatggtcataaagtttcactcggatgtccgattcaagcgcgtaatatatcgagacgctcgaaatagaacaacggaagctctcgagaaattaaaatggtcataa

SEQ ID NO: 39449 - DNA, 574 bp, Glycine max
  Peptide Sequence Number=SeqID_131134
ccgccagttggaagacagcctggcgttgagcgacaggttgaccagatagcggctgtcgtcgctcatcggcgtgctcaacatgtcccgggacacgctgttgttgagaatatcgacactgccgccgcgccgcaggttctgcagcctgaacagccccacggacagggccaagccgtgttgttcatccgactgctggctcaagccggcggcggcgccgatcttggcatagaccggcgtgctggcgttgacccggacatcgatgctgtttttatcgccgtgcaaggtgtaggcgctggtgtggccggtggctacttcgatcgacggttcgatgaatgcgcggccatcgaacagattttgccgccatcccgcctgtacgctggccagcagcgacgtggatcgcacaccctgcgcgtcgatgttcaggttggcgggcagatggtaggtctggttggttctcaagtacttggcgatcacgtcgatgaaggggccgtcctcatggatccaggcatagtacaggccgacgccgcccgtggtgtgcttttccgaaagactgccttccccctgcgcggagcctcgg

SEQ ID NO: 39450 - DNA, 663 bp, Glycine max
  Peptide Sequence Number=SeqID_131135
gatcccgattggctctccaagttgaaagttatcgatgaggagaacttcgaagctccggaggaagatgaagaagtccgagctctaaaattagagctagggaaggcaagactcgccaaggagaagttcaaatcagccgttacacacatccggaaagagtgcaccgagttacaaaaggaaaacgcggccactgcaagagcccttgaacaagaaaccaaaagggcccacaaagaggaacatggccgagagaaattccgaggagcattgtggggtagcaacaatgagctcaagctccgaagagaggaaagagaccggtcacgggtgcatggcatgatcttaaaagaagagttagctgcttgcgcaaggtccaagaggagtttggctcaacacttggaagccacggagcaaagcatgctagctatcatagggcagtacaagggagacttgaaccagtctgtgacccatgaacaaaagctagtggaggattttgcacaagtgtacgccgaaaaagaagcaagagggagggtgattgatgcattgcatcaagaagcgactatgtggatggataggtttgccttgaccttgaatggaagtcaagacctcctgtgtctattagccaaagcaaaagccatggccgaagtgtgtacggcccccgaggagatttaa

SEQ ID NO: 39451 - DNA, 490 bp, Glycine max
  Peptide Sequence Number=SeqID_131136
atggcttccagaaaaagaaagagtattggtacaagacccatagctcagtatgatacaaggaggttccactctttgaggcttggacccgatacacagataatgttcttggaagacatatactacctaagaggaagctccgaagggccttcaccaaagcaagtcagggtcagaggccacttggtgaggattgacgcagacaacctcaacacctttctggagacacctgtggtactagctgaggaaggccaccctgggaagattctcaggaaagatttaacaactcttgctcaggtgtggactgttctctcatactccaacctggctcctacttcccacaccttagacctgatagtagatcgagctaggttgatctttggcctagtctctcagatggacatgaatgtgggaactctcatctttggtcagattacatctatggaccagtctaactcttctagacttgggttccctacttttatcatcgctttat

SEQ ID NO: 39452 - DNA, 621 bp, Glycine max
  Peptide Sequence Number=SeqID_131137
atggcctccatgatgagccatgttaggtatgaaacagctcatgagaagaacgcggccactgccgccgctgtcagttcggctgccgaagcagacccgactctcttggcaactacgcaccatcctccctcaaacatagtaggacggggaaggggcacactggggcacgatggcagccctcacctgggatacaaccgagcggcttacccttatggattgccgcccaactattcaccacccatcttgcaagaagatgcgggccacattgcttctcccgtccatgaaaaagagcctcctcagcagcccgacgaagtccataaagaccctcaagattatgctcggagggatgtcgagttttatcccccgatccccgaagggccggcaccaggcacgttgccccaacccaacatcgcagcatcgccaatagttttgtctatgaactgcccccgtgcgaaggaagaaagggaagctcgcgatagcatgacagaggatctttgcttagtaccgatgttagctatcatcgccaagttcaaagtgccggacttcgacaagtataaagggacgacttgtcccacgaataaccatctcaagatgtactgcccaagtatagatgggcgctcataa

SEQ ID NO: 39453 - DNA, 931 bp, Glycine max
  Peptide Sequence Number=SeqID_131138
atggataagaagatccgcagtcttgtgaatagcattttgaaaaatgcttctgtccctgatgctgataaagatgtcccaacatcttccaccccaaatgctgaagtcctctcttcatccagtaaagagaaatcaacagaggaagaggatcaagccacagaggagacccctgcaccaagggcaccagaacctgctccaggtgacctcattgatctagaagaggtagaatctgatgaggaacccattgtcaaaaagttggcacttggcattgcagaaagattacaaagcagaaagggaaaaacccccattactaggaaagaaatttcctcatctgattctgatgatgatgtcgaactagatgttcccgacatcaagagagccaagaaatcagggaaaaaggtgcctggaaatgtccctgatgccccattggacaacatttcattccactccattggcaatgttgaaaggtggaaatttgtatatcaacgcagacttgctgtagaaagagaactgggaagagatgccttggattgcaaggagatcatggacctcatcaaggctgctggactgctgaaaacagtcaccaagttgggagattgttatgaaagcctagtcagggaattcattgtcaacattccctctgacataacaaacagaaagagtgatgagtatcagaaagtgtttgtcagaggaaaatgtattagattctcccctgctgtaatcaacaaatacctgggcagaccaactgaaggagtggtggatattgctgtttctgagcatcaaattgccaaggaaatcactgccaagcaagtccaacattggccaaagaaagggaagctttctgcagggaagctaagtgtgaagtatgcaatcctgcataggattggcactgccaactgggtactcaccaatcatacttccactgttgccacag

SEQ ID NO: 39454 - DNA, 1566 bp, Glycine max
  Peptide Sequence Number=SeqID_131139
atggcgtcgtcactgtcgcctggcgcgcggctcctgatcgccctgatacgcgtttatcaacgcgccatcagcccactgctgggacctcattgccggttccatcccacctgctcgcagtatggggtggaagctgtacgccgcttcggcatgttaaaaggcagttggttgacgattaaacgcgtattaaaatgccaccctttgaacccgggtggcgacgatccgacggaccacgctccgcagccacagcagacccagaccacgcagaacacaagcagcgcagcgggtgatgccgcctcttccggcgtgccggctagcggccagggcaaaacgatcaccgttaagactgatgtcctgtcactcaacattaatacccgcggcggtgatatcgagcaggcacagctgctgacttacccggacaaactgggttcagacgcgccgttccagctgctggaaaccactccggccttcgtttatcaggcgcagagcggcttaaccggccgtaacggtccggataacccgaacaacggcgcacgtccgctgtataccgcttcccaggatcacttcgagatggccgatggccagaccgagctgcgcgtgccgctgagctggaccggtgagaacggcgtggtttacaccaaaaccttcgtgttcaaacgtggcgaattcgcggttaacgtcgactacaacatcaataacgcctcgcagcagccgctggaagtggcgatgtttggtcagctgaagcagacgatcgatctgccgaagcatcgcgataccggcagcaataactttgcgctgcacactttccgtggtgccgcttactcgaccagcgatgcgaagtatgaaaaatacaaattcgataccatcgctgataacgagaacctgaacaccaccaccagcaacggctgggtggcgatgctgcagcagtactttgcgaccgcatgggtgccgcgcactcagggtaacaatacgctgtacaccagcaatctcggcaacggtgtggcggcaatcggctataagtcggcgcctgtgaccatcgccgccggcgcgcagcaggatctcggtgccaccctgtgggtcggtccggaaatccaggacaaaatggccgctatcgcgccgcacctcgatctgaccgtggatacggctggctgtgctgctgaagttcctgcacagcttatcggtaactggggcttctccattatcgttatcaccttcatcgtgcgtggcatcatgtacccgctgaccaaagcgcagtacacctcgatggccaagatgccaaagcaagccggagtcggaggcgcctgtataaggctggagaaagtcgaacctgggcaggctgttgccgatctggttattgatgccagtctccgagcccgcccgctgtcaactctgctgtccagcttactcgacctgcgcatctatgtggaagcggcgattgattttccggatgaggagatcgacttcctttccgacggcaaaatcgaagcgcagctgaatgcggtgatcggcgatctcaacggcgtgcgcgccgaagcgcgtcaggctggtgattcgcagcctgctgcgtga

SEQ ID NO: 39455 - DNA, 1569 bp, Glycine max
  Peptide Sequence Number=SeqID_131140
atgtcagttgaatgtatcttttttgattgcgatggcacgctggtcgacagcgaagtgatctgcacgcagtcctacgtcaacacctttgcccgttacggtatcgaactctcgctgcagcagatgtttgagcagtacaaaggggtgaagctttacgacatcatccgcgatgtgacggcacagcatcaggtaacactgccgctggctgaggtggagagtgcctaccgcgcggaagtggcgcgcctgtttgatcttgatctgcagccgattgccggcgccagagcgctggtggagcgcgtgaaggtgccgatgtgcgtggtgtcgaacggtacggtgaagaaaatggagcattcgctggggctgaccggcatgctgccgtatctgagcggacgcctgtacagcggctatgacattaatcactggaagccggatccggagctgatgtaccacgcggcggaacagatgcaggtgccgattgaaaagtgcattctggtggatgattcagaggctggcgcgcgggctggcatcgccgctggcataccggtgttttactactgtgccgatgcacacaatccggtgattgatcacccgctggtgacgcgttttgacgatatggcgcagctgccagcgctccttctcccgccagcgggagaaggggctgatcgagcggggttgaatccaaaattcgcccgaacaaaccaacagaatgccgaggctggcctttgctggggcgcgatcggcaaacagcagtttaatgcgcgcggaaaaggagagctgcggggctttttccacatggcgggtgaaagcttccggctcgcccatgctgcggcgaatcacaaacgacaccagcgccggcagcaggccaaccaggaacataccgcgccagccaatcacgctcagcagcggcggcgtgataaaggccgccagcaatacgccgagctgccagccgataccgacccacgccgaggcgcggttgcgcttctccttcggccaggcttcggcaatcagcgccatgccgatgccaaactcaccgcccagccccatgccggccagcgtacgatacgccagcagatcccagtagccctgcgccacggcgcacagcccggtaaacagcgagaacatcaggatcgtcacggtcagaatgcggatgcggccgtagcgatcgctcagatgaccaaacacaatgccgccgaccaccgcgccgatcagcgtccaggtcaccagcgaaccggcctgcgacgcatccagcgccagcgacacgctgatcgccggcagcataaagcccagaatcagcagatcaaatccatccatggcatagccgctgatggcagccaccatcgctttcgccggcgtaacggcggttttgttgttatttgcagaggacataaaacagcacctggcagaaaaatgtgcgccaagtataaagagagcggcaggttgagaacaggcagaaatcaagcgcactgcctgtcagcctcagcgctaacaggcagtcatcacgtcaatcaggagggtttattgctgccgtcgtcgcccgacagcagttcatccagcttatcaccgcccacgtga

SEQ ID NO: 39456 - DNA, 969 bp, Glycine max
  Peptide Sequence Number=SeqID_131141
atgtcgacaagcgcaatgagcgtggtgatcctcgccgctggcaaaggcacccgcatgtattccgatctgcccaaggtgctgcacagcctggcaggtaaaccgatggtgcaacacgttattgatgccgctaccggcctcggcgcacagcaggtgcatctggtctacggccacggcggtgaattgctgcaggagaaactggcgcataacccgctgaactgggtgttgcaggcggagcaactcggcaccggccatgccatgcagcaggcggcaccgttcttcgccgatgacgaagatatcctgatgctgtatggcgatgtcccgctgatcgcccaggaaaccctgcagcgtctgcgcgacgccaaacctgctggcggcatcgggctgctcaccgtggtgctggataaccccaccggctacggacgcatcgtgcgtgaaaacggcaccatcaccggcatcgtggagcaaaaagatgcgtcagccgaacagctgaagattcaggagatcaacaccggcatcctgattgccaacggtgccgatctgaagcgctggctggcgcagctcaacaaccacaatgcgcagggtgagttctacattaccgatatcatcgccatggcgcatcaggaaggccgcgtgatcaacgcagtgcacccggcgcgcatcagcgaaaccgacggcgtgaacaatcgtctgcagctttccactctggagcgcacttatcaacgcgagcaggcagaaaagctgctgctggctggcgtcatgctgcgcgatccggcgcgcttcgatctgcgcggtacgctgcagcacggtcgtgatgtcgatattgatactaacgtgatcattgaaggcaacgtcacgctgggccatcggatgccacgctggccgccgcctgcaccgtcgggccgtttgcgcgcctgcgtccgggcagcgaactggccgaacaggcgcacgtcggcaacttcgtcgagatga

SEQ ID NO: 39457 - DNA, 1398 bp, Glycine max
  Peptide Sequence Number=SeqID_131142
atggcagctggaaagattgtccagattatcggcgccgtagttgacgtcgaattccctcaggacgcggtaccgcaggtatacagcgctctcgaggtaaaaaatggtgatgctcgtctggtgctggaagttcagcagcagctgggcggtggcgtggtgcgtaccatcgccatgggttcttctgacggcctgaagcgcggtctggaagtcaccgacctgaaaaaacctatccaggttccggttggtaaagcaacactcggccgtatcatgaacgtgctgggtgagccaatcgacatgaaaggcgacctgaaagaagaagacggcagcgctgtagaggtttcctctattcaccgcgcagcgccttcttatgaagagcagtcaaactcgcaggaactgctggaaaccggcatcaaggttatcgacctgatgtgtccgttcgcgaagggcggtaaagtcggtctgttcggtggtgcgggtgtgggtaaaaccgtaaacatgatggagctgatccgtaacatcgcggctgagcactcaggttattcggtctttgccggcgtgggtgagcgtactcgtgagggtaacgatttctaccacgaaatgacggactccaacgttatcgataaagtagcgctggtgtatggccagatgaacgagccgccgggtaaccgtctgcgcgtagcactgaccggtctgaccatggcggaaaaattccgtgatgaaggccgtgacgttctgctgttcatcgacaacatctaccgttacaccctggccggtacagaggtttctgcactgctgggtcgtatgccatcggcggtaggttatcagccaacgctggctgaagagatgggtgtgctgcaggagcgtattacctccaccaagaccggttcaatcacctccgtacaggccgtttacgttcctgcggatgacctgactgacccgtcaccagcaaccacctttgctcacttagactcaaccgttacgctgagccgtcagatcgcgtcactgggtatctacccggccgttgacccgctggactctaccagccgtcagctggatccgctgatcgtcggtcaggagcactacgacgtcgcgcgtggcgttcagtcgctgctgcagcgttaccaggagctgaaagacatcatcgccatcctcggcatggacgagctgtctgaagaagacaaactgctggtggcacgtgcgcgtaagattcagcgcttcctgtctcagccgttcttcgtagcagaagtcttcaccggttctccgggtaaatacgtgacgctgaaagacaccatccgtggcttcaaaggcatcatggaaggcgaattcgaccacctgccagagcaggcgttctacatggtcggcgcgatcgaagaagctgtcgaaaaagcgaagaaactgtaa

SEQ ID NO: 39458 - DNA, 345 bp, Glycine max
  Peptide Sequence Number=SeqID_131143
atgataaatggagaagatgaatataataatagaggggacccctatgggtacatagattacattcaactcttggaaaaaactaaccgaccattgcacgagggacaccgaacaagagaacgagggagaagagagacacccaaagaattcaggcggttagtccttggcgaattctttttggcaaagggagaagagaatgaaaagatgaatagcacaagttttcaaggtttagaaaaccagaaaacttcagaaagcttttggttcaaagaagaagaagaagttcaaagagattcaaggcttgtaaaggattgtaagagattgattggaaaagtattcaagattgaatga

SEQ ID NO: 39459 - DNA, 380 bp, Glycine max
  Peptide Sequence Number=SeqID_131144
gttacgaggaaattatcatgaatccaattatttctgctgcttctgttattgctgctgggttggccgtagggcttgcttctattggacctggggttggtcaaggcactgctgcagggcaagctgtagaagggattgcacgacaaccggaggcagagggaaaaatacgagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 39460 - DNA, 820 bp, Glycine max
  Peptide Sequence Number=SeqID_131145
aatagtccttgagttttatgccaatgcttggccaacagaggagggcgtgcgtgacatgagatcctgggtaaggggtcagtggatcccgtttgatgccgacgctatcggccagctcctgggatatccgttggtgttggaagagggccaggaatgtgagtatggccagaggaggaaccggtctgatgggttcgatgaggaggccatcgcccagcagctatgtataccggggcaggattttgcccggactgctgcagggaggcgagtgcgaatcatgcgcaccaacatgaccaccctgacccagatatggatgacgttgctcctcagcaacatcctgcccagcgatcataattccgacctccccctgccgaagtgtcagctggtgtacgccatcctgacgcggatgagcgtccatgtggctcagttaatcgctgatgccatttatatttttgcagtccccgttgcacctaccaaggtaattcggccgcccatcacccgggcttttattgagaagtactgtacccagagacaggctcagggtgatgctccacaggccgcaggcgcgccaccaccacctcatcaggctggccaggctggggcatttgacatggagcagtatttacggcattttgggttcgccagcaggggggccaaccaccgagcacataccagttcagggcagaggttacgtggccccggagattggcccgaggccctagcgggaaaggcgcccccagaagctcccggcgatggagaagaggcccacgaggacgaggagatggccgatttgcttgacttcttgggagggagtggagatacatga

SEQ ID NO: 39461 - DNA, 330 bp, Glycine max
  Peptide Sequence Number=SeqID_131146
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 39462 - DNA, 513 bp, Glycine max
  Peptide Sequence Number=SeqID_131147
atctactccaggagaattagtaatgtgtcaggagaaattggtacaagaagccgtggatacacttcttgataatggaatccgcggacaaccgatgagggacggtcataataaggtttacaaatcattttctgatataattgagggcaaagagggaagatttcgcgagactctacttgggaaacgggttgattattcgggtcgttctgtcattgttgtaggaattgctaagagtaaaattcgggaaaaagaaccgattgtatgggaaatacttcaagaagttatgcagggacatcccgtattgctgaatagagcgccgactctgcatagattagactttgatggggatcaaatggctgttcatgtgcctttatctttagaagctcaagcagaagctcgtttacttatgttttctcatacgaacctcctgtctccggctattggggatcctatttccgtaccaactcaagatatgcttattggactttaccatattaacgagcgggaatcgtcgag

SEQ ID NO: 39463 - DNA, 252 bp, Glycine max
  Peptide Sequence Number=SeqID_131148
atgccacccaccaggcaccctctagacccggataagtctaacagggccctggggtttccggcattgatcatgggcctctgccagtcatttggggttcccgtcacccgtagtaaggtgatccgaccgccgatcacccgggccttcatcgagaagtattgcacacctaggcaggcgcagggtgatgcacctcaggccgcagatgtggcgtccctaaataatgactggtttaataaaggaaaattatcactatag

SEQ ID NO: 39464 - DNA, 496 bp, Glycine max
  Peptide Sequence Number=SeqID_131149
atgggcccttgcagccgatcagacggtgtcgaggacactgtctatgagaaatacggcattagcaaggaaaagtgggcccagttttgccagactcgcagagacctttcttgggaggatgtgcgcaagaaagcacaggccatccagaagcagaatactgccccccacgttgtgtctcgtgggggttatgattatttggagcagaagctcctggctgagaagatgaagaagaagctggaggaagctgcacagtcaggaagcgttgatggcgtcatcgaccctccatccccggtcagacgccacgtgaagtggaagatggtccgcacgaagaagacaagggagatgacgactgaggccgcaaaggaaatcactgtgaagattgattcgtttgaggagcaggccacacagggatcgttcgtcccccatggacgtcaggatgttctcgctgcttctattggacgtccagagcaccctagacgtgtccgtgctgctggaaccg

SEQ ID NO: 39465 - DNA, 90 bp, Glycine max
  Peptide Sequence Number=SeqID_131150
acccttgggcacggtaacaaaaagtggggtggtcgacaaaagcagggcttttgctcctatatttgtgatgaggaactcagacctacatag

SEQ ID NO: 39466 - DNA, 244 bp, Glycine max
  Peptide Sequence Number=SeqID_131151
caccactcattgagttagtgaggaaccatgttccctcatgggaagatgcccaggaaatgggtgtggagggaagaagcccaaagtttcaagaacctcggcatttgagactccaagaagattgggccagagatgcaagagaaggccctagggttctgttcgatggcaaatggtcaatgtgttggtcttcctactgggcgactgatgctactaaagatgtttttctacctaacaatattcctctatt

SEQ ID NO: 39467 - DNA, 276 bp, Glycine max
  Peptide Sequence Number=SeqID_131152
atggactggtgtgagcagaattttgcacaagtgcagaaaaatgcttgtgtgtggttggctgtggaaagtctagtgcagaacgagttctggatgtttgctagtagatccccaacgcttgggaggattgatggggacccggtgttgagagaaacgaggatatgggctacgtgggagtacgtgagctcagttggaggtgggcaacaggggatggtgggtttatgcgcgcattgtggatgtggaaaacttgttgtgcaccatcgcccgaccgccacctag

SEQ ID NO: 39468 - DNA, 297 bp, Glycine max
  Peptide Sequence Number=SeqID_131153
atgggaggaactgaaaggattttagtgataattcccaaggtggtcatatctctctttatggtttctagaggtatcatccccttcgaaaaacatattacggcagtagggactaccagcaacaatatgttatcaaagagaaaaactctagatgagggttcactattatcaagcaagtcggagacccaacatgaccataaattcacctctactccttatgttcccatggacccgggtatagggccccttttcaactcaccgtgtgtgcaaaaaggtgttggtgttgcgtgcatcaaatga

SEQ ID NO: 39469 - DNA, 755 bp, Glycine max
  Peptide Sequence Number=SeqID_131154
atggtgaaagttggaacctcttacgtgccgatcaacgtctcattttcgccaaaagttggcccagggcttcccggtatcaacagggacaccaggatttatttattctgcgaatggcttctgtttctatcagctgtccctcctgttcagctactgacggggtgggtgcgtaacggcaaaaagcaccgccggacatcagcgctggcaagtgtagcggtcaccgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcaattgaagtcacagtgttgaacattccctttcacagagcagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 39470 - DNA, 453 bp, Glycine max
  Peptide Sequence Number=SeqID_131155
atggcaaagtttgacccagatatagtcctggagttttatgctaatgcttggcccacagaagagggagtgcgggacatgcagtcatgggtgaggggtcagtggattccctttgacgcagatgccctcagccagttcctgggtgacccgctagtgttagaggaaggccaggagtgcgagtttagtcagaggaggaacagggccgatgggttcgacgaagaggccattgcccagctattatgcataccgggtcaggatttcgctcggaccgctgcagggaggcgggtgcggatcatgcgcaccagcatgaccaccttgacccagatgtggatgacattgctgctcggcaatgtcttgcctagtgatcataactccgaccttcctctgccgaagtgtcagctggtatgccacccaccaggttccctctatacccgaataagtctaacagggccctag

SEQ ID NO: 39471 - DNA, 286 bp, Glycine max
  Peptide Sequence Number=SeqID_131156
tattatggcacgttctccagacaagataaaagcttcaatggctcaaaagaaactcttaaacttagtgtgaggattagtgatctatggtttattagcacgcctaaaaaatctgagcaagatgaaatggtgttcgtggactccgattgtgttctaggggacatcccttttagaaaatacaggtttgttggatttgcggatgttgtggctgaccagtttgaacctggactattggttgatgttattggtgttgtggaggaggttgtctttcgccaagtttcaggaaaag

SEQ ID NO: 39472 - DNA, 327 bp, Glycine max
  Peptide Sequence Number=SeqID_131157
atggctaagtatgacccggaaatagtcatggaattctacgcgaatgcatggcccaccgaggaaggagtcagggataagagctcttgggtgtggggccaatgggtcccctatgatgaagatgccatcaatcaattcttggggcatccattggtcctggaggaggggcagcgttacgagttcagtgaaatgaggagccaggcttcgggattttataaggaggctatagaccaattgctgtgcattccgggacaagactttgcacgaagcgtgacaggaaggtgggtgcggatcatgcgcactagcatgaacaccttgacacagatctga

SEQ ID NO: 39473 - DNA, 255 bp, Glycine max
  Peptide Sequence Number=SeqID_131158
atgggtaaagtagtgaaggtgcaagagcagatgaaggccgacatggaggtcatgaaagagcaaatggacacaatgatggaggccatgatgagcatgaagaagataatggaagccaacgcagttacagttgccgctaccagcactgttgctaaggtgaactcgacgtccccatccggcatcaaccaaatgaatcatccaacctcaaatatgctaagttctagcttctcatctcaaggaggtgagcttagctattag

SEQ ID NO: 39474 - DNA, 291 bp, Glycine max
  Peptide Sequence Number=SeqID_131159
atggaacaagaaggtggattatgtgatgggaaagaagttgatcagtttcatcaaccgtctggtagtaatgaggttgccattgctaatgaggatggtatttcatatggatcagagctcatagaggttgacaaagtaaaaataaatcaagatggtgctctctgggatattttttggagacaggatgtccctaagttgcaggaatatctgaagaagaatttcagagagtttaggtatgtccattgctgtcgtttaaagcaggattgggtgaaggatcaagctgctaataaatag

SEQ ID NO: 39475 - DNA, 450 bp, Glycine max
  Peptide Sequence Number=SeqID_131160
atggccccgaggaaacttgcctcaaagagatccaggaaggataaagcggccgaaggaactagttccgctcccgagtatgatagtcaccgctttaggagcgctgaacaccaacagcgcttcgaggccatcaagggatggtcatttctccgggagcgacgcgtccagctcagggacgatgagtataccgatttccaggaggagatagttcgccggtggtgggcatcactggttacccccatggccaagtttgatccagacatagtcctcgaattttatgccaatgcttggcctacggaggaaggcgtgcgacatatgaggtcttggataaggggtcagtggatcccgtttgatgccagatgctatcggccagctcctgggatatcctttagtgctggaagagggtcagagtgcgagtatggccagaggaggaccggtccgatggttcgatga

SEQ ID NO: 39476 - DNA, 636 bp, Glycine max
  Peptide Sequence Number=SeqID_131161
atgtttggatcctctagttctacaggggcgaaacgtccttcacgcagagatgccaggacttcctgctggttattaccgatgctggaaacgatgcccaagccagtaatcactgcacgtttcattcaatacctctccattttgtgtataaatttgcgccttctggcacacatcgttaagatcgcgctacgccttgtgattcgagtaacttacgtgaaacaaaacgctatacaacccgccaacctcgaattcaacgctgagggtacacctgtttcccgagattttgatgacgtctatttttctaatgataacggactcgaagaaactcgctatgttttcctcgacggaaaccagctcagcacccgcttcccggagcatccgcggagcctgtttgtggtcgcggaaagcggattcggcaccgggctcaattttctgaccctctggcaggcgtttgaccagtttcacgctgcccaccctgaggctacgctacaaagattacatttcatcagtttcgaaaaattcccgctcaccgagcacgatctgcgccaggcccatcaacgctggccggagctccgcccccctgggctgaacagcttcaggcgcagtggccgcctcacattgggggctgccaccgtctga

SEQ ID NO: 39477 - DNA, 111 bp, Glycine max
  Peptide Sequence Number=SeqID_131162
atgaagaatattccagatttgggagttatcttcatgtttgaggaaggtcgacaaaagcggggctcttgctcctacgtaccctccatcgaagaggaaatcagacctacgtag

SEQ ID NO: 39478 - DNA, 378 bp, Glycine max
  Peptide Sequence Number=SeqID_131163
atgaagagagaatctcctctatccctgcattacaaattgtttgaggggacacatgtcccagacattgtctcgacatcagggaaagctgctgctttaggtgctgtgtccaaggatgccttgattgctgaactcaaggacacatgcaaggtgctggaagcaaccatcaaagccaccacagagaagaaaatggagctggaacggctgatcgaaagactcacagacagtggcattgatgatggtgaagcagctgaggaagaagaagatccagctgaggaagaagaagcagctgaacaagaagaagaggcagctgaggaagaggaagatgcagcagaggatacagattcagatgatgatgatgattctgaagccaccccatga

SEQ ID NO: 39479 - DNA, 475 bp, Glycine max
  Peptide Sequence Number=SeqID_131164
ctactgacggggtggtgcgtaacggcaaaagcaccgcccggacatcagcgctggcaaagtgtagcggtcacgctgcgcgtaaccaccaccacccgccgcgcttaatgcgccgctacagggcgcgtcccattcgccattcaggctgcgcaactgttgggaagggcgatcgtcatgacgttgtaaaacgacggccagtgaattgtaatacgactcactatagggcgaattggagctccaccgcggtggcggccgctctagaaatagtggatcccccgggctgcaggaattcgattccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccg

SEQ ID NO: 39480 - DNA, 207 bp, Glycine max
  Peptide Sequence Number=SeqID_131165
atgggggtgcaaatagcacccaggcccacttgggccctccagaatattcctccagaaggctgttgcttctggaggaagcaacctggctcgcctgccgaggcgcttccgaaacgtttccgtaacgttttccgtgaggaatttcgcaaaggtttcaaccgttcttcgacgttcttcattcgttcttcatcgttcttcgttcttcatcgg

SEQ ID NO: 39481 - DNA, 648 bp, Glycine max
  Peptide Sequence Number=SeqID_131166
acaggatatgccttatttgcagatggaagacccgttgatatggtcttcaatccactaggggtaccttcacgaatgaatgtaggacaaatatttgaatgctcgctcgggttagcaggagccagtaaacaaacatctaatccatggatatttgaacccgagtatccaggaaaaagcaaaatctttgatggaagaacagggaattcttttaaacagcctgctataatgggaaaaccttatattttgaaattaattcatcaagttgatgataaaatacatggacgttccagtggacattatgcacttgttacacaacaaccacttagaggaagggccaagcagggaggacaacgggtaggcgaaatggaggtttgggccttggaaggatttggtgttgctcatattttacaagagatgcttacttataaatctgatcatattaaaactcgccaagaagtactcgggactacgatcattggaggaacaatacctaaacctacagatgctccagaatcttttagattgctagttcgagaattacgatctttagctatggaactgaatcatttccttgtatccgagaagaacttccggattcataggaagggaagcttaaattggactgaatcagaatttttattctatgattga

SEQ ID NO: 39482 - DNA, 312 bp, Glycine max
  Peptide Sequence Number=SeqID_131167
atggggatcgcacccacaagacacccagtggacccggaaaagtccaacagggccctggggtttccagctctggttacgggcctctatcagtcctacagggtgcccgtacccccccggcaaggtcacgtcctcatagggatcgcgcttgcaagacacccagtggacccgaagaagtccaacaggttctacggagtacctgtcacctccagcaagggcatcaggccccctaccaatcgagctttcatcaagaagttctgcgtctccaggcaggcgcagggcgaaacaacacagcagcctggggatggtcggtag

SEQ ID NO: 39483 - DNA, 150 bp, Glycine max
  Peptide Sequence Number=SeqID_131168
atggttccccacatgtcatcgggcccgccggctttggatgacaaaggtgcagatgaccataattgtctctgcgtgccatcggacatgactgtgtttgaatggcgaaaaggtgagcggaatgaccataatttgtctccgcatgtcacatga

SEQ ID NO: 39484 - DNA, 106 bp, Glycine max
  Peptide Sequence Number=SeqID_131169
agttttctgcctttgccctgttttcttggctgtgatagtgtcataccctaatttcgtccagggacctttgcttgatgacatgcgacctttctttggtccttgtgag

SEQ ID NO: 39485 - DNA, 395 bp, Glycine max
  Peptide Sequence Number=SeqID_131170
atgggtcaacttcaacggcaagccttccgcaaagcctatggtaagatttgggacctagctagggtagaagtctccacagagtccattgcctcccttgcccagtattatgataatccgttgagaaaatgtttggaggcaaaagcaagaatcttggcaggtagaaatgaatgggccccgttcatagccgttctcgcactgttgatctttggaggagtcctcttttcgaatgtggatgggttggtggacctggcagcgatcgacgcttttctcgcctatcataaccacaaggaaagcccggttgtcgctatgctagccgacctatatgacacgttcgaccggggatgtgaaaagagcagcgcaagaattgtttgttgtgcactggctctctatgtgtg

SEQ ID NO: 39486 - DNA, 137 bp, Glycine max
  Peptide Sequence Number=SeqID_131171
gtgttgagggaagaagcccagagtttcaagaacctatggatttgaggtcaaatcctattcaagggggaaggaatgatgcaatcctacccccaagtgttggatcaagtggcctcagaataattaagaagggggggtga

SEQ ID NO: 39487 - DNA, 343 bp, Glycine max
  Peptide Sequence Number=SeqID_131172
cgaccgaccgaagccccggtgaacggcgcccgtaactataacggtcctaagcttaggtggagggcaaagaaggcctccttctggggggggccagagccatcagtgagataccactctggaagagctagtattctcaccttgtgccaggacctacgggccgagggacagcctcaggcagaagggagcttgactgcaagacccacccgtcgagcagggacgaaagtcggccttagtgatccgacggtgccgagtggaagggccgtcgctcaacggataaaaggttgggctgttcgcccattaaagcggtacgtgagctgggttcagaacgtcgtgagacagttcg

SEQ ID NO: 39488 - DNA, 321 bp, Glycine max
  Peptide Sequence Number=SeqID_131173
atgatggaggtcaacatggctactgtcgttcccgcaagtactgccactgaggtggacccgactcacctatctggcctcaatcaagtaaatcatctagtctcagatatggtaggtcagggaggtgatgcattgggaagtacgggcggcccccattttgtgcaggtccagagcaagcaatccttcccatcatatggcttgcctcccaactatacaccacccaatgttgcacactctcccgatgagaatgttgatactctgctcccatacccattgagagccaacatccccaatctggtcatgcacaggtccctcaacccatga

SEQ ID NO: 39489 - DNA, 76 bp, Glycine max
  Peptide Sequence Number=SeqID_131174
atggtggggtatgaaccttcaagctttgcggatttggtcttcaccgatgaaaggatcgaagtgggtctgaaaagag

SEQ ID NO: 39490 - DNA, 1005 bp, Glycine max
  Peptide Sequence Number=SeqID_131175
cattaaggagttggggcggttgatgggacctctccaaatgcaagccttccgcaaggggtacggaaagattttagatttgaccatagcagagatatccacagaagccgttgtatcactcacccaatattatgaccagcctttgagatgcttcacatttggagacttccaattagtttcgactgttgaagaatttgaggaaattctaggatgtcctcttgggggaaggaaaccgtatcttttctccgggtttcttccctccttgagcaaaattgcagttgcggtcagggattcggcgagaggattggatcgtgagtgggtcccgtttatggatgtattagtattgctaatctttggggttgtcctctttccaaacgtggacggtttggtggacctagccgcaattaatgctttccttgcatatcatcgtagcaaagaaagcccgatggtagctatcttggcagatttatttgacacatttgaccgaagggcatccatgtccgctccgaagccatcgctcgtgtgtccgaaaaagagaagagtagatttggacccaacatttggctgggatatgaggcagaacaatcagcctggtttcctcgatggaaggaagaaaagaagggagtcctcttctcatgtggggactaccccaaacatcccgggagcaccggcggaagagagcctctctcctttccttgtgagagattttggcacgcaaagtttcaagattatacaaagagtacataaggcgtgggaaaacccgttaaggaaagataaagaacttaggggcatctgtaatggcatcatcggtagttatcatgaatggctgaaagttcgtacacgagggttagattggctctccaagttgaaaattatcaacgaggagaacttcgaagctccggaagaggatgaagaagttcgagctccaaaaacagaactaggaaaagcaagacttgccaaagaaaaattcaagttagtcgctacagacgtccggaaagagtgtgccag

SEQ ID NO: 39491 - DNA, 342 bp, Glycine max
  Peptide Sequence Number=SeqID_131176
atgtaccctctcttgttctcagtcaaacccaaggaatgggaagaatcaaaagaattctcagactgtgtcgttttgaattctttgacaagggagaagggagacacaaaagaattgacgcggttagtccttcgttcttttggaaaaaggagaagagagacacaaaaagaattgaggaagttcgtccttggtgaattctttttggcaaagggagaagagaatgaaaagatgaataacacaagttttcaaggtttagaaaaccagaaaattcagaaagcttttggtacaaagaagaagaagaagttcaaagagattcaagagattcaaaggcttgtaaaagattga

SEQ ID NO: 39492 - DNA, 231 bp, Glycine max
  Peptide Sequence Number=SeqID_131177
atgttggcaacccattacggataccgagcgacggccagaaaaccagcgtcaaattgcttcttcacttcttcttttatcttcaaggatgtttcgggcttcatccttctcagtttctgctttaccggggaacactcgggatttagaggccccatttcttggtcctcacgggcgaccatcctttctaattctgggggaagtcccacatcctcgttcccttcatcttccgtttga

SEQ ID NO: 39493 - DNA, 215 bp, Glycine max
  Peptide Sequence Number=SeqID_131178
atggggaaggctgttgcttctggaggaagcaacctggctcgcctgggcgagctgggcggcaagcacctcctctatttcgctataaataggggaggaagtgaagaagaaaaggccgaggcgcttccgaaacgtttccgtaacgttttctatgaagaatttcgcaaaggtttcaaccgttcttcgttcgttcttcatcgttcttcgatcttcaacgg

SEQ ID NO: 39494 - DNA, 372 bp, Glycine max
  Peptide Sequence Number=SeqID_131179
atgatacgcggagataccttacggttatccgcaccctttagtcatccagaggcggcgggcccgatgacaagcagagaccaagtttggtcattctgcacccttgtgtcatccagaggcggcgggcccgatgatacgcggaaatacccgagtgacataacgcttgatagcatgcagagtgtcatacctaatttcgtccgggaccttgctgatgacatagtcttctgcacctttttccttgtgaggtgcttggcacccatcattaggcaatatgtgaaattcctccgggaacaacaagtcatttacatgcggaaattttatggtcacccgcgactctcgtcaaccgagaggaacgaaattagtgtcatacactaa

SEQ ID NO: 39495 - DNA, 880 bp, Glycine max
  Peptide Sequence Number=SeqID_131180
atggctgagaagacaaagaaaaaactagaggaagctgctcagtccggaagcactgagggcgtcattaaccctccatctcccatcagacgacacgtgaagtggaagatggcgcgcaccaagaaaactgggcagatgacgtctaaggccgcaaaggaaatcactgaaaagattgcgtcacaagattcgtttgtcccccatggtcgtcatgatgtcctgactgttgccattgggcgaccagaacaccctggctgtgtgcatgctgctggagccggtgcgccatcaagcaatactttggctctgctccacaaagctcccatgcaatcacagggacttgcactgcctctggagcctgaggttggtccctcagctgctcgtgttagcacaaatgggagttgtgttgatccctcaccgaccgatccagagacgggtgactcagacaaatatgggctgtacatcgaagaaaatccttcccgcctggttgccctaggaagagtttatgagggatccgcagctgttcacaacatccctttgttgcatggccaggtggaggttggtgttgaggaggttaaacatgtagaggctcccgttcctgtacccactaacgaagttcaactagtggggcaaaccctgaacactttccttgcttggccgacacatctcgtgaagcgagtatcagaacaggcaactgtgtctccagcaaagcctccagataggtcggatcctgaggtcgatgatcccctgtatctgatgacattgaccatcccacaacttttcttgaagcctctccaggttatgtgggatgctactgtgttcggggtgtttaatccagacttcccattgtacatcaagcacgaagatctctctgaaattatacacggtg

SEQ ID NO: 39496 - DNA, 516 bp, Glycine max
  Peptide Sequence Number=SeqID_131181
atggctgagaaggcaaagaaaagactggaagaagctgcccagtctggaagcactgagggcatcattgaccctccatctcccatcagacgccacgtgaaatggaagatggcccgcacgaagaaaactggacagatgacgtctgaggcagcaaaagaaatagctgacatgattgattctttggacgagcaggcgtcacagggatcgtttgtcccccatggacgtcaggatatcctgactgctgccattgggcgaccagagcaccctggccgtgttcgtgctgttggagccggtgtcaccataaagcaatactttggatcagcttcacgaacatcccgcagttcttcctccatgcctcttgaagacctagaacagctgacccaacaaatcagagaccaactggaggagtcaatcacagaaaaagtgactcgaaagatgatggaatccttcagccagatgcagtcgcagtttcagtctcggatgcaatcacagggaattgcactacctccagagccagag

SEQ ID NO: 39497 - DNA, 492 bp, Glycine max
  Peptide Sequence Number=SeqID_131182
atgttgatgtgtgtgtacaagtacaacaatgaatattttgctccgaaaacagtcaattttgagacaaaaatcgattatatccactgttttggggcctccaaactagatattaaaacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 39498 - DNA, 252 bp, Glycine max
  Peptide Sequence Number=SeqID_131183
atggccacaaggatggtggccatgatgagcatgaagaagataatggaagccaatacagttgtagttgccgctaccagcgttgttgctaagatatggtgggcaaagatttgggaagtatgggcggtatgtgcaaattcaaaacaagcacaccttcccgccatatgtttggcccccaactatacaccacccaatgtggtgtacactcctaataagaatgtcaataactccacttccatactcattgagagctag

SEQ ID NO: 39499 - DNA, 201 bp, Glycine max
  Peptide Sequence Number=SeqID_131184
atggccagcagtataatcaacaatagggacatgggagaaatcaccctggaaatcctttcaacaaagttcaaggtggaccatccacaaggccacgggaacaagggccaagtctctatgatcgaacatcaaagctggaagagactcttgatcagttcatgcaagtctctatgtcaaatcaaaagagcacaaagtctaccataa

SEQ ID NO: 39500 - DNA, 96 bp, Glycine max
  Peptide Sequence Number=SeqID_131185
atgaaccctaagagaataaaggtcattcctgagtggcccactccagccagtgtgttgcggaaaaaagcccagagtttcaagaatctcaagatttga

SEQ ID NO: 39501 - DNA, 794 bp, Glycine max
  Peptide Sequence Number=SeqID_131186
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggtgactaagcgtacaaggtggatgccttggcaatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 39502 - DNA, 555 bp, Glycine max
  Peptide Sequence Number=SeqID_131187
atggcaagcacaccccgccaacttattctcaatgtatttttccagcgctttggccaccatccggcaggctggcgccatccgagttcgaaagatgatggtcggcctaattttgactggtggttacgcgcagccaagctggccgaagacgctaaatttcataccttcttcctggccgattttattggccgctcggcagaagtgacgccgcaaacgggccgcagcggcctgagttaccagtttgaacctctcaccttgctgtctgcgattgctgcttccacacagcatatcggtctggtggccacgtggtgcgacggccgccaaattttggcctggaacaagacccgcgcgcatgatgagcgctatgcgcgtgctgctgagtttgttggcctgaccaaagccttgtgggatagctgggaggatgacgcgtttgatcatcccaaccaggacacaggggtttattttgatgcggccagtgcacatccggtgaactttaaaggcaaatattaccagtcagaaggcctgctcgattttccgcgtccgcttcaaggctacccg

SEQ ID NO: 39503 - DNA, 493 bp, Glycine max
  Peptide Sequence Number=SeqID_131188
gaaggcataggtcacatcttagacctcactcccataggagagaaaatgaaagaaagcctcaagaggttaacattaaactcccatacttccatgggaagggacaatgtagaggccaatttagattgggaaataagggtagagcaacaacttaaaaggaagtctacttcaaaatcttatggctctcactcttatccaaagaaagaccaaggtcaaggaatcttaggggaggacacattacttgtcaatgccccaaccaagaaaaccatgattatgaggggccaagacatttatagtagccaagatgaggctactacttcaccttcctctagtaaaagtgaagaagcaaaaggggaagaatctagtgaagagatctacctccaagaagaaggacaacctttaatggttaaggaggagtgtaaggagacacttgttagcattgccacatctcttaggcttgagtttattcctcaagtaaaggagttgttggatgagg

SEQ ID NO: 39504 - DNA, 240 bp, Glycine max
  Peptide Sequence Number=SeqID_131189
atggcttacacccacattccggtgaaagttgaaaatcctggatttacacacgattctcctcaaatttcagccagcccgtatcaattagacttcacactttatgcttcggggtcatacaatgctcaatggaatgccccagggctcctccacgataagcacacgttgcgttcgagtcgtatcctcagaaaaatggaggttgaggaaccttggttggggttatggctaccattgaattattga

SEQ ID NO: 39505 - DNA, 201 bp, Glycine max
  Peptide Sequence Number=SeqID_131190
atgtcgctgcatgttctttatctttatgcgtttttctggatttcccccagggatttcccgtctgctgggcaggatcatcttgagctaccatctggggtggggacaaaacatggacagcagaaaccaatcaaggtacttaggaacggatgcaagtggggatggggtcacgaccgactgatcgttgccctttctctgcgctag

SEQ ID NO: 39506 - DNA, 447 bp, Glycine max
  Peptide Sequence Number=SeqID_131191
ggcaaagaggttgcgggaaaaaggtgctttggcaagcacaagtgcacattctacgatgacaagcattgcggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 39507 - DNA, 431 bp, Glycine max
  Peptide Sequence Number=SeqID_131192
atggataatgaagagggcgtgcaggaacagatgaaggccgatctatcgtctttaaaagatcaaatggcttccatctcggagcccgccttgaatcctggcctagacagaaacacggtcgtgttcggtcgaaggtgtagtccgcaagcttatccttatggcctgcctccggacttcaccccccgtgccactccggaagatttaagccaagcccctacttttgaagggcaactcccaccttatgaagactatcccggacaagacgatggggaaggagatacccatcttagccccctgctccacctcaaagatccatccccgcatgaactaccccagccgaacatagcccgccatatcccagcctcacccacacccgtaaaagaatctgttccctttgcggaagataaaggaaagattgaggcgcttgaagagag

SEQ ID NO: 39508 - DNA, 429 bp, Glycine max
  Peptide Sequence Number=SeqID_131193
atgaagcacttcactgacaccctcatcagtgccaacatagtatctttctacctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 39509 - DNA, 329 bp, Glycine max
  Peptide Sequence Number=SeqID_131194
ttaaacgcttctttgctattggtgtggtaacctcctttggctaccataaggacatagatgggcagtggttgaagaaggacgcgcaacctcaacaagacgagcgtactccctctcctccgcctcaacgagatgattcctcagccctaatgaatgaagttatttcagaattacgaggccttcgcacctatgttggagaacactttgattccttggatggtcgcatagatgccattgatgctcgctttgaaggaatggatacctgcatcacacagcttgaagaggatgtgagttatcttcgtcggtgctttgaccttccaccaccttcctag

SEQ ID NO: 39510 - DNA, 792 bp, Glycine max
  Peptide Sequence Number=SeqID_131195
cacgttgccaagccaaaggtaggcgatggagaccaccagcaggacgggcgcaaccaccgcgcagaagagcaccatcgcggcggtaatgggatcgccctggttggcgaacggcatcagcaacatcattgtaaacgccatactggcgagccgggaaagggaccaatcgcggccgtcgcgtaccttcgcgttgcaccgcggacaccaggcgcattgatttcgtttcacaaccggtatgcggaacagcatgtcgcactgcgtacagcgctgatagtgcgcatgcggcgttggcgaactgaccgaatgaacgaattctacgcggatctgaaccgcgattttcaggcgcttatggcaggcgaaaccagttttttggcaatgatctcaaataccagcgcgttactgtttgaacgtctggaagaggtcaactgggccggtttttatctcctggaaggcgatacgctggtgctggggccgttccagggtaagctggcctgtgtacgtattccggtcggccgcggcgtgtgcggttccgccgtggcgcagaaccgcgtccagcgcgtggaagatgtccatgcgtttgatggccatatcgcctgtgacgccgccagcaattcggaaatcgtctttccgttgcaggtgaataatcagattatcggcgtactggatatcgatagcacggcgtattcccgcttcaccgcagaagacgaacaggggcttgcagagctggtctcgcgcctcgaaacgctgattgcggcgaccgattatcaaaaaatctttgcccacgtcgcaggataa

SEQ ID NO: 39511 - DNA, 572 bp, Glycine max
  Peptide Sequence Number=SeqID_131196
ggggtgcgaacatgcgaccgctacgggtcacaccgctcagccccatgatattggttaccttgtccgacaaagagctaatgtcggtggcttcttccttcctttcgcttggaggcgcatacctccacagaactgcgtggctattttggtatggaaacggaataggtctaactaccgaggggtatcggggcgtttagggagctgcgtctctggtgaaatatgtcaccaaaggcttaggctttctaagaccttcctcatctgcgggctgcatgcatatgtgctgctcttcacccccttcatcaccaacttccagtcgaccttggtctatcatctgttgcaacagggcctcgtagataaaccttttgggggtcgtcacgtccttcaaaggttaggacctgcacagcctacccaactcgatggcattaatcgctccccctccatgattggaaagtgggctaggcactgttcggttgagtggcccggggttttcccatggtatgcccaggttgcatcaggttataccactttgggaaaggaggctgatagatccttccgggagatatcacagccatctg

SEQ ID NO: 39512 - DNA, 315 bp, Glycine max
  Peptide Sequence Number=SeqID_131197
atgttggtgcgcatgatccgcactcgtctctttgcagcggcacgggtgaaatcttgccccggtatgcatagtagctgtgtgatagcctccctttctggttgtgcttgcacagttggccctcctccaatatcaggggggaccttaaatcctcttaaggtgtggatatggagcacactgaaaatgagggcacgtagccctctcaaggcgaggatgtgtaatcctttggaggtgagggcgtgcagccctctgttggcgaggatgtgtagtcctcttcaaggtgagggaatgcagccctttgttggcgaagacgtgtag

SEQ ID NO: 39513 - DNA, 403 bp, Glycine max
  Peptide Sequence Number=SeqID_131198
tggaggacatgattctggctgctgcattcccacagaagatacaacacatgaagtgaactacatggggaaccagccaagaccaaactttaatgcaggtgggccacaacaacaagggactagtctctatgacagaatgacaaagctggaagagactcttgctcagttcatgcaagtatccatgtccaatcaaaagagcacagagtcaacaatcaagaatctagaagtccaggtggaacaatgggcaaaacaactggcagaccgatcgtcacgtagctttggagccaacacagagaagaatcctaaggaggagtgcaaggctgttatgactagaagcaaagtgggaattgcgctgagcgagcaggagcgcgctaagcgagccacagtgcagtggaagttgcgctaa

SEQ ID NO: 39514 - DNA, 204 bp, Glycine max
  Peptide Sequence Number=SeqID_131199
atgaaaatacagaaaaagggatgttctattgctttactttttcttaattttttaaattgtgatcaaggggttcccatgaaccctaagagaataaaaggtgttgaggaaaaaagcccagagtttcaagaacctcgggatttgaggtcaaatccttttcaaggggtagggaatgatgcaatcctaccccgcaagggcattggatag

SEQ ID NO: 39515 - DNA, 393 bp, Glycine max
  misc_feature (384)..(384): n is a, c, g, or t
  Peptide Sequence Number=SeqID_131200
atgggtcattttaaggtccaaggccttaaaagtaccaccttccaatttcctttgctttttccgacgttttccacaaataaacgttggtggcgactccgcgcattttcctcctttggaagacgcacccgtgagccccgcctcacttgcccacaaaaggcttcaaaacaaagaaaggggaacataggctcaaaggggctatcgaaggaattaattcaaggtaggctcatttggctagaggcttataagaacaaaatgcctaaatcatctcccaacatgcatgtgaagcaagaagtatcaacaagagtcaagccaagactattgtgcaagcaatcaatggggcaaaacacaccgaataaaatagatgatgatggctcaaattctcancaagggtaa

SEQ ID NO: 39516 - DNA, 150 bp, Glycine max
  Peptide Sequence Number=SeqID_131201
atgacacgtggagataccttacggttatcccgcacccttgtgtcatccagaggcggcgggcccgatgatacgcggaaatacccgagtggttatccgtataaactttcttttgctatctgtgcttggcacccatcattaggcaatttgtga

SEQ ID NO: 39517 - DNA, 201 bp, Glycine max
  Peptide Sequence Number=SeqID_131202
atgtctcgggacttccatttattgtgtaacaaaaggattccaagtatctcaaagcggctaaccaaaggttgcatgtcaacaagtaataatccccggacgaaattagggtatgacacatgtgaattaggaagcatcaacaagaatcaagccaaggctattgtgcaagcaatcaatggggcaaaacacaccaaaagattatga

SEQ ID NO: 39518 - DNA, 276 bp, Glycine max
  Peptide Sequence Number=SeqID_131203
gtgaaaaagaggctaagtcatgaagtgctaaaacgcgcatccaccgctaagcgtagctttaacgcggttagcatgacagaagaatctggcagagcatcaatatcaaggccacacgctaagcgcgagatagaattagggcagacaatagccttacagcagaattttagcaacattccagagcacaccacaatgcctatttggggaaaagagctctggaggcagcaagaggagcagcttttccagagatacctaggttttgtaatctcattattgtga

SEQ ID NO: 39519 - DNA, 136 bp, Glycine max
  Peptide Sequence Number=SeqID_131204
gattctcgtcacacctagtaaggtgattcgactgccgatcacctgggctttcattgagaagtattgcactcctaggcaggcgcaggggaatgcaccacaggctgcagatgcccgtgatcaatgctggaaaccctag

SEQ ID NO: 39520 - DNA, 306 bp, Glycine max
  Peptide Sequence Number=SeqID_131205
atgggtcaacttcaacggcaagccttccgcaatgcctatggtaagatttgggacctagctagggtagaagtctccatggaatcgattgcatccctttcccagtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaagaggtgtcctctttccaaatatggaagggttagtggacctagcagcgattga

SEQ ID NO: 39521 - DNA, 192 bp, Glycine max
  Peptide Sequence Number=SeqID_131206
atgtccaaatcttttgaatttgggatgatcgaccctctcaatgagtcaatctcttgctttctcagggctacacgccctcgccttcgtagggctacacgccctcaccttccgaggactacatgtcctcaccttcagagtactacacgtgctcgccttcagaggacaacatgtcctcgcccttcgccttcgtag

SEQ ID NO: 39522 - DNA, 177 bp, Glycine max
  Peptide Sequence Number=SeqID_131207
atgtcggctattgagttttctattcaatccctgaatgaaatttgcatgatgtcgattaggaaatgtttgatcggcgtgatccggctaaaggcccaagtggagaaggacgaaggcctaagtggagaaggacaaagcccccgagtggagaaggatgaaggcccaagtggagaaagatga

SEQ ID NO: 39523 - DNA, 348 bp, Glycine max
  Peptide Sequence Number=SeqID_131208
atgtttggggtctttaatcctgacttcccgctctacataaagcacgaagaccactccgaaattgcacacggtggtcaatgtctaagcatatcagtgttacagttgcatctaactgaaacaagtatgcaagcggggaattctgataaatatggatttctcgagccacagtccattcagaggtctgggcaatcgcagtttgagactgaaagttacataaagagttggatgcaaagttcaaaatgcgatgtctatcttggagcctacctgaatggcggacactggccgatggtggtcattgtgcccaaggaacacctagttgtctggttttgttcattggggatcctctag

SEQ ID NO: 39524 - DNA, 406 bp, Glycine max
  Peptide Sequence Number=SeqID_131209
tgtaacgaggaaaaataagacagacccaggctggaaatattgtcatccactggtagaaggagaaacaaacataattgtttgtaatttctatggaaaaatcacaaagggaggaataaccagagccaaacaacacctgattgggaagtcgggtaacattgcaacttgcaagaaaactccaccaaatttagtcgaagagttgaaggaatatatgactaccaaaaaaagtgggaccacttacagtacttatggcagtggtaatatggcaaatataagagattttgaatttggtgaaccaattggatgtgatggaagtgaagatgatgagtttgcggactcttgtaatgctattgcaagtgcaaagacaaagtatgagactaaaaaaaggactaatggacaaattttgtaa

SEQ ID NO: 39525 - DNA, 534 bp, Glycine max
  Peptide Sequence Number=SeqID_131210
atgagtcttcattcttcatcaagtgttaatggtgagggttctactcctaaggaccccttgtataagatatcagatgagttgagatcccttaagttgtggaaagaaaaaggtaaaaaaagagtggaagaaataagtcaagatgaaagagagaaaataagagaggaagaaagaagaaaaataatgaaagaaatgaaaagagaaaaacatgcgtcctatagtagtcattactcttgcaagagtttaagtgaagaacttagcgattattatagagggcgccatagttcacacactaaacatcactcccaaagaagagaaaaggatagaaggcctcaagaggttaacattagcctcccatatttccatggaaaagataatgttgaggcctacttagattgggaaatgaaggttgaacaactctttgcttgtcatcatattagggaagagagaaaagttccattggctacccttagctttcaagggtgtcataccctaatttcgtccggggattattatttgatgatatacaacctttga

SEQ ID NO: 39526 - DNA, 408 bp, Glycine max
  Peptide Sequence Number=SeqID_131211
atgagagaaaagagagaacaagagaaagaaaatagtgaggcaccacagaggaataggataaagaagactgatacacttgagggaaagagtgatacacataagagaaagagtgatacacatgagagaaaatttaattgtttcgcagaggaatttaaagatgtctttcctaaggagatttctcatggactgccaccttcaagaggcatagaacatcaagttgatctcctgatgagaatcctgaaactgaccaaatacaggctaaaggccaggtggagaagggcgaaggcccaagtggagaaggacaaagcccccgagtggagaatgatgaaggcccaagtggagaaggatgaaggcccagaggcagagacattatcaagactattaattgttgctgaaggcccagattaa

SEQ ID NO: 39527 - DNA, 200 bp, Glycine max
  Peptide Sequence Number=SeqID_131212
atggtcagaagtcgagacgagttgacggcagaaatcaaccaaggtaagataatgacccggtcacgattggccgcgcattgtttgctccctacttgcaggtacttaggcacggatgctaatggaggacagggtcacgaccaaccaatcgtcgtcccttcccagcgttgggccagcggagaacgtcgctgcaaggcagccca

SEQ ID NO: 39528 - DNA, 104 bp, Glycine max
  Peptide Sequence Number=SeqID_131213
tcaaatacaatctgcatgttctgaagcgtgatgtcgtgacatccggtacgacatctgtccccagtatcagaatttcaagtgggttgcttgagtactggacgtag

SEQ ID NO: 39529 - DNA, 138 bp, Glycine max
  Peptide Sequence Number=SeqID_131214
atggacagtagaaaccaatcaaggtacttagggacggatgcaagtggggatggggtcacgaccgaccgatcgttgccccttctctgcgtgaaacaagcagagaacgtcgctgcaaggcagcccataattgacgcctaa

SEQ ID NO: 39530 - DNA, 400 bp, Glycine max
  Peptide Sequence Number=SeqID_131215
ggctcgcaaggaagagtatggccgtaacaaatttcgcggagctctgtggggtagcaacagtgaagggaagagagggaccagtcgcgagcacatagcatggagcttgtctcagcgtttatgcgagacggagaccaacatgctagctatcatcgccaagtaccaagaagagttaagtctagccacggcccacgagcatagggtcgcggacgagtatgcccaagtatacacagaaaaagaggctagaggaagggtgatcgactctttacaccaagaggcaaccatgtggatggatcggtttgctcttaccttgaacgagagtcaagaacttccccgattgttagccaaggccaaggcaatgaaaccgctaggaaacttgtatggtctctcagatcttgactag

SEQ ID NO: 39531 - DNA, 369 bp, Glycine max
  Peptide Sequence Number=SeqID_131216
atggcacatttttcggattctgcacagtctgtgaaggcaatttgtcagaattttgggattgagcttgactctgaatggaggctcttgtctcttgctgaaattgcatattttggatggtcatttgcctcattaactcttctaaggaaggttgaggaggagccttggttgcttgttgtctttgttgttgctgcattagaggaggaacatatggcttgcttggaccagcaacattttggaagggagggacaggctgctgttgttgtggaggacttgtctatctcagatttggatgattcctccaacttggattgtatctgttgcttgaaagatcataattattatgctgttgttggttttgctgctgaggag

SEQ ID NO: 39532 - DNA, 846 bp, Glycine max
  Peptide Sequence Number=SeqID_131217
atggggaagaaaaagttagaaatgagtcttgaaagccaacaaatcagctttgatctatttaatgaaggaaaggaactactggaccacaatgtgtgcttaaaggtgaaggagttggatgagaaggcaacagcttcgataccgcatgctagatatgacagatctaaactttcatcccaagaggtctgggaccgttacacagataatattctcggtcggaagatccttccggagagaaatgtaaagttgtatgtcactgagtttgttgaattcaaaagggaactagaaaggagaaactggcataaggaacttacaaactttgtagatgggagcatagacgtagcaattgtcaaggagttctatgcaaatctctatgaccctgaagacaaatcacccaagcaggaaggggagagcctgccagcttactccaggttagctcagttgaggccagattcgcaagagctggcagcccacttatgtatccctggaaggggatttgaattgaatgcagacgggcatcctctgaagattttgagaaagaatttgactacactggcccaaaccaggagcttactttcctttcctaacttggcccctacctctcacacttcagacatcactttacacaaggccaggttaatttatggcattattcagaagatggatatgaacctcgggtacctcatcttgagtcagatttctcttattgttcaacatgactcttcgaggctaggttttcatgtcctcatcactgccttgtgcaaggcccggggagtcgcctcttactctttaacttttgagagcttgagcccagccattactttggcatatgttaaaaagaattgctag

SEQ ID NO: 39533 - DNA, 333 bp, Glycine max
  Peptide Sequence Number=SeqID_131218
atggggaacaagcaaagtgatttgattcccattgacttggagattaacgccacttgtagaaggcgtaatcaagagagaattagaaattttttgcaggacttagaggcaacagcaattccagaggaagaacctcaatcttctgaggcatcttctagttttcctattgcagaacattctcatttagatgctagtgaagactacatcatggttgaagagccaagaagagttactctggaagattattcaagttctaatctgccacaaattttcaccagcattgcacaaccagaagttcaagcacaaaccattacttatccaccatcattgatttag

SEQ ID NO: 39534 - DNA, 243 bp, Glycine max
  Peptide Sequence Number=SeqID_131219
atgggtgaagtagaggaggtgcaagagcagatgaaggccgacatggaggccatgaaagagaaagtggccataatgatggaggccatgatgagcatgaagaagataatggaagccaatgcggttacggttgccgctaccagtgctgttgtaagggcaagcagttggtggtatacccctgcaaaacactttggaaggcccttagtatcacccacaaccacaccccttgcattccacaacgagtaa

SEQ ID NO: 39535 - DNA, 544 bp, Glycine max
  Peptide Sequence Number=SeqID_131220
atggcatcgttcaaccagatgcagtcccagtttcagtcccagatgcaatctcagggacttgcactgcctctggagcctctggttggtccctcagatcctcaagtaagcacaaagaagagttgtgttgatccctcaggaaacgatcctgagacgggtgactcagacaggtgcggcttgtacatcgaagcaaatcctgcctgcctagttgccctgggaagagtttatgagggatccactgttgttcataacactcctttgtttcctggccaagtaaaggtgggtgtggaggaggttaaagatccagatgctctcgttcctgtacccactaacgaggtttccttagtggggcaggcaattcacaccttccttgcttggccgacacatctggtcaagcctttatcacagcaggcagttgtgtctctggcaaaaccacctcaaaagctagatctggaggttacatgggatgccaccgtgttcggggtctttaatccagacttcccgctctacataaagcacgaaaacctctctgaaattgcacacagtg

SEQ ID NO: 39536 - DNA, 948 bp, Glycine max
  Peptide Sequence Number=SeqID_131221
atggcagagccatcgaagaagagaaagggatcatcctccaccgctactgctgctgctcatcgccgccacggaccatctgaagcatccacaacacctattcatccatctttatcatctccaagatcatccacattgttttcttccgatgatcagtgtctacggtacctctctcaattttcttctaggatcatcttagaccctaagtacctagatgaagagttctttaatgatgaaacgtttgattgctatcaagtgtttcaaaattctggccttgttgatttcatgtcattaaaactgccacattatcctgaacttgtaaaggtcttctactgcaatttgaaaatacaggatggcattatttcctctgagaaatttgattattctagtcataatgcttgccgcatggtctgcaatgatcaggctgaaatgaccgcacaagcctctgaggaggatttgattctgatgtgggcttttctcaccagtcgtcagatcgactgggcccatttggttcggtaccgaatgcataaggcattacggaccaatgcacctctgccttacccacagatgataactttgtttctgcgtcattttcaaattccgcttgatgatgagccatttgttcaagtcaagtgttcctttgcaattggtgctggtgctgtgtcttcttttggttaccgtaaggatcggaatggtcaatggctgaagaaagacgcactccctcctcaagatgagcgtactccttcacctcctcctcagcgtgaagattcagcactcctgaatgaagtccttcccgaattacgaggtcttcgttcttatgttggtgaacgtttcgactcattggatacacgctttgccggcatggatattcgcctcacacaagttgaagaagatgtctccttcatccgtacttgctttgatccaccaccaccgcctccatcatccttttag

SEQ ID NO: 39537 - DNA, 574 bp, Glycine max
  Peptide Sequence Number=SeqID_131222
atgagtcatcattcatctagtgttaatggcgagggtactagtcataaagaccctttatctagaatcttagatgagttgagttccctcaagttatggaaagaaaaacaagagagaaaagaaaaaggaaaaaaaagagtggaagaaataagtcaagatgaaagaaagaaagtaagagaggaagaaagaagaaaaataatgaaagaaatgaaaagagaaaaacatgcctcctatagtagtcataactcttgcaagagcctaagtgaagaacttcgtgactattacgaaggaaggcataggtcacatcttagacctcactcccataggagagaaaaggaaagaaagcctcaagaggctaacattaacctctcatacttccataggaaggacaatgtagaggctaacttagattgggaaataagggtagagcaacaacttaaaaaaaagtctacgtcaaaatcttatggctctcactcttatccaaagaaagaccaaggtcaaggcatcttaggggtgacaccttctaagcccaaagatgataaggggaatacaatagaaaagcaagcccctaaggcta

SEQ ID NO: 39538 - DNA, 120 bp, Glycine max
  Peptide Sequence Number=SeqID_131223
atggcaaaaatcaaccaaggtaagacgatgaccactcacgatcggtcgcatatcgttcggctcttacttgcagggtcacgaccgaccgatcattgccccttcccggcgctaaacaagtag

SEQ ID NO: 39539 - DNA, 425 bp, Glycine max
  Peptide Sequence Number=SeqID_131224
caaatcctgcccacctggttgccttgggaagagtttatgagggatccactgttgttcataacactcctttgttgcctggacaagtaaaggtgggtgtggaggaggttaaagatacagatgctctcgttcctgtacccactaatcaggtttccttagtggggcagacaattcacaccttccttgcttggtcgacacatctggtcaagtctttatcacagcaggtagatgtgtctccggcaaaaccacttcaaaagccggatccggaggtcgatgatccgctttatctaatgacattgatcatcccagagcttttcttgaggccttaccaagttacatgggatgccaccatgttcgaggtctttaatccagacttcccattctacataaagcacgaagacctctccgaaatcacacacggtggttaa

SEQ ID NO: 39540 - DNA, 865 bp, Glycine max
  Peptide Sequence Number=SeqID_131225
gatcccacggtatcccatgaggggagcgccaaccgaagaaagtctctcgcctttccttgtgagggatctaggcgcgcaaggtctcaaggttatacaaagagtccacaaggagtggagaagtccgttgaggaaagacaaggagcttaggggcatccgtaatggcgtcatcggaggttatcatggatggctaagaattcatacgcgagggttagattggctctccaaattgaaagttatcgatgaggagaacttcgaagctccggaggaagatgaagaagtccgagctctaaaattagagctagggaaggcgagactcgccaaggagaagttcaaatcagctgctacacacatccggaaggaatgcaccgagttacaagaggaaaacgcggccactgcaaaagcccttgaacacccaccccaacagggcccacaaggaagaatatggccgagagaaattccgaggagcattgtggggtccaaaaggagcttggctcaacacttggaagccacggagcaaagcatgctagctatcatagggcaatacaaggaagaattgaaccagtccatggcccatgaacaaaagctagtggaggattttgcacaagtgtatgccgaaaaagaagcaagagggagggtgattgatgcactgcatcaagaagcgactatgtggatggataggttcgccttgaccttgaacggaagtcaagacctcccgcgtctattggccaaagcaaaagccatggccgaagtgaatttcatcataactaagaaaacaccaaggcacccctataacactctgtcataccctaatttcgtccggggacctttgctcgatgacgtgcgaccattctttggtcctcgtgag

SEQ ID NO: 39541 - DNA, 744 bp, Glycine max
  Peptide Sequence Number=SeqID_131226
atggtggcccaagcccgggctgttgatatgctcgtggagacgtcatcatcgcgattgtggatggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccgtaaggcgcaaggaagctgattggtgggatccccctgtggcggggcgaagccagaggaaactctggtggaggcccgcagcgatactgacgatagctggagccgcgggcgagttctatcgggtaaagccaatgattagaggcatcgggggcgcaacgccctcgacctattctcaaactttaaataggtatggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcgggttaaaattcctgaaccgggacgtggcggctga

SEQ ID NO: 39542 - DNA, 276 bp, Glycine max
  Peptide Sequence Number=SeqID_131227
atgtcgcaggggtcaggagaccttggggacgtcagatggggagctattggccaaaaccaagcttggccaatctcgacccaacccgggcataagcaacccgcacgcacacttcagcagcctgtggagtggatactacctacgccaactccatatcgactagttgagcctgttcaattgataaaggtgtcatcctctgaagaggatcttgaagaggacccagaggagttatctcctgaacctgctatggatgcccctgacttatcagaggatgattag

SEQ ID NO: 39543 - DNA, 450 bp, Glycine max
  Peptide Sequence Number=SeqID_131228
atgcagaggaactcgcctgcctcctcttgcgatacttctttcttgccacagccatcccttttctccggaagacctttcattggaatatcctcattcggtgtgagggtcattttgtcattttgttcttccaccatctttgccttccctttaacgtttgcgggttgtgtcggcaggtcgacgggtgcaaacacgcgaccgctacgggtcacgccgctcaacctcgtgatattgtttaccttggctaacaacgagctgatgtcagtggcctcttccttccatttgcttggcgatgcatacctccacgggactatgtggctgtttcggtatgaaaacggaacaggtttaactaccgaggggtatcggggcgtttggggagttgcgtccttggtgaaatataccactgtcgcaacctacccttcggcaggagggagggcgacgcgtgactcgcgg

SEQ ID NO: 39544 - DNA, 643 bp, Glycine max
  Peptide Sequence Number=SeqID_131229
atggggacaaatcaaaacggcaaaaggttttatcaagtcaaggttaaaagtctagatttcaccagcctcaaggaattgggacgattgatgggacctctccaaaggcatgccttccgcaaagtgtacagaaagattctagatttgaccgcagctggggtatttacggaagctgtcgtattcctcgcccaatactatgaccagccgttgaggtgcttcacgtttggggacttccaaatgcaagattgcagctgtggtcggagattcggagagagaattggattatataaagcaaactcgaaacggcatagtgggcataccgcggaaatacttggaaggcaaggcaagggatatgacaagtcaataaaaccgcaattgatgctttccttgcatatcaccatagcaaggagagcccagtggtggctatcttggtggacttatttgatacattcgaccgaaggtgcgggaagaacagcacacggatcatctgctgcttacccgctctttgtgtgtgttgattgggaccaacacttggctgggataggaggcagcacaatcaattggtttcctcgatggaaggaaggaaaggagggagttcttttctcatgtggggactaccctaacgttccgttgatggggacgaggg

SEQ ID NO: 39545 - DNA, 387 bp, Glycine max
  Peptide Sequence Number=SeqID_131230
aagtactgcacgcagagacaggtccagggtgatgcaccacaggccgcggacgcgccgccacctcatcaggctggtccagccggattgtttgatacggagcagtatttgcgacatttggttcgccagcaggcggccaaccatcgagcacatgtacagacccatgattgtctctatcagatgagtctcagcctgcagagccagagctttacttcttttccgtgccctactccggaacagttcagggcagaggtcgcatggcctggagattggcctaaggcccaggcaggagaggcaccagcagaggctcccggcgaggcagatgaggcccgcgaggacgaagagatgaccgatttacttgatttcttaggagggagcggggccacatga

SEQ ID NO: 39546 - DNA, 657 bp, Glycine max
  Peptide Sequence Number=SeqID_131231
atgattcctggtcaagcccctgttcctgaaaaactggttcccaaacgacaacagggagtgaagatttctgaaaaccctagccttgcaacaagtcctagggaagtagacccggagatggataagaaaatccgcagtattgtgagtagcattctgaaagatgcttctgttcctgatgctgagaaagatgttccaacatcttccaccccagatgttgctgtccctgaagctgatgaagatgtcccaacatcttccaccccgaatgtttctgtgcctgatgttgagaaagatgttccaacatcttccggcccaaatgctgaagtactctcttcccccagcaaagagagatcaacagaggaagatgatcaagccacagaggagacccctgcaccacgggcaccagaacctgctccaggtgacctcattgatctagaagaggtagaatccgatgaggaacccattgccaacaagttggcacctggcattgcggaaagactacaaagcagaaagggaaaaacccccatcaagaggtctggacgaatcaagactatggcacagaagaaaagcacaccaatcactcctaccacatccagatggagcaaagttgcaatcccttccaagaagaggaaagaaatttcttcatctgattctgatgatgat

SEQ ID NO: 39547 - DNA, 663 bp, Glycine max
  Peptide Sequence Number=SeqID_131232
atgaccaccctgactcagatctggatgactttgctgctcagcaacatcctgtccagcgatcataattccgacctccccctgccgaagtgtcagctggtgtacgcaatcctgacgcggatgagcattcatgtggctcaattaatcgctgatgccatctatatatttgcaggtatggcacctaccaggcaccctctggacccggataagtccaacagggccctgggatttcccgccttgatcacaggactctgccagtcgttcggcgtccccgtctcacctagcaaggtgattcggccgcccatcacccaagcttttattgagaagtattgcacgcagagacaggtccagggtgatgcaccacaggccgcggacgcgccgccacctcatcaggctggtccagccggatcgtttgatacggagcagtatttgtggcatttggttcgccagcaggcggccaaccaccgggctcatagccagggctttacatcttttccatgccctactccggaccagttcagggcagagatcgtatggcctggaaattggcctgaggcccgggcaggagaggcaccagcagaggctcccgacgaggcagatgaggtccgcgaggacgaggagatgaccgatttacttgatttcttaggaggaagcgaggccacatga

SEQ ID NO: 39548 - DNA, 453 bp, Glycine max
  Peptide Sequence Number=SeqID_131233
atgaccaaacctggtctctgcgtgccatcggacacgactgtgtctgaatggcaaaggggtgcggataaccgtaaggtatctccgcgtatcataatgaccaaacttggtctctgcgtgccatcggacacgactgtgtctgaatggcaaaggggtgcggataaccgtaaggtatctccgcgtatcataatgaccaaacttggtctctgcgtgccatcggacacgactgtgtctgaatggcaaaggggtgcggataaccgtaaggtatctccgcgtatcataatgaccaaacttggtctctgcgtgccatcggacacgactgtgtctgaacggcaaaggggtgcggataaccgtaagggtcagtatgacaaagattatggggcggccgacaaaagcaaggctcttgctcctacgtatcctccaatgaggaactcagacctacgtagttctggataa

SEQ ID NO: 39549 - DNA, 288 bp, Glycine max
  Peptide Sequence Number=SeqID_131234
atgggattagataccccagtagtccctagccgtaaacgatggatactaggcgctgtgcgtatcgacccccgaagaaccttaccagggcttgacatgccgcgaatcctcttgaaagagaggggtgccttcgggaacgcggacacaggtggtgcatggctgtcgtcagctcgtgccgtaagccggaggaaggtgaggatgacgtcaagtcatcatgccccttatgccctcggcgacacacgtgctacaatggacgggacaaaggatcgcgatcccgcgagggtgagctaa

SEQ ID NO: 39550 - DNA, 435 bp, Glycine max
  Peptide Sequence Number=SeqID_131235
atggttgaaggttatcgcaatgtgttgcagaactactcatttccgtttaatcgccagttggtattaacagccaatgagagtgtcgaacgcgcgctgttgacgcttattaatagtctgagcaagttctcttccatcgtagttaagcgtgatgcttacgctgcagaggccatgcgcctgttccgcgaatttaatattgccgtgcctcaggagcgcattaaaagcatcgttgagggtcgtccgcttcgcgaaacggaactgccaccgataattggtaagcttacgcctcgccagtcggaaccagggctcccgctgaaggaacaggtcaatacagatgaaggtacaatctgcgtttatgaacgcggggaacaccgtgaaaaaatcgttattcctgttggtcaggcgtgcccgaaaacctcagctaacaataatgaatga

SEQ ID NO: 39551 - DNA, 408 bp, Glycine max
  Peptide Sequence Number=SeqID_131236
ggctacatgccctcaccttgggtactagttaccctcaccgttgagaggactacacgtcctcgccttgagaggactacatgtcctcaccatcagagggttgcacgccctcacctccagaggactacatgtcctcgccttgagagggctacacgccctcaccttggagggctgcacgccctcacctccagaggactacatgtcctcgccttgagagggctacacgccctcaccttggagggctacacgccctcaccttgggtactagttaccctcaccgttgagaggactacacgtcctcgccttgagaggactacacgtcctcatcatcagagggctgcatgccctcacctccagaggactacatgtcctcgccttgagagggctacacgccctcaccttgggtactag

SEQ ID NO: 39552 - DNA, 306 bp, Glycine max
  Peptide Sequence Number=SeqID_131237
atgtcaggatttacacgtgattctcctcaaattttagccagcccgcatcaattagaccttgcaccttacgcttcagagccctacaatgctcaatggaatgccccggggcttctccgtgacaagcacacgttgcgttcgagtcatatgggagcaagaggtgtagctgggggtgatactgagggccttccgaagtgttttcaaggggtataccaccaactgcttgcccttcagtggcatatccgagccaaggctcaaagtcggctagattgtggtggggaatttcatgtgtctctcccaccggtttaa

SEQ ID NO: 39553 - DNA, 108 bp, Glycine max
  Peptide Sequence Number=SeqID_131238
atgacaacttgtcagaattctcctcttgtctcagcaatgggagcagtcccatctgatatgagggccttcaattctggctgtggggtcgtgcttgttggacagtggtag

SEQ ID NO: 39554 - DNA, 351 bp, Glycine max
  Peptide Sequence Number=SeqID_131239
atggcactgacattttttgggattttggacagcttgagaaggcagcttgtcagaattctgggactgttgttgattcaattgggtagccaattgtcctatctgattgggttaagctctgaatggagactctggaatgtatggtctgcttgggccagcagcattttggaaggaaggagcaggctgctgttgttgttgctgagggctggaccatttgaggttagggtgattcctccatccagggttgtatctgttgctggaaaggctgctcaattgctccaggttgctgcatggaagggcaaaggtctgtatggtggtcagcagaggagcacaaaccacaaactcttacgacag

SEQ ID NO: 39555 - DNA, 303 bp, Glycine max
  Peptide Sequence Number=SeqID_131240
atgcacacacaaagtttcacaattccacaatttcctaaaataggcctaactcacaaaaacagtccccagtggagtcgccaactgttgcaacctacccttttgcgggcgagcgaggcgaggctctcgggtgcgtcttccaaaggaggaatacgcgtggagtcgccaccaatgtttatttgtggaaaacgtcagaaaaaccgaaggaaaccggtcatgaagaatattccagattcgggagttgtatttacgtttgaggaaggtattagcacctctcacgtttgtcccaaaggacaacagccttaa

SEQ ID NO: 39556 - DNA, 630 bp, Glycine max
  Peptide Sequence Number=SeqID_131241
atgggttctccacctgcctccactcctcctcctcctcctcctcctacttcggacgcatcggctttgccgtctaccgtgaaaccacctggtgctgagagaccagtggtgcatgttgatcctgctaccgagaaggccgacggtccccacaggaagaaattaagaatatatttggtgattgtggcgcgtgataaggtggacatcacctacgagaactggaaggagatccctactgctcagaaggacctgatttgggaggatattcaggcggaatttgatatcccagaggcttctgacaccgatcaggacggtgtcgaggacactatctgtgacaaatacgacatcagcaaggaaaagtgggcccagttttgccagactcgcagagacccttcttgggaggatgtgcgcatcaaggcacaggccatccagaagcagaatactgccccccacgttttgtctcgtggggctgagaagaccaagaagaagctgcaggaagctgcacagtcaggaagcattgatggcgtcatcgaccctccatccccggtcagacgccacgtgaagtggaagatggcccgcacgaagaagacaggggagatgacaactgaggccacaaaggaaatcgctgagaagatt

SEQ ID NO: 39557 - DNA, 495 bp, Glycine max
  Peptide Sequence Number=SeqID_131242
atggaggccataaaagagcaaatggccacaatgatgaaggccatgatgagcatgaagaagataatggaagccaatgcggttatagttgccgctattagcgctgtcgctaaggtgaacccgatgctcccatctggcctcaagcaaatgaatcatccaacctcaaatatgacacatatctctcaaaccatgggggagacacatgaaattccccaccacaatctagctgacttcgagccttggctcggatatgccactgaagggcaagcagttggtggtataccctgcaaaacactttggagggccctcaatatcatccacaaccacaaccctcacgttccacagtggttaaaaaccctcatgactatggcaggaatgggaaagttggatcatctagaggaaaggctcagggccattgaaggaggtgaagattatgcctttgctaacctaaaagagttgttcctagtacccaatatcatcacccctcccaagttcaag

SEQ ID NO: 39558 - DNA, 264 bp, Glycine max
  Peptide Sequence Number=SeqID_131243
atggggtggccgtacaagctttctgcaatcactgacgcagcctcagcatgcaaaaaacaactcacatatctcatggaaacaataaaagcaaagcaggggtactgtactactactccacctcatccactctctctagatctctatttctcaccttgcacctgcgcgaaccagaacatgccacctacattcttcgctactataccaccccttcagttgggggcgttaccccaacctggcatcatggcaatggacttacttgtttag

SEQ ID NO: 39559 - DNA, 1176 bp, Glycine max
  Peptide Sequence Number=SeqID_131244
atgaacaaaaatggcgttattccgtcgtggatgaagcagcaatggcggggcatagtgaaagtgcgtttgaaatgggtcaagaaccgaagcctggaccacgtcatcgacaaggaaaccgatctgaaggcggcgtgcctccttaaggacgccgtgaaccgctcctccaccggcttcctcaccgcgcaatccgtcgccgactggcagaaacttctcggcctgaccgtccccgtcctccgcttcctccgccgctaccccaccctcttccacgagttcccccaccctcgctggccctccctcccctgcttccgcctcaccgacaccgcactcttcctccactcccaggaactctccctccaccaaacccaccaaaacggcgccgtcgaaaaactctccaagctcctcatgatgtccaactcacgcgccctccctctccactccctccacgcgctcaagtgggacctcggcttacccgacaccttccacaaaaccctagtcccccaattccccaaccacttccaattcgtcaagtcccccaacggcgtcgtttcgctcaagctatcccgctggcccgacgaactcgcggtttccgcactgcagaagcacaacgagggtgggacccactaccgcgaattcaagcggggacaatccgcgttggcttttccgatgcggtttccgaggggctacggcgcgcagacaaaagtgaggacgtggatggaggagtttcagaagcttccttatgtttctccttatgtggattccacgaagattgatcctaacagcgatttgatggagaagcgtgtggttggggttctgcacgagattttgagcttgactctgcacaagaaaaccaagaggaactacttgaggggcttgagggaagagttcaaccttccgcataagtttacccgcattttcaccaggtatcctgggattttttacctctccttgaagtgtaaaaccaccacggttactctcaaggaaggttaccagagtgggaaattggtggacccgcatcctcttgctcggcatagagataagttctaccatgtgatgcagacggggctgctttatcgcggtgacggatccttgaaacctcgggagaacaagattgaaaatgatgagctaaggagtgaggacgaggttgaaatgagtgaccaactctgcgagagtgaatga

SEQ ID NO: 39560 - DNA, 705 bp, Glycine max
  Peptide Sequence Number=SeqID_131245
atgtgtgagacgtccaaaatttattgtttgcactggtggaaatccttcgggttatattcctacacatacaagccaaaattcaacaaccagtggattactttctggaaatgtttggaggaacctatcatcatttatgcctcaaagggaagtgtctgctcaggtgcaagtgtaaagagtgtgcttgcatgtagtcatttaaaagtgtcagattcatctatacatccatcatccatagggctttggcatcagcaattgtcaactgaggacagtaggttccctgggaggggaaggacccttggtgctgttcaaggtcaaactgcttctcatcttcattcagattcaaaccttcaagctagacttttggaggatagcagtcccaatagtcctttagattcatccactcctagtaatcctcaacggttgtctgaaggaaggcattcagttgacaatgtagctacagcagctgctggtgttccacagaatcagggtgcagctgtttcggaagaagggattagaaaacttgtatcaatgggctttgataggacgcaggtggaagtggcactggcagctgctgatggtgatctcaatgtggcagtggaaatactcatgagccagcagtgcactttctggagtttattctctttaaaaaatgaattgtcagtgatgctgagtggccgtgccgtgggccaggatggccgaaggtaa

SEQ ID NO: 39561 - DNA, 1431 bp, Glycine max
  Peptide Sequence Number=SeqID_131246
atggagggtgagggtgcagcagtgtggcaaggtgcggttttaggtggaataatcttctggcttgtttctgcttcataccttaacgctactcgcaaacttaggtctttcttacaaccttgggttactcatcacgttgacactcaaacccctattatcctcaagatccagagttacgggtttgggttcctggatgcacttttctctgggttgtcttgcgttgtttctgtgcccttttacactgcttttctccctctgctattctggagtggtcatggcaaattggcgaggcagatgacgttgttgatggcgttttgtgattatattgggaactgcacaaaggatgtggtttcagctccaagacctgcttctccacctgtcaagagagtaactgccacaaaagatgaagaggataatgcgttagaatatggattgccttcttctcacacacttaacacagtttgcttatctggctaccttttgcgctatgtcctgactcatactcaaattcaaggtgcctatgttacttatcttggagtttctcttgcctgtatgctggtgtttctcattggattgggaagaatttatcttggcatgcatagtgtggttgatgtccttgctggccttcttattggacttgttgtccttgcattttggcttatggttgatgaatacatagacagttttgtgatctcaggacaaaatgttacgtccttttgggctgccttgagcttcctcttgctttttgcttatccaactcctgaacttccaactccaagctttgagtatcacactgctttcgatggtgttgcattgggaattggagtgaaaggggaccagaatggggaaggagagaattgtggtgttagtttgggcagagagctatctcttagagcttcagctctgggactgctgtatgctgcagttgtaatagaactatttggagatgttagaatcaagtactcccctaggatttgttttggtagtcctccgatattaactgagcatgccaggaagggccagagaagagctgtctctggtgttcaacaaacataccatcaatttcaccatgccaacgttcctcgtttgttctcgtcagagctgactatacctgtatttctaggaaggatgctattgggcatacctacaattctaattgtgaaattctgcagtaaggctctcgcaaaatggaccattcctgtggtagcgaataccttgggcatcccaataaaatcaactggctatatacctacattgaatggatctgtgacggggaaaaagtctgataagcttaaacaaggttacctgcaaaagctcctttcccagcataaggcattcgatgttgataccggaattagatttgttcagtatgcagggcttgcgtggtctgtagttgacctagtgccgtctcttttttcatacatgagcttgtga

SEQ ID NO: 39562 - DNA, 912 bp, Glycine max
  Peptide Sequence Number=SeqID_131247
atgggcaacatctcaagcggcggcaatccccgtcgccgacacagcggagcttcacggcggagccacccgccgccgccgccgcccgttacgccgcagcctgagatcgcggcgaatccattcgtgtaccatggtgctgctgcaccgtacccgaaccctcctctgcattaccctcagtaccattaccccggttactaccctccggtgccacccatgccttatcatcctcatcaacatcaacatcatcatcgacacatggacccagcgtggattcaggggcatttccctagtgggcccatgatgcctaaccctgcacctttcgtagagcatcagaaagccgttacaataaagaacgatgtcaacatcaggaaagagacccttaagcttgaacccgacgtagaaaattctggccacttccttgtttcgttttccttcgatgccaccgtttctggcagcatcaccatatatttctttgcaaaagaaggtgaaggctgcatcctcacaccaatgaaggaaaaccaacttgcaccagtgtctgtgcatttcgagcaaggccttggccagaagtttagacaggcagctggaactggtattgatttttcagtgtttgaagagtctgagttattgaaagtgggtgaaaaggatgtctaccctctagcagtaaaggcagacgcatcccctggtaatcatgatgagtcagatagatctccaacatctagtaacacaaactctcagattacgcaaacgatgtttgagaaggagaaaggagagttccgggtgaaagttgtcaagcagatcttgtgggtgaatggaatgagtgtatgtgtagcggatgtgcaaaggattctaggttccagacagatagatgctcaatttgcagacaaccagttgagaggctgttggagatataggtag

SEQ ID NO: 39563 - DNA, 303 bp, Glycine max
  Peptide Sequence Number=SeqID_131248
atgtggtttggacaaaataggagctgccgtatcgaatctggcaggctggcacgcaataaaggtaatagaatgaacaataaagccgccactttatttgttcgtggagaggtcgcggatgatgagaaggtgggggctctacctgaaggagaaggaattccgcacgcgcgccctacaaccacccaccactaccgacgggactgggctagtattgaatcgacccagaaaccaactcgcccaccatgttcctctactccaaacccacatcgaacaaagaaccatagtcgcgggctccaaacccagtag

SEQ ID NO: 39564 - DNA, 159 bp, Glycine max
  Peptide Sequence Number=SeqID_131249
atggaaagagatcagggtggtaccggaagcagagacgagaggttgaaggagaatgagttggcagaccaaaacaaaattgagtacgaagaatgtgtagagcaatcccctagaacaagtcgagggcactgttcgtcagaatcaccacacggagactattaa

SEQ ID NO: 39565 - DNA, 654 bp, Glycine max
  Peptide Sequence Number=SeqID_131250
atgaacaaagatggtgctggtgattcttctttcccagttgtaaaggatcaaactcaattttcggttgcccatgcacgttacagtaagagtaatcctatagccagatggcatatatgccagggttcaattaatagtatttctttctcaatggatggggcatacttagcaactgttggacgagatggttacttgcgagtgtttgattactcaaaagagcaacttatatgtggcgggaaaagttattatggtgctttgttatgttgtgcatggagcatggatggaaaatatattttgacgggaggggaagatgatttagttcaagtttggagcatggaagatcgcaaggttgtggcatggggcgagggacataactcatgggtcagtggagttgcttttgattcatattggacatcaccaaattcaaatgacaatggagagactgttacatatcgttttggttctgttggtcagcttttcattctaagtaaaactcattgcactgacacggatacggacaccggacacggacacgtgaacacctgtaatgttcaaaatatagaacctagtacgggtgtcgtgtcggtgtcggacactgacacggacgcgtgtcggataccggacacggcaaggggctggagtgtccgtgcttcatag

SEQ ID NO: 39566 - DNA, 267 bp, Glycine max
  Peptide Sequence Number=SeqID_131251
atggcaatcttcctgagtaatggaagtggaggcgaaaacagtaggaggatgatgagaaacagtgagaagccacaaaacatacctaaccagaacacggtgctgaatcgcgggaaagggaagatggaagaagcattgtatgtccaaatgggtgaagaaacaagaatggaggatgtgttcatctcaaacgaaaagtatttagccgatgacatggtgctaatagctggcatcctcagatttaacaactttattagtgggagggtgtggtga

SEQ ID NO: 39567 - DNA, 330 bp, Glycine max
  Peptide Sequence Number=SeqID_131252
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgagtgttaacacaaatccgggatggccaaaccagaagaattcgtcacttggacaaaacaagtggggtcccattggtcacattattgacatctttcattttaagagccatttggtcgacaatgacttcaagtttagttcccacaaccagaaccagctgtaa

SEQ ID NO: 39568 - DNA, 216 bp, Glycine max
  Peptide Sequence Number=SeqID_131253
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggggagtagtagaggcctgtcggcaggtgtggtggtggtgaaaagtaagagaagtagagaagcgagtgaaggcaaatga

SEQ ID NO: 39569 - DNA, 174 bp, Glycine max
  Peptide Sequence Number=SeqID_131254
atggatcaactcctggttattttcaaaggaggaggaggaggcaacagtgataaaatgtcacagtcaccaatagagttcgctaatgtttcgttaaaaacagaattaagaaaggaggtagttaggagaaagcagaagagaccgtcaagtaatgactgttactttttagctgtctaa

SEQ ID NO: 39570 - DNA, 561 bp, Glycine max
  Peptide Sequence Number=SeqID_131255
atggtgggtgctcgtcgcaacggaagcgaaggcgaggtcccagggtcaagaagtctgtgtccggttctcgccggttccgatttgcacctagtgagtacagtaggacgtgatgatgcagactctgtttctgtttcaacttcctcaaccttttccggttcggtgagtgaagcaattttttctctgagaaaacctaattcgggttccgtttggggttcctcggaagtgtgttgttgttccgtcgtgttcggaattggaaactccgtttcttggtccttaacgggagaactccagaacctactagccaaagaggaagatctgtacggcgcggatctacagcgagttaaaagcaaagcgtttctcgggggcgtgcttgaattggaagcaaaatcactatccttatcgacattcactctctcatggaacgtgatgtttgagcgtggtgggctttcgacggaagaagctgggccagttgggccagaggggtttgcagcggcaggggtggttgttggggcttcggatccaacagcagtagcagcggcagcggcagcgcgggggagctaa

SEQ ID NO: 39571 - DNA, 1683 bp, Glycine max
  Peptide Sequence Number=SeqID_131256
atggcgaacgactcgtcgtttttgttcgccggcattcgtttcgatagaaagaagttcggcgccgatattgccaggttccagaaaaaagacagtgatactgattcggcgatgattttgagcgccgccgaagacgaaggcgagaaaacaatagaacctctggaagaagagaaagtcgcggcgtcaacgacgaagaagaggaagcgcaagggaacctcttccgaaacggtcgaaggattcaatgtgttcagaagttcgacgtctgtggcgcagtcgaatgatgaagtccgagtcattgaggagtccgttgagctgtataataataataagaaggaacaaaataagcaactcgagcgggacgcaatattcagaaagcaacacaacattcatgtctctggttataacgtgccgtctccgcttcaaagctttgatgagttgaaatcaagatataactgtccttcatatttgttgcgcaatctgaaggaacttggatttagagaaccaacacctatccaaaggcaggctataccagtacttttacaaggtcgtgaatgctttgcttgtgcaccaactggctctgggaaaacccttgcgtttgtgtggccaatgcttatgaagcttaagttcccaacttcggtgtccttggttcaaataatcaactgtgttttacaggatccggaaaaaggcagcattcgagctgtgatcctttgtcatactcgtgaattatctgttcaaacatatcgagagtgcaaaaagcttgctaaaagaaaaaaatttcgcattaagttgatgactaagaatcttttaagaaatgctgatttttcaaaatttccatgtgatgtactaatatccacaccacttcgattacgtttggctatcaagaggaagaagattgatctcagcagagttgagtatcttgtcctggatgaatcggataagctatttgagcctgaattattcaagcagattgattctgttatcaaggcatgctcaaatccctcaataatacgctcactgttcagtgctactttacctgattttgttgaagatcgagctcgagaacttatgcatgatgctgttcgtgtaattgttggcagaaagaatatggcttctgaaacaataaagcaaaaattggtttttactggaagtgaagaaggaaaacttctagcaattcgtcaaagctttgccgagagtctaaatcctccggtattggttttcctccaaagcaaggagcgtgccaaggagctgtgcagtgaacttgcatttgacagcattagagttgatgttatccattctgatttgtctcaagcagagcgagaaaatgctgttgataacttcagagctggaaaaacatgggttttgattgctactgatgtagttgcccggggcatggatttcaaaggtgtgaactgtgtgatcaattatgatttccctgattctgctgctgcatatgtccacagaattgaaaatgttgatttttcattaggtcgttctggcagagcagggaggactggagaagcgattactttttacacggaagatgacattccattccttcggaatgttgctaatcttatggcagcatcaggctgtgaggttccttcctatctcatgaagttgcgcaaaaagaagtggaagaagcaccgacccaaaagagattcaatctccacaaaaccagacctatag

SEQ ID NO: 39572 - DNA, 417 bp, Glycine max
  Peptide Sequence Number=SeqID_131257
atggaaattgaatgtatcaagcgcttctctgtaatgccgttgcttgcacatcaagttgatgtggcagaacccccgcatggtttgggccacgggggagttctccaggtcctcaaaaacggtgtcgttctggcagaacaaggtttgggaattgggagtgagagggcacggagtggaggacgcgtgactctgtctagaggaacttcacgtatttgtaagcttcttccagaagcatcgcttggtccgttttcttgtcccacggcatcagcttctggagacaccgtgttttctggcttagcttctgacgacgttggcgagccaggttgctctgcgggatcaccggaggtcattacgactccacgcgctgccacttctgctccggcgagtagaggggagggaggcggaggtgtatctcattaa

SEQ ID NO: 39573 - DNA, 336 bp, Glycine max
  Peptide Sequence Number=SeqID_131258
atgtgctgcactagagttcaagaattattaaagcctgaagaccacgaagaaggacgggtgcctcgaacagtggaatgtgaacttacccaagatcttgttgatgcattcatacctccagggacgaatcatgaccctaaatcagtccgccactgcatacctggagatgtggtgactgttactggaattataagaggaattaacacttacatggatattggaggaggtatgcctgagcttgcatgtctttgttatccaccatatatggttccctgttttaacacttgcttggatgttgaagggaaagcaaatccaagtttgttagtcaaagatacctga

SEQ ID NO: 39574 - DNA, 1866 bp, Glycine max
  Peptide Sequence Number=SeqID_131259
atgcagacaccaaaagcaagagttggtgcttcagaagtgccccaaaagaaatctcctgcaactcctcgaactgctcgtcagttgaagacaccaaactctgatgcatactctgtctcctctccaaatgctgcaaaaaagactccgaaagatagaagtccaaaggttattgaatgcaggtcacctcatagtccaatatctgagaagaaacgacctagtaaggtccaggaattggaatctcagattgctcggcttcaagaagatctgaagaatgctaaggatcaacttaactcatctgagtcatggaagagaaaagctcaacaggaggctgaagaggcaaagaagcagcttgtagacttgacgaaagagctgcaggaatcccatcaacagcttttggacttttcggcttctgaagaagtgaggcttcaagagctccgcaaaatttctcaggatcgagatcgagaatggcaatctgaactagaggctgtccaaaagcaacaggcaatggattcagctgctttggcatctgccatgaatgaaatacagaaattgaaaattcaacttgaaagagtatgtgggtctgaagctactcagatcaacagttcagaatcagctcatgctgaaattcaggaattgaagatggagcttgataaaactctctctttggtagaaaagctaaaaaatgaggtaggtgattgcaaagaatctgaatccagggctttggaagtagttggtaaaatgcaaatgcaattggaaacagcaaatcagactgttgaaactcttaggtccgatgggatgaaagcagcagaagcttacaaatctttagcttttgagttggagcaatcaagaactcaagcaaaatcattggaagaacttgtgagtaaacttcaggctgatttgcttagcaatgctaacaaaagtatgttaggtccaactccaaccaatgaaaatgaaccttctcaggaaaatgaggaaataaaccagctcaaagccgagcttatctctgcaaaagctgaagtggggcagttgaagtccgtattggatatttcggaggtaagataccaggaagagtatatccagagcacattacagattagatgtgcttttgaacaactggaacgcgcaaagtcagaatctagtcagagagaggttgagttatatgaggaattgaggagagctaaagctgatactgaggagctaagggcaaacctgatggacaaggaatctcagttgcttagtttgtcgggtgagaatatggagctcaattccaagatcaatgaaaaccaatctactagaaggcaatctgagcttgtgatagagctaaaaaaattggatgctgatgttgaagagttgaaggaaaatttattagatagagagacagaactgcaaaatatagcagctgaaaacagtatgctcaagatggacataaaggaggagttggagaagaataaaatcaccaatgaagcccttgcttcagctgaagcagcaagggcggcagagcaagaggctttgacaaaacttggcagcataacagaagaggctgataaaagcaacaaaagagtggttcgggtgactgagcagttagatgctgctcaggctgcaaattcagagttggaagccgaactaaggagactgaaagttcagtcagatcagtggagaaaggcggccgaagcagccgcctctatgctttctgctggaaataatgggaaatttgtcgaccgaaactgctcacgtgaaaacagcttcaattctgttactggcaagatgaattcaccttatttattagacacagatggagagtcacctaagaagaaaaatacaaacatgatgaagaagattggagttttgtggaggaggaaccatcattag

SEQ ID NO: 39575 - DNA, 1122 bp, Glycine max
  Peptide Sequence Number=SeqID_131260
atggcagcaataatgttgacgactatgaatattcctctgcacacttcggtttgggttaattcccggcggaagagttggtgctgctacgcctcactttcgcagccagataggaaggagatccgtctcggtttgcccagcaaaggtcgcatgtccgctgacaccctcgaacttctcaagaattgtcaattgtcagtgaagcaggtcaatcctcgtcagtatgttgctgaaattcctcagctatccaacctcgaagtttggtttcagaggcccaaagacatcacaagaaaattgttatctggagatcttgaccttggtattgttggactcgatactttcagtgaacatggccagggtagtgaagatcttatcattgtccacgaggctctcgagtatggtgattgccgtttatcccttgcgattccccaatatggaatatttgaaaatgtaaattcagtggacgagcttgcaaaaatgcctcaatggacagaagaaaagcctctacgagttgctactggtttcacctatctggggcctaaatttatgaaagagaatggacttaagcatgtcacattttcaactgctgatggagcactggaggcagctcctgcgatggggatagctgatgctatcttggaccttgtaagtagtgggaccacactgagagaaaacaacttgaaggaaatcaaaggtggagttgttttggaaagccaggctgtgtttattgcaagcaggaaatcgatgatccaacggaaaggagttcttgaaacaacacatgagatgcttgagaggttggaagcacatctgagggccattgggcagttcacggttactgcaaacatgaggggaagcagtgcagaggaagtggctgagagaatactgagtcaaccatcattaatgggtttgcagggacccactgtaagtcctgttttctgcaagcatgatgggaaggtaacaccagactattatgccatagtcatatgtgtgcctcagaaggcactatacaagtctatacaacaactgagagcgattggaggcagtggagttcttatatcacccttgacctatatttttgatgaagaaactccaagatggcgtcagctcctatctaaacttgggctgtag

SEQ ID NO: 39576 - DNA, 681 bp, Glycine max
  Peptide Sequence Number=SeqID_131261
atgaaggtgggagcttatgagggagaaagaatgaaggtttatggtgtggtgtgttgggatcattatgagggatggaggggtctagaaaaagaggagatatcaaaatcattttctatatggtggagggatttgtgtaaaacttgtggtggattaaatgagtccaaatggtttgatgatatggttgtgaggaaagtgggaaaaggagacaaaactcagttttggaaggatatttgggtgggaaatcaatcgttggcaagtgagtacccaagattgttcttaaattctcttcaaaaggacgagtatggagccaattcaatatggggtagtgagatgagggagtctggaggtggaattgtgcttggcggagagagtggtttgtgggagggtgacatggttgagaacagttatgggggtgggggggtcgtgttggttgagggagcggaggattcttggttgtggccacatgaacaatctgggttaagtcttcatataaggctttgtgcgaaaggatcgaggattcaaatattaatgcacactttagttgatatgtggaaagtgaaacttgctcctaagcatgaatccgggtctctgcttgttggggcaatgaatcacgataacggtagaatggtggataagcaaggaaaaatgcaggcaccatgtgctgatagtggcttcgtgtag

SEQ ID NO: 39577 - DNA, 1071 bp, Glycine max
  Peptide Sequence Number=SeqID_131262
atgccgccgaagcagcaatcaaaagctgatcttgcgaagaagcagaagatcgtagaggacaaaaccttcggtctcaaaaacaagaacaagagcaaaaatgtccagaaatacgtccaaaacctcaagcaatccgtgcaaccaaatcccgactcttcaaaactcgctgccaagaaaaagaaggaggaagagaaggccaaggataaggagttaaatgatttgttcaaaattgctgttagtcagcctaaggtgccagttggtgttgatcctaagtccatattgtgtgagtttttcaaagtggggcagtgtaccaagggcttcaagtgcaagttctcccacgatttgaatgttcagaggaaaggggaaaagattgacatttatagtgataagcgtgacgaggaaacaatggaggattgggatcaagagaccttggagaaggtagtagagtcgaagaaaaccgagtataatcagaacaaaccaactgacatagtctgtaaatactttttggacgcagtggagaagaagcaatatggttggttctgggtctgccccaatggtggtaagaattgccactatagacatgcccttccccctggatacgttttaaaatctcaaatgaaggctctattagaggaggaatctgaaaaaataacaatagaggaggagattgaaaatcagcgcgccaaagtgacaactacaactcctatgactcctgagttattcatgcaatggaagaaaaagaagatagaagaaagagatgccaatttggctgcacaacaggcagaaagagctaagaatgatcgcatgagtggtcgtgagctatttttgtcagatgctagcttgtttgtggatgatgatgaagcatacgacaagtaccaaagagaaccagaatctgaatctggcgacactgaacagaatgcgaatggtaatgctactgaagatggtcccagcaccttgatagctagtgctgatgttgatgatgacgacgaactggacatggacgagttggatgaattagaagcaagcttatcaaagacatcaatacaaataaaggagttaggagctgaaacttaa

SEQ ID NO: 39578 - DNA, 714 bp, Glycine max
  Peptide Sequence Number=SeqID_131263
atggagagatcaccacaacaacatgaaatggccaaaaaaaaggtttccttggttgatgtggataaaaactacattgacaccccatcacagaacaaggaatttgagttccaaaccaagaaagtgtccttgagaacaagatacccagctgatgaactctttttcaaaggaaaactccttcctcttaaccttcttcctcgcgttcaaatggttgaaaagctcattgagaatgccgatgccaccacacctctccaagcttggaccatctctccctcagaatcacgcaagaccaagcgattcaggctggctcaaaggcttaaagcttcaaaaacttacgtaaaaactttgttcaacaaatatggttgctatgataatagttgtgccaatgatgccgcaacaagccataagaagaacgtgaaggatgatgctaggaaaaacaaaaacccatttgagttttttggccacaacaagcatcaaaggcaaagatcttgtgtggttaagaacaatgatgatatgcttgaagatggcttcattaatagcaataaaaggtcatgcgagttgcaattgttaaataagagtaccagggcagagcaagaaaattcaattaatagtgccatctctaattgtaagaagtcacaacaacagggtagttcaaacaaggtttgttcacaatctctagtttgtggaaataaagaaataactgggttgattcactaa

SEQ ID NO: 39579 - DNA, 1908 bp, Glycine max
  Peptide Sequence Number=SeqID_131264
atgagaaagttgtgttttaaccccaaaacggagtcgtttgctttggcacgcagttctccttcttcgccactatccttaacctcaagcccaacgcttccgaggctgagcttttccgaacctagcagcttccacgaagatattttcatcgaagaagctgaggcactgatactcaaatggaacccagactcttccgcttacgcaaaagtcacttccctcttctaccaagacagaaacgaagccaaacaatatattagctgtgttaaccagcttcagaaaactatgcattcgttgctctctcagaacctttcctctgacaaactcatcctcgctcataacctaatgcagattgctatgaagaggctcacgaaagagttctaccagatcttatccatgaaccgcgcacaccttgatcctgaatccgtctccgccagatcctctcgcacctccgccaattccagcgcctccgattatgacgacgattttgcggcggaggacgacgatatccgcgccgccggcgactctatctccgaagtcgagcaggtttcctccggcgccatggcggatctgaaattaatcgctgactgcatgatatcttccggttatgcgaaggaatgcgtcagcgtctacatcttaattcgaaaatctatcatcgacgaaggaatctaccgcctcggcgtggagaaacttagctcctcgcgcgctaacaagatggattgggaagttcttgatttgaagatcaagagttggttagaggcgacaaggatttccgttagaacactctttaacggagagagaatactctgcgaccacgtcttcagttactcagattccgtcagagaatcatgcttcgccgagatttcaagagacggtgccgctctccttttcggattccctgaactcgttgccaaaacaaagaaatcttcgccggagaagctgttccgcgtgctcgatatgcatgctgtggcttccgaactgttgccggagatcgagtctatcttttcctccgattacaactccggcgttcgttctcaattcctggtttcgcttcaacgactcaccgaatcggcgcaaatcttgctcgcggagttcgagtccacgatccagaaaggcacttcaaagccggcggtgaacggcggcggcgtgcactcgctcacgattcagacgatgaattacctttcagtcctcgccgattatctcaacgtgctctcggatatatttccgcgcgactggcttccaccgcagaagtcgtcatctctgccggaatcttatttatacagcccagaatctgattactcggcgtcgacgccggcgctgacagcgcgttttgcgtggctgattctcgtcctcctttgcaagctcgacggcaaagcgaagcattgcaaggacgtttcgctttcttatctgtttctcgcgaacaatctctggtacgtggtggccagagtccgaagctcgaacctgcagtacgtgcttggcgacgattggatccttaagcacgaagctaaagcgaaacggttcgtttcgaactacgagaaggtggcgtggggagaagtggtttcgtcattggcggaaaatccagccgcggcggaggcgagggcggtgttcgagaacttcaaccgcaaattcgaggaagcgtatcggaaacagaactcattcgtcgtagctgacagagaattaagagacgaaataaaaggttcgatcgcgagaagtatagtgccgagatatcgcgagtggtataatgttcttctagctaaggttggatcagtgagggacttgacggcgacggagtacgtgacgtttacccctgaggatattgaaaattacctcgttaacctcttcttttttggaacctcatccagtgctgtatcgtcctcgtcggtatcgtcgtcccctctccggcgttggagttaa

SEQ ID NO: 39580 - DNA, 108 bp, Glycine max
  Peptide Sequence Number=SeqID_131265
atggttgcagatattttgaccgggtgtggtgcagataaagtatttcagaaattcacacggtatacaagtagggtatacagtgaatgtgaagatttgaaatttgaataa

SEQ ID NO: 39581 - DNA, 297 bp, Glycine max
  Peptide Sequence Number=SeqID_131266
atggcactgtcccaatggccttcagccaccttaccctatctttgcggtagccaaaaggtgattttgaaagctgctttttttggggggccaaaactcagtccagttcaaaataagagcactagattgggtctgattggactaactgcaattagggcttcaagcccatctaattatgaggcgttacttccgcttgcaggcttcggacattctagaagcaaaaatattaaagaacttctctgcccatttagaggcataaatacgaatcaccgcgcttcttcctcatcacactgtcactga

SEQ ID NO: 39582 - DNA, 1284 bp, Glycine max
  Peptide Sequence Number=SeqID_131267
atggctggtgataaacaaaaactctttaacagactgaagccattcataggtgtagtgttcttacagtttggatatgctggtatggatattctatccaaagctgcactgaacaagggaatgagtaactatgtatttgtcgtgtaccgtcatgtttttgcctttgttgtcatggccccttttgcactgatcttggagaagcctgttattgaccaaaatttgtattttttgggcatgaagtacaccacagcaacctttgctgtttccatgtacaatgtcctccctgccattacctttgtcatggcttggattcttaggcttgagaaggtaaaactaaaaagtatacgcagtcaagcaaaggtggtagggactttagccactgttgtaggtgccatggtcatgaccctgataaagggcccaatacttgatctttttggaacacacgcaagtagtacccacaaccagcaaaatggtggggtgaatcttcaacatgcaataaagggatcagtgatgatcacaattggctgctttagttgcgcttgtttcatgattctccaagctattaccattgaagcctaccctgctgagctctctcttacagcatggatatgcctattgggaacagttgaaggtggcgtagtggcactggttatggaaaggaagaatctttctgcttggtctcttcaatgggatacaaaactgcttgctgctgtttacagtggcatagtttgctcgggaatggcttattacatccaaggagcagtgatgaaagatagaggcccggtctttgtaacaacttttaaccctctctgcatggtcattgtggctatcatgggctccttctttctggctgaaataatgtaccttgggagggtggttggagctattgtaattattttaggactgtatcttgtggtgtggggtaaaagcaatgactacgagtcatcaaattcaattactaaaaagcatacattgccatccaagcaaacagtagaggaggagcattctaatcatgatgtcatcactctcagtaacttaggcgcgggaaacatagttcgagatgaacaagttcatcgttgtttgaacaattatgatgtagtagtagaggtttttaatgtagcactgtggtatgtcgaatgcataactaaaacagtaaatggctcagcaggcatatataatactacgaaacagggttggatgaaaaacattttctacctaatgacgaaagcatgccctcaaaagacaatgcagatagaagatagaccaatatccttcatctttcaatga

SEQ ID NO: 39583 - DNA, 981 bp, Glycine max
  Peptide Sequence Number=SeqID_131268
atggccataaccgccaccatttccgttcccttcacatcccccagtcgccgcactctcgcctccgtcaatagcctctctccgcgttctacccgatccactttgcccacaccgcaacgcactttcaaataccctaattcgcgcctcgtcgtgtcttccatgagcaccgaaacagccgtcaaaacttcatccgcctccttcctcaaccgcaaggagtccggcttcctccatttcgccaagtaccacggcctcggaaacgacttcgttttgattgacaacagagactcctccgagcccaagatcagtgctgagaaagcggtgcaactgtgtgatcggaacttcggcgttggagctgacggagttatctttgtcttgcctggcatcagtggcaccgattataccatgaggatttttaactctgatggtagtgagcctgagatgtgtggcaatggagtgcgatgctttgccaaatttgtttctcagcttgagaatttacatgggaggcatagttttaccattcatactggtgctggtctgattattcctgaagtcttggaggatggaaatgtcagagttgatatgggggaaccaattcttaaagcctcagatgtgcctactaaattacatgcaaataaggataatgctgttgttaaatcagaactagttgtagatggagttatctggcatgtgacctgtgtcagcatgggaaatccacactgtgtaactttcagtagagaaggaagccagcggggagcaggagcaaccctagcctgtggaactggagcttgtgctactgttgttgcagcagttcttgagggtcgtgctgggaggaattgcacggttgatctacctggaggacctcttcagattgaatggagggaggaagataatcatgtttatatgacaggctcagccgatgatttagagaaaattcaagtggtttggacagccttggcctctaactctaactactatggcgaatag

SEQ ID NO: 39584 - DNA, 2946 bp, Glycine max
  Peptide Sequence Number=SeqID_131269
atgacgtcgttcttgaagcctgagaatgctctgaaaagggcggaagaattaatcaatgttgggcagaagcaggatgctttgcagactctccatgatctcatcacctcaaagcgatacagagcgtggcagaagacacttgaaaggattatgttcaagtatgtggagctttgcgtcgacatgcgaaaaggccgttttgcaaaagatggtcttattcagtatagaattatatgtcaacaagtgaacgttagttcactggaggaggtcataaagcattttatgcagctttctaccgagaaagctgaacaagcccgtagccaggcgcaggcactagaagaagcccttgatgttgatgatttagaggccgataaaaggccagaggacctgatgttgagctatgtcagtggcgagaaaggaaaagacagatctgatcgggagactgtgaccccatggtttaagtttctttgggaaacttataggacagtgctggaaatattgaggaacaactcaaagctagaagccttatatgctgtaatctttcttcttatgttcttgtacaacttcttgatgctatacatgattcatatgtatttgcttaatatgacagctcatcgagctttccagttctgtaagcaatataagcggacaacagagttccgcagactgtgcgaaatcattagaaatcatttggctaatcttaataaatatcgtgaccaacgagaccgacctgatctttcagctcctgaaagcttgcaactgtatcttgatacaagatttgagcagctgaaaattgctactgaacttggactctggcaggaagccttcagatcagtggaggatatacatggactgatgtgcttagtcaagaaaacacccaagccatccttgatggttgtttattatgtgaagctgacagaaatattttggatatcatcgagtcatctgtatcatgcatatgcatggttcaagctctttttattgcaaaaaagcttcaataagaatctgagtcagaaagatttgcaattaatagcttcatctgttgttctggctgcactttcagtgcctcctcatgatcacacccacggtgcatctcatttggaactggagcatgaaaaagagagaaatttgagaatggctaatctcattggctttaatcttgaaactaaacctgaaagcagagaaatgctatcaaggtcatcacttcttgctgaactggcatccaagggtgtgatgtcttgtgtgactcaggaagtgaaggacatttaccatcttttggaacatgagttttatccctctgatcttgcattaaaagcgctgcccttaataactaaaatctctaagttagggggtaagctttctactgcatcatctgttccagaggtgcaattagctcagtatgttccagcacttgaaagactggctaccatgaggttgctgcagcaggtgtctaatgtgtaccaatctatgaagattgaaaccttatcggggatgatccccttctttgatttctctcaagtggaaaaggtttcggtagatgctgttaagcagaagtttgtatcgatgagagttgaccacatgaaaaatgctgtgattttttgcaaaaagagtcttgagtctgatggcttaagggatcacttggccaattttgctgaacaattaaataaagcaagacagatgatttatcctcctgataggagatcatcaaaacttggagctttacttccctctttgacagaggttgtggccaaagaacacaagaggcttcttgctcgaaaatcaattattgagaaaaggaaagaagaacaagaacgacagcttcttgaaatggaacgggaggaggagtcgaagaggctaagactgctgaaaataactgaagaagcggaacaaagaaggcttgccactgagtttgagcagaggaaaaatcagaggatcctcagggagatagaggagagagaaaatgaagaagcacaagcattactccaggaagctgaaaagcgtattaaaaagaagggaaagaaaccaatcatagagggggacaaaatcaccaagcagacattgatggagttgactttgactgaacaactccgggaaagacaggaaatggaaaagaaactgcagaagttagcaaaaaccatggatcatttggaaagagcaaaaagagaagaggctgctcccctgattgaagctgcatatcaacagcgtctagtggaagagagacttcttcatgatcgtgagcagcagcaagaggttgaactgagcaaacagaggcacgagggagatctcaaggagaaggagaggcttgttcgcatgatgggcaataaggagatatatcaagcaagggtggttagtcaccgccaagcagagtttaacagattgagaagagaacgggaagagcgaatctctaggattttacagtccaggagacaggagagggaaaaaatgaggaagttgaagtattatctcaagttagaagaagagagacaacaaaaattgcatgaggaggaggaagctcggaaacgtgaagatgctgaaaggaaaaagaaggaagaagaggaacgcttgcggaaattggaggagatagctgaaaagcagaggcagagagaaagggaacttgaagaaaaagagaaacaaaggagagaagcattgttgggtagagctgctgctgaaccagctcctcctgcccgtccattggaatcgggatctgctgctcctgctgcagctgcagctgccgccgcagctccaacaccagggaaatatgtccctaagttcaggcgacagagaactgaaagcacaggagctgcgcctcctccagagacagaccgttggaacagtagcagcaggccagatggtggtgacaggtggcgtggtgatgatcggaaaagtgcatttggttctggtggaggttcaaggtcatcttctacttggacatcttccaggaatgcccgttga

SEQ ID NO: 39585 - DNA, 1329 bp, Glycine max
  Peptide Sequence Number=SeqID_131270
atggtggctaagcaggtgcttaacgacgagatgtttaccatcctagtactcatggctctcttcaccaccttcattacaactccaatagtcttggccatatacaaaccctctcgtatagtaaactccggttcgcaaaaaccgtcgcggctaacagatttgcaagagaagcttcgcattcttgcgtgcatccatggacctggcaacataccctcactaatcaacttcgttgaatcaattcgggccaccaacatgtcacgactcaaactctacgtgatgcaacttaccgaactcactgatagctcttcctccatcttgatggttcaacgcagtcgaaagaatggttttcccttcatcaaccgaatgaagagtggaccaatgcatgagcaaattgccacagcattccaggcttatggtgaagtgggtaaagttactgtgcatcatttaacatctatctctctattgtcaacaatgcacgaggacatatgccacgttgcagaaaagaaaggtgtggcaatgattatattgcccttccacaaaaggtggggaggggaagatgaagaggtgacagaagacttagggcagggtttgagggaagtcaatcaaagggtgcttcaaaatgcagcctgctctgtcgcagtgctagtcaatcgtggggttgccagaaggtacgaacaagaacctgagacaagtgttgctgcaaggaaaagagtgtgcatatttttcattggtggaccacatgatcgcaaggttttggagttaggtagcagaatggcagagcatccagcaattaggttgcttttagtgagattcacttcatacacagaagttggggacgagggacccaaatataactcaccaacatcaaccaccaactgggaaaaagaaaagccaataactagaagcaacttaagaatggatatcttatcaagggccagccattctcacaaatttaactctcatgaccaggagttggatgaggaagcagtaaacgagttcaaggttaaatggcaggagactgtggagtacattgaaaagaacgcaaccaacataacagaggaggtgttatcaattgggaaagctaaggatcacgacctagtaattgtggggaagcaacaacttgagacaaccatgttgacaaacatagattttcgtcacgggaatgaagagctgggacccattggagatctctttgtctcttcgggtaacggcattaccagttcattgctcgttatacaggaccgatatttgataaattcaaacgaaagtaatctcgttaagacatcaagggccgagagtactgtgattaaagatgctatcgaagaactttaa

SEQ ID NO: 39586 - DNA, 975 bp, Glycine max
  Peptide Sequence Number=SeqID_131271
atgggttccctccctcacgtagtagaggactgcatgggcttcctccaactttatagcgacggttccattttccgttccaacgacatagaattcaaagtttcacccattcaagacaactccataacctataaagattatctctttgacaagagattcaacctttctcttcgcttctacaagccccaacacgtagcacccatagacaataacaagaagcttcctattgtgatgttccttcacggtggaggcttttgcttcggttcgcgcacgtggccccatattcacaactgttgcatgcgcctcgcgtcggggctccaagcggtggtggtttcgccggactaccgtctggcgccggagcaccgtcttccggccgcagtagacgacgccgtggaggcggtgaggtggctccagaggcaggggctgagcttgaaggaggacgcgtggttgagtgggggcgttgactttgattgcgtgttcgtggtgggtgactcgtctggcgggaacattgcgcaccacctggcggttcggttggggtccggttcgagagagatggacccggttcgggtacgaggttacgtgttgtttgctccgttttttggcggggaggttcggaccaagtccgaggaaggtccaccagagcacatgttgaacctcgagttattagacagattttggaggctgtcgatgcctgttggagagagcagagaccacccattggcgaatccgttcggacctggaagcccaaatcttgaacaagtgaagcttgatcctattttggtaatagtaggtggcaatgaattgctcaaggatagggcaaaaaactatgcaacaaggttaaaaaaattagacaaggacattaaatacgttgagtttgaagggtgcgagcatgggtttttcacgcatgattcattctcatcagaagttacagaagaggtcatccaaatccttaaaggattcatgcttgcaaacttctag

SEQ ID NO: 39587 - DNA, 1335 bp, Glycine max
  Peptide Sequence Number=SeqID_131272
atggcaaaagtggctaaaccaagttctgtgccctcgagctctcaccaacttggctccggacctttgaaaactggatctatggctagaaagaagacaccgtcagaacttaggggagagctgttgaagcgggcaagtgttgtggactttactgatgaatctcaaccccccttggctgatcctacaaagaccactgaagtggacaatggatttaaaaaatcaaagttgtggaagccccctagatacacagacacacgggttgatgaagtatttgctgccaaaaagtccaggtttaaaattgcatctggcaaggaaaatgcaaaggaaaatccatctttggggcaaactagtaatctgaagaatctttcagttttttcaacttttgaggctaagggacatcaaggaaatacatgcttggagaattctgttacttccagtgaggtcagcaaagctagtgtattacaatcttgccaaacatttgaaaagtggagccaaggaaaatttcgtagtgttgctgaactttcatcagctgttgatacatcttgtggcacggctactattgacctgggaaaagcattaagaggactagctgcacttgaaccatctaatcctaatgacacggctgctgatttgtctgaaggacaagatttgacagctgttaaaggaaatttcttatccgaattccatttaccgggcaagaaggtccttttggatcttactctaaaaaccagcatgcggattgtatcctcctcttctgtgaattggtttctcttgacctcactgtctagtgtggacgtacctgtcttatgctctcctgtgccatttcaaaattctgctttgtcttctcctgatattaaatgtgtggagactagaagagctgaagacattgctgcttcttacaatgggtctatatggaaagatggtgagtcggcacaagggtcatcagatagcctttgtaccattgaaattaaggatgcacttcttccaccttggattatttgtggtatatgtgcattgatggcctctgaaggaagaagctttgaggcaagctgtccaaacaattggggttatggtcaaggctcactctctgaccttgttgaaatgcaagccacgtgttggagttttgtgacggaacctagctcaattggcttgaatgttgccttaaaatcaacttgtgaaaagccggaatctaaagctgccggcagtgaaagcttacaagaccacggaagtacttttggcattccagaagctgtagtcacttctggactgtgttcatgttcattaaaaggcgtaaggtacagtgatgaatcttatacagcatcgctatcccctgtatga

SEQ ID NO: 39588 - DNA, 501 bp, Glycine max
  Peptide Sequence Number=SeqID_131273
atgtctcgcaaccaagctaggcaggcatatgctcttttgcattgctcagtctcatcttttgctttttgtgtactgacttcaagtaactcaactaacaagtcaacaacttcctctatatcaatagcatcaaaggtatggaagacacctgtaatgggaaaatgtaacaaggatgccacatcattgagggttatggtcaactcttctattggtagatggaaactactagtttccttgtgccacattttcgcaaaagcaagtaaatttcccctatcacttttctccaacgaacatgtaatcagagaacttaattttgtagaagccactatgcctttaatctcaggtaggggtgggctaaaggcccaagtggagaaggacgaaggctcaagtggagaaggacaaagccccgagtggagaaggatgaaggcccaattggagaaggatgaaggcccagaggcagagacactatcaagactattaattgttgctgaaggcccaaactaa

SEQ ID NO: 39589 - DNA, 315 bp, Glycine max
  Peptide Sequence Number=SeqID_131274
atggcacccctttgtgtcgctggaagccaccaaggaggtccttccatgtggcaacttctccatcatccacctctagtaaggcaacaacaccatcaccatcttcaaaccattctctcgagaaaagaagccactaactcaaaccttggtgagaacctaacacagggaagaaggaagagaaagtcaatggtggaagcctcacttgtcagtggcgaaagcttgcttgttgtaggtgatgttgtaagtgaaggcagtggtggtcgcaaaaccaaggtcggtgatgacaatggtgatgagaatggaaaagagggagaatga

SEQ ID NO: 39590 - DNA, 1101 bp, Glycine max
  Peptide Sequence Number=SeqID_131275
atggaatctgaaaacagggttgctgtggaggtagagaaacgtattattggggtaacaaccaaggtggagaatataaagaaagaagtagaaaatgactgtaatggcgcagaaattcagactaagaatgaagtttctaaacccacagtggatgctaaaggccccatttctgctggtgacaaagttgtaattgaagcctctaaaacttctgcaaataaaaattcaaaaggtgccaaggaaactggtggtagagcaagtgttgcttccaggagcaacaaatatgccaaagacaaacccattttgaagggtccaatttcaatatctcaaaaactaaggccatccctttcacaaagcctttctttcccagccaaatcagctggtgaagatgctatgcagaaaagcattgatgggtatcttgtgaagccaaaagttagacatattcaaggtaatgggatcagaggtgagggccacattcgtcatttaaacaagtcaacaaactctgaagtcaactccctggcaaaaaccaacactggcatgcctgctttgaaacgctctgcgtttggtaggtccactacagttactgcattcaccaagagccaaacttctgaggcatcgttacccgttgatcaggtgtcaagcacagcaaaaactgcaaaagcaaataaagaggatgatgattctcattccacaacttcaagtgctaccccttgtctgagaagcaatggaagtggattttcctttagattggaagaaagagctgagaagcggaaggaggaaaaccaagaggcagagatcaagctattgaggaagagcatggcattcaaagcaactccaatgccaagtttctataaggaaccacctcccaaagttgagctgaagaaggagaagataagtcttatcttcggacttgataataaagatgtggtttcaaagaaaccaatccggaaaacccaagccaagctgaattctaaggaaaatgtaaccacagaaaacaaagaagaatgccaagatccacatgatgttaacaattctgaatgcaaaaatgaaatggagttacaatctgaaacagttcatgcaccaaatagtgcactgcttctaaattga

SEQ ID NO: 39591 - DNA, 192 bp, Glycine max
  Peptide Sequence Number=SeqID_131276
atgggatgtgaagataaagttggtttaaaagtgtggggcacggagaggcgagggagtgagggactagcacagaaagatattgtttggtgtacggtggtgagtgtcgacgctgccactctcgcctgtgtctgtgatgttagtgcggatgatgatatggattcggacttaaaatgtagcaacgttttttattaa

SEQ ID NO: 39592 - DNA, 885 bp, Glycine max
  Peptide Sequence Number=SeqID_131277
atgaacgacttgttatcaggtttgttctcaaagggaaaacaagaagagcatgtgattgagataacagaaggtggtggcataatggagttggagaagttcttggaagaagtggaatcagtgaaggaggacttgaaggagctagagcgtctccacctaagccttgatgctacaaaccaaaacggaaaagcgcttcacagcccaaagggcgttagggagctacggtctcgcatggacctggacgtggctctctctctcaccaaagccaagcacgtcaagggtcgcttggcggctctccaccgtgccaaccaagccaccctctccttgcccgattgcgggcccggttcatactccgaccggacccgaaccgcgctggtgggggccttgaccaagaaccttagacagtccatggcgagtttcaataagctgagggagcagatatcgtacgagtacagagacaccgtgcaacgtagatactacgctgtcactggagagaaccctgatcaagaaaccatcgacctcctcatctctacgggtgagagcgaaacattcttacagaaagccatccaacagcaagggagagccagtgtcatggacacaatccaagagattcgagagaggcacggcacgatgaaagagatagagagaagcctacacgagctgcaccaagtgttcatggacatggcagtgttgatccaacaccagggtgaacacttggatgacatagagagccacgtggaactcgcaaactccttcgtgagcaaaggggtacagcatttgcaggtcgtgaggaatcatcagaagaacacccgtaacttcacttgtttcgccgttctgctcttcatcatcgtgttggtcataattctccctattgttttcagaaattga

SEQ ID NO: 39593 - DNA, 2229 bp, Glycine max
  Peptide Sequence Number=SeqID_131278
atggcttttgttgtagactttcttgatatcaggagtacatttggtgcaagtgactgttcattgctttgcattaattcttccctggatgctccaatcaaacatcaagataatccttgggcttcatatataactgatgcctcacctactcatagtcaagattttggttgctttctcaacattgatgatatcaacgaggtttctgccacacgaaaagggtttaaaaaccaaataaaaaatttatggtggagaaaagggaaagaagatggtgcagattctctcaatggtcccacgtatgactttaattccattgaatcccagattcgagttttgggtgattatgctttcatgttacgagattatgaacttgccttgtcaaattatcgcctaatttccacagattacaagattgataaagcctggaagcgttatgctggtgtgcaggaaatgatgggacttacatacttcatattggatcaatcaagaaaggaagctgagtattgcatggaaaatgcttttaacacatatttagatatcctacattctgctgtgatgcttgaacaagcatcatactgctacttgttgtctaaaccctccatgttacacaaatatggatttcatctagtgctttctggtgagcagtataaaaagtgtgatcagatcaaacatgcaattcgaacatacagaagtgctctttctgtttttagaggaactacttggagttatataaatgatcatgttcatttccatataggacagtggtatgcttctcttgggatgtatgatgtggctgtcaagcatatgatggaaatcttggcctgtagtcaccagtccaagacaacacaggaattattcctgggcgactttcttcaaattgtcgagaaaactggacggacgtttgaggtaacaaaacttcaattgcctgtaatcaacatctcttcactgaagatcatcttcgaagattaccgaacttttggaacatcttcagctgctaatactagagaaggcttgtggcactctttggaggaagaaatgctaccatcattctcttctgccaagacaaattggttggagttgcaatcaaagcttatctcaaaaaagcacagtcaatcgaatgtttgtgttgcaggcgaagctgtgaatgtgaatattgaatttaaaaatcctctgcaaatctcaattcccatatctggtgttacacttgtatgcaagtattctgccagtactggtgatattagatcagatgagaatgagtcaagtgtggagaaagataatgaggttgaccactttaggaatatgagctccgacaattcctcatttatggtgtccgaggttgatttcttactaggaggcggtgaaacaaccatgttgaaaacaaacaccacacctaacagcagtgctggcaaagagcacctatgtcctttcctggcaaattcacagctccaggcaatcatcccacattcccactcaacaatagtggttttggggctaggctgctctatgccattatccgggatttataactatgctactaacctgttgtcagcagtttcccagatgttggaaagccaccttaattgtagcctcaaggagatacaactatcagttactcccagggcagagggtactcttgaaattcttggtgttaggtggaaactgtctgcttttcctcttctaaaatcccagagcatacccaagcttcagggttccattcaccctctacctggaaaggcgtatgctggagatttacgacaacttgttttggaattgaggaatccatcagactttcctgttaagagagagctttggttaggatatcagaatattggtctgaagaacgagcatgaaaaacttgaagttgctttgcgagaaccttctgcgtacaaagaagtcaagctccacgttcttggtgcaggtatgcaaaactggattgtgagcaagaaatacggtgtcagtgctcaaattgtcacaatagacctgaggtgtggagtgctgcactacaagtttggacagcagtgtttgcatccacgtgatttcagcagtggcatgagccaagctttgatattcaacctcagtgctggatcgggcaatgacagtctgctttttggaccaccaggatatgaggttagggtcaagaaacacacaggtcccagaggtagaatgtcagtcatatgggtcagatgcccaatcagcatcacagaagacagtgagggacaaagaaacacgcattga

SEQ ID NO: 39594 - DNA, 1452 bp, Glycine max
  Peptide Sequence Number=SeqID_131279
atggcaagttgggcaagttggcaagttggcagagagaacgcaaccatgataagaagcaagcaaattggtgtagaaatctcgtttctcagtcatcttaatctcaatggaatctatttaattacattctcctctttcatccagggtaaagaagaaaaaattgcttgtgtgatcggtgaccgatcaactagtgatgttgttgtgaggctacgcacacaggaaggtcgagatgattggctgtactgccattcagagattcttgtgaagaactgcaagtattttgctgatcggttgtctgagaactggccaacatgtcagatccttgattcccgcaactgtgttgatgtctattgccaggagttgaattttgattaccatgtaaatcttatacgccttctctacattgtcatagatggttcagttgatgatttgtggcatggtgttaggaatgcccttggcattctgcaggtcgctgttgagcttggatgcccacaaattataaatgcctgtgtgaattacttagaagcggtgacatgggaagaggctgaggaggatgagatattgaaaattgtacctcgaatgggattacaggcagagcctatcctagctagacttcaaccagttaaccagtctgctattgtaaacatctttgtctctgccctccgctttgctacatcatctccacctccacaactgaatgatcttaagtcttcggcacaagagcaacttgagtacatgctaactgaagatgatgatgcccctttgttgacagctgatgacaacataaaacttgaggttaaagaatgtgtaaacagactactttcccggtttaacgactcattaacagctttgttctgtggttccacagaatcactctctgaggctggaaatattcagttgtttaaatcctatttgactgatttgtcatgggcttgtcagatattgagtaagttggaaattatgagggagtttgttgagtattggtttgatgcatcggataagattgtcaaggtgcttgaacaaggaagttctacaactgaagtaattgagataaaattaagagctattgaggtgacatcaaaggttttagaggcaattgggtatggcactgttatattgccaactgcaaaacgccttcaggtcttgaaagtgtggcttccatttgtgagggttacaaaaccattgattgattctgtcacgatgaattgtgagaatgccatgcttcttaaattagatggcgaaatgtggcaatccttagaatccacgtttgtgtctatcattcttgcattgccttcaggggatcaagcagaggttttaactgagtggctggataatgagtacatgcagtatccagacttaactgaggcatttgaagtgtggtgttataggtccaaggtttctaagagaagactatcattgctagaggatgagcatgccatgactaactcattttga

SEQ ID NO: 39595 - DNA, 2040 bp, Glycine max
  Peptide Sequence Number=SeqID_131280
atggcgacatactttcatcatggtaactccgaaatccaatcgggtggcgccgacggactccaaactcttgtcctcatgaaccccggctatatccactactccgacgcgccgccgccgcagcagcaaacctcacaaaccgccggaaacctcgtgtttctcaaccccgccgcggttgctggaggaaataataactcgtttaacccccacgcgccgccatctcacacccaacaattcgttggaatccctctcccaaattcccaagacctcaaccaccactccatgcacgcgcaccacgatgtctcagccctgcatggcttcctgccgcgcatgcagtacaatccctggaacgcgctcgaccccgccttggcggcgcgtgaaaatccacgcgcgcagcaggggctgtctttggggttggggtcgttccgggagggtcaggcgccggccatgtccggcgacgacctgcgcatatcgggcgggtcgccgtcgtcggcttctggggttaccaataacggagcttctggcattcagagcgtgcttttgagctcaaagtacttgaaggcagcgcatgagcttctagaagaggttgtgaatgttaacaatggaattggcactgagttggggaaaaaaagaggggggcagaacaaggtagttggagaatcttccgcagcaggtagtggagatggttcagttggtggggaagggaacggaaagcgcagctctgagctatcaactgcagaaagacaagaaattcaaatgaagaaagccaaactaattggcatgcttgatgaggtggagcaaaggtacaggcagtaccaccagcagatggagatagtgggttcatcatttgagcaagctgcggggattggttcagcaaggacttacactgcccttgcattgcaaacaatctcgaagcagtttcggtgcttgaaagatgcaattgcagggcaggttcgcactgcgaataagagcttaggagaagaagattgctttggaggtaaaatggaaggttcgaggctcaaatatgttgaccatcatcttcggcaacagcgagctctccaacaattgggaatgatccagcacaatgcttggagaccccagagaggattgcctgaaagatccgtttctgttcttcgtgcttggctcttcgaacacttcctccacccttatcctaaggattcggacaagcacatgcttgcaaaacaaacagggttaacaaggagccaggtttcaaattggtttataaatgctcgagttcggctttggaagccaatggtggaggaaatgtacacggaggagatgaaggatcatgaacagaatcggtctgaggataaatcaagcaagagcaatgaagattctgcttcgaaaatgtcagccccacaagacaaaggtccttccaatgaaaccgaagctaagagtttcaattccaaacatgaggtttctaagagccagaacactgctatggtttcagtttctaggccatcaacatcaccacttggtgtgaatgtgagaagccaatcaggattcagcttcatggggtcatcagagctagatgggatcacacaaggaagtcccaagaaaccaaggaaccatgagatgatgcattccccaaatagtgtcccttcaatgagcatggatgtgaagcccaatgatgaaaacaatgagcagctctcaatgaaatttggggttgaaaggcaaggcagaaatgagtcctctttcatgggaaatcaaacaaactttaatggtgggtttggacagtatccaattggggatattggaaggtttgacacagagcagtttacaccaaggctttcaggtaatggtgtttccctcactcttggtcttgactcattaccaggaactcatcaaacatttctcccaaaccaaaacattcaactgggaagaagcttggacattggtgaaccaaacgagtttggtgccataagcacttcctctcctcactcaacagctgcttatgagagtatcagcatgcaaaacccaaagaggtttgctgcacaattgttgccagactttgtgacctaa

SEQ ID NO: 39596 - DNA, 258 bp, Glycine max
  Peptide Sequence Number=SeqID_131281
atggaagtggcagcagtgtggcacctaacgggcaagaggggcattttgtcgcggcactatgaggactcatactcaaatgctgacagcctcacactgtcatctgtttcctaccgtttctatacctatgtatactttgtcgtttcagagtcagtaatacgctgtaaaaaagtgaaacgcctgcggaaaggagccaaaatcacgaatgtgagcccaaacttggagagatttcctgcaagaaaaggacaaataagcatttga

SEQ ID NO: 39597 - DNA, 555 bp, Glycine max
  Peptide Sequence Number=SeqID_131282
atgggagaagggtgtggccttggtcatcttcaaattccactgcatcttcagtggacaacattgtcaggtccacaagaccagattagagtccacgtatataaccctctcgatgcaaggttcgagaaggtcagcgaggtactttctagcgtagttgagggattgttcgagggcttgtctgacggaggtggagatcaggttgcgaacgatctctggatcgaagtaatagaccttgatgttcaattgtgggaaggtggatttgacgagggatttgagatgttctccgggcactgggagtgttggaggattgagtggacggcgacgatggagccacgaaggtactccacgtcgagggtgatggccatgtggacaagggaggggtcacagacggaggtgaaaacgaaggaggcgcatttaccgttggcggcattgcggaatggagcagtggggcagagggaggcagaggaggctgtcgagatggtgggaggagcggatgttggtgccatggggacgaagccagagaggagagagaagacgacagagaggaatccatgctaa

SEQ ID NO: 39598 - DNA, 495 bp, Glycine max
  Peptide Sequence Number=SeqID_131283
atgcttcgtgccgtaattttctgtggggcaaagtggatattggcaaaaacaagcccttggttgtttgggggtttaggcctttttaatctcaaggactggaaccttgcgcttctttcccgtatcctgtgggactttcattgtaagaaagattctctatgggttcggtgggttcaccattactatttcagagggagcgatgtgtggaattacaatacttcttcatcagattcagttttgataaagaaaatcattcaaataaggaactttattatctctaaagagttaagtacgaaagaggccaaaaagaggattcaatcttggagcaccaatgaacaattgcttgttggcaaagtctatgaatacattagaggtgtcaagcctactgttagttggtgttctgttatatggaacccagcaacccccctaagatgtctttcattttgtgacttgctaaaaggaatcggctgcttactcttgacaaagttgtttttttga

SEQ ID NO: 39599 - DNA, 402 bp, Glycine max
  Peptide Sequence Number=SeqID_131284
atgtgtaccggagtctttgtttttctttctagtaaacttccattagttgggaacaccgcaccggattttgaagcagaggccgtgtttgatctggagtttatcaagtatcctttggtttctgatatcaccaaatccacctcgaaatcttatggtgttctcattcctgatcaggggattgcattgagaggattgttcattattgacaaggaaggggttattcagcattctaccattaacaacctggcaattggtagaagtgttgatgagacgaagataacactccaggctttgcagtatgtgcaggaaaaccccgatgaagtttgcccagctgggtggaagcctggtgagaagtccatgaaacccgaccctaaacttagcaaagactattttgctgcagtttag

SEQ ID NO: 39600 - DNA, 621 bp, Glycine max
  Peptide Sequence Number=SeqID_131285
atgtctggctcccgaaagaagcttcttctgaacaccgtgtccgtgaaactaggctgcggcacctgcagaagaccaagcctgcgtcgcatattccacccaaagccaaaaccaaagaatcttaacaacaacaccaattaccgaaagcacaaacattcttcttcttcttctgcttcttcttccttttttgcaagccaatgggggggtgacagcaccagcgccacccccaccaacaccaacaccacattctcaccctacgttgattcctcacacttttctgactcagattcctacgtgaaggctgtggggggtttaggcagagctgggaaagaaggtgtggctgtggagaaagactctgatgacccttatcttgatttcagacattccatgcttcaaatgatattggagaacgagatatactccaagcaggatctcagagagcttctgaactgctttcttcagctgaattcaccgcatcatcatggtgttatagtcagagctttcactgagatctggaacggtgttttctctgtgaggtccagttctcacatccaccttaagccactactggtagaaaatagaaatcacaatggaggacctgaatgcactgagtatggtccctaa

SEQ ID NO: 39601 - DNA, 840 bp, Glycine max
  Peptide Sequence Number=SeqID_131286
atgaagctcccttccctactacacaacaaaccctcttcttcttcttggccctgccaccaaccgcgaaccctctctttccgaacccaaaacgacgccgcattcaaaaccatcaacgccgcttacttggacacgctggagagctccgaaacttccttcttcacagtctcccctgactccggaagcttctcaactgcctcagaacaagattctagaagaccccactcactagactccgtcattcgcggcttgcgttccgaccgcttattcttcgagccagacgagacaagctccatattagaggccaaaccaccaccaccaccaccaccaccaccatcaccaccaccaccaccaacaacaacaacaacgttgccgttcaaagacagcgttgtcatgtccgtggactctcaggacccttacgtcgatttccgcaggtccatggaggagatggtggaggcgcagtgcgtcaaggactgggagggtctccaagagcttctgtgttggtatttgaaagtcaatggaaaaaccaaccatggctatattgttggcgctttcgtcgatttattggtcgcttcttcttcttcttcttcctcttcctctttctcggtttcttcttcttctaataataataacaactcccaaatagtatctccttcttcccctttatctttttatagctcttctctctcttcctcttgcagcactcgctgtgtttcttgtttggaagctgaggtcgtcgaggttcataatgatatagccactagtactcctacttcttctttcttgttacaacaagttagggaagaccagccatcatcttcttcttcttcctatttgaattaa

SEQ ID NO: 39602 - DNA, 1794 bp, Glycine max
  Peptide Sequence Number=SeqID_131287
atgtcagtctcatggaggtattctaatctaattccaatactcatacacggcctttatactttgaggacgattttctctattggaatggacaaattgcatactattaagattgaaactagatcccgagcacagacccctgcttcatctgctgttgcagttaaagcacgtttaaaagatgttagtaatgctttaatgacatccaaagagctacttagaattataaaccgcatgtggggtcatgaagatcgtccttcatctagtatgtctcttatctcagctctgcatactgagctggagagggctcgcctacaggtcaatcaacttatccaggaacagcgctcagatcagaatgagataaattatttgatgaagtgttttgctgaagaaaaggctgcttggaaaaaaaaggaggaagaaattgttgaggctgcaattgaatctgttgctggtgaactcgatgtagagaggaaactcaggagacgattagaaagcttgaacaagaagcttgggagagaactggctgacaccaaaacatcccttcttaaggtggtgaaagagcttgaaagtgagaagagagcaagagaaattattgagcaagtatgtgatgagttagcaagagatgctgatgaagataagtctgatattgagaaacaaaagagagtgtctacaaaagtttgtgaagaggtagagaaagaaaaggaaataatgcaattgactgataggttacgcgaggagagagctcaaaagaaactctctgaggcaaaatatcagcttgaggaaaagaatgcagctgttgataagctcaggaatcaacttgaagcttttctaggaggcaaacaagttagagaaaagagtcgcagttccactcacttgagtgatgaagaaattgctgcttatctcagcagaagccgattaggttcccatctcattgaagataaagaagatgacaggggagaggttgacaatggagtagaatgtgaggaggaatctgctgaaagtgatctgcattctatagagttaaatatggacaacaacaacaagagttataagtggacctaccctcctgaaagcagatttgatacaagaagatatccaattgaggaagaagtgaaaggtagtaggaggtctacctctgggaaagcttcaaggaaaagcacatcactgcaaaggagtatatcagatggaatggaatggggagtccaagctgataagattcaaaattcaggagatgggatagattgggaaagcttttatgaactggaaaagcaagctcaaggaaaaggttatgcagatgaaatgcaaggctataaatcagtgaaaggtctaagggatcagatactggctggttctaggcttgcatcttccagaggttatgccagtccaactagacaattttcccagccatggccatcacgagatcttgcaaataacttccaggaaagacctgctacagcacagggcaatggtctaaaatcaaggttaggggaagccaggggtgagggccagaatgtaaggaagtccaaaaggtccatacccgtttgcttctgctaccatgatggctggtatgatcgtgttcgtagagttcagaacatgtgttatataagtataacaagcgagtttttgttttctcctgtagcatatgctgaagcccgaagggtgtataaataccgaaaacttaaaatcaagccaaggaggagaaaaactcagaacccaattcgggcgaaaagaaattgtgaaattcagaagtcgagggacacatcaaagatcaaacatcgtgcgaggatcataaactga

SEQ ID NO: 39603 - DNA, 1461 bp, Glycine max
  Peptide Sequence Number=SeqID_131288
atggcaattggctttcagttcataataatcacactcttctctctattttcggctccctcactcacttttgcttttgtccctatccttcccagatttccttcttcagcagttagtgcagagctgaagcaacgctctcattcttcccaaaatgggctttacagaacaaaattcttcacccaaatactcgaccacttcaattttaatccccaaagcaatcacacttttcaacaaaggtatctcatcaacgataccttttggggtggtgccaagaacaatgctccaatctttgtctacactggcaatgaagggaacatagaatggttcacgcagaacacaggctttatgttcgaaaatgctccttcttttcaagcccttttggttttcatcgagcatagattttatggaaaatcaataccatttgggggaaacaagacggttgcatatgcaaatactagcacacttgggtatttgagctcaacacaggcattagctgattatgctactctcatcattgatttgaagaagaatttgtcagcaactgattctcctgttgtggttttcggaggatcctatggaggaatgttggctgcttggttcaggatgaagtatccacacgttgcaattggagctctagcatcctcagctccaattctccatttcatgggtttggtttcgccagatatcttcaacaacatcatcacacaagacttcaggagcgagagtgagaattgttacaaagtgataaaagggtcttgggatctgatagacgacacggccaataaacccggaggaatggaactgctgcggaaaacattcagaatatgcaagagcgatgattttgggcctggttctttggaaggttggcttcgggcggcgtggatttatacagccatgacagattacccgacaccatccaatttcctgaatcccttgccagcatatccggtgaaaaaggccattgacagctcagtaacgggaaataatagattagccaagttgcatgcagcagccagtgtctactacaactatacaggcaaagcaagatgtttcgatttggatgacaattctgatcctcatgatcttggaggatggcaatggcaggcttgtacggagatgataatgcccgtaggtggaagcaacaaggagagcatatttccagaatatgagtggtcatacgaagccagagcctcttggtgtgactttttctacaacgtacagccaagaccacactggattacaactgagtttggcggccatgctgtagagagagttctgaaaaggtctgccagcaacattatattttttaatggtttaagagatccttggagtggtggaggggtgttgaagactatatcaaaaacattagttgctatagttgcaaaaaaaggagctcatcatgtagacttaaggttctcaagtaaggaagatccacagtggcttaaagatgtaaggaaactagag

SEQ ID NO: 39604 - DNA, 957 bp, Glycine max
  Peptide Sequence Number=SeqID_131289
atgctcggagcttggaagagtaaaccgcaatttcctccagtgtgtgtgtctgcatttgagctacttttttggcagaaaatcatgttaagaatgggtttgagggctttgtttgctgagagcttccacaggttcttgtctactcagactggagggaagctacaagacaaggttgcgctgatcacaggcgcagctagtggaataggaaaagccacagctacaaaattcatcaataatggagccaaggttattattgctgatattgatcaagagcttggccaagagactgcaaaagaactaggacctaatgctactttcatagcatgtgatgttactcaagagtcagacatttccaatgctgttgatttggccgtttctaaacacaaacaacttgatatcatgtacaacaatgcaggaatagcctgcagaagtcctctaagcattgttgacttggacctggaactgtttgacaaagtcatggacataaatgttcgtggcgttgtggcaggcatcaagcatgcagcacgtgtaatgatcccacgtggaagtgggtccattctctgcacagcaagtgtcacaggtgtgataggaggggtgtcacaacacacttactcaatatccaagtttgcagttgtgggcattgttaaatctctggcttctgagctatgcaggcatggaatccgggtcaattgcatatcaccttttgccatccccactcctcttgtcatgggagaaatgagtcagatatatcctcatgttgatgctcagagacatgaggacattgttcacaatgctggtgtcttaaagggagcaaattgtgaacccaatgatattgctaatgctgcacttttccttgtgtctgatgatgccaaatatgttagtggacacaacttggttgtggatggaggtttcacatcttttaagaatttggacttgcctgcaccaaatcaagtgcagtag

SEQ ID NO: 39605 - DNA, 735 bp, Glycine max
  Peptide Sequence Number=SeqID_131290
atggttgttgaggtaccatgtgatggtgagggtttgaagaagaagaataagaagaggtttgatggtggtataagtgggtgtaggagcattctggtgtggagttctgggaatcattatgattatcagagagtgaggttggtatgggaaggggaagtggtgcgcaggataaggtgggtgcgcagagtagaaggaagcggaggatctggtggtgctaacgtgagcggggaccgggttgggttggcggcggctgcaggagatgaagaagcgttgagggagggagcggtgtctgtggaacaaaacgacgtcgccagcgtggaggcgtttgtctttgacgtaacggctccatcctttggtcaaaacgtaactctggctactgttccaataagagtaacggaagcgccaacacttcccggactcgtcctcgaaactcagcaacagccccttcgccgccgacgagtcgagagggaagtgcttctccgcgtgctgtttcggaatcacgagccggttcagcttcccgacgtcgctcggcgtcaacggcttctcgaacatggctaccttctcctcctcttgcgtcaagttattagtagccttgtccgaaacgataacgtcgtcttcctcctcctcctcctcgtcgttcagattgaaacgcgggccacatggcggcttgttgctgttggtcgttggtccagtatagtgttgtttccggtgaatagtggtttatcgatgacattgtga

SEQ ID NO: 39606 - DNA, 960 bp, Glycine max
  Peptide Sequence Number=SeqID_131291
atggaagcttcagctttgagtcaacgcatcatggaaggaagtcaatggaaactggcactcctcctgaattttcatccctctcatttgagaatgacaggcattcatcttctacatcctgtaaagaagattgaaaagtggaaactggaggaagaaaggagaatggaaaaggcaaggcttgctgaggaaacagaacaaggtcaaaatggtagtggctatattggtgggaccagaagagaggctcccccaagcttgcctaagaggacatggacatggcaacagagggttcaggtgcccgtaaaaggggcagatcggtgtgtgcactttggtcttcccaaattgatccaggtgacgatggtttaccacgacggatatggtggtgtcgaaattcctccgacaaaaccgcttgctccgcaaatcgtcactagagcggttacctctggcaagaactcttgctccgatactggtcgtgacttcatcagagcaagttttgctgccaacttcttcgctagatacaatgacaacatggtttctgcgttttggtgctccatcgttgtcgttgcggaagccataggtgatcttcgagatgcgtttgttgcgtttccacggtaccgaacaagcttagcaatcggttttgggtgctctcgagatcaatcccaagggatagagctagatgctgcaacggaaagaggtgggaagcagccatgggagacagctgcttgtcccttacacgtaatccttgaggtagctaggtctcttggtgatccttatgagtctgctagtgggtgccgtgatattggagttgctatcagaggtaactaccaatggcaaagcgtgggcttttgtggcggcgcaatgaccatgctagagaggaaattggccactgagcaacgtaggtgtgcacgccttgctttgcatggtgaagttattaacttcaatggaatccatgggaaagccaagtaa

SEQ ID NO: 39607 - DNA, 813 bp, Glycine max
  Peptide Sequence Number=SeqID_131292
atggggaatggctatagaaggagggtttcccctattacactagagatgttcagagtcttggatttggtgattatggacaaaggtgcccgttatagagatgatgttggagttgttcagatggtccaggatatctggcaaggaactcaacttctagctattgatgccactgccgccatgggtttacttagaagtgtcctgataggggatgaattgactgagaaagagaagaaaacactgaaaagaaccttgactgacatggcttctattgttcccattggagttttaatgcttcttccattaaatttgttcatctactgtatatgtgtttggggagcatcaacactccccaaaaaatgctatatatctgtgtaccaagggaagatggacaacgttgatttcctacaggttactgcagttgggcatgcagccatgttggctgctatcaagagatatgtaccagctcttagagctgccaggctttatgccgcaagctgggttcgtgacattggtcctgaccttcggcctgatgattataagaaggatgatgacatgactgatgaaacaaatggtgaaaagaaaacaactaaaggaaaagaatcctcaacactggaggaccttgctgtagctgcaagagggggaatggagactctcagaccggctttgcagcgtgtgtacatgaccagagcatctgcatacagagatgctcttaaaagtttcatagaagggtatcaagagggtgttcagcaagtaatggagaagaaggaagattccaaaactcaagaagatgctgatctacccaaaaaatcaacttga

SEQ ID NO: 39608 - DNA, 1209 bp, Glycine max
  Peptide Sequence Number=SeqID_131293
atgccggagattttagacggtgcaattcggcgagccgttgtcatcggaaacggcttcgccggcgctgagaatcagtgcattggtttggtccgtgctctcggtttctccaaccgccactccttatatcgcgtgacgaggcctcgaggaggaatcaatcggtggcttaaatggcttccggtttctatccacaaaaggttagactccgttatcagaatgatctgtggcaaatcgcgttttcaaacgcctcataaaatcggcatttctaacgtgttggatgctgatgctcaccacattgccaccatggcccgtgaaacgtttcataaggatggacccttgttggtgattgcatctgggcgagacaccatttctgttgccagctccattaaacggttagctccagaaaatgtttttcttgttcagatacaacatccaagatttcaactgaataggtttgatcttgtgattactccgcgtcatgattattttccgctgactcctcatgcccaacggcaaataccttggtttcttcgaaggtgggtgactccatgggaacctcctggccacaatgtggtcctcactgtgggagcgcttcatcaagctgattccgctgctcttagggttgcagcttctgcctggcataacgagttagcaactctgccaaagcccttgcttgtggttaatgttgggggacctactggtaattgtccctatgatgtggatcttgtaaagaagttagtggttatgcttcagaatgttctatggagctgtgggagtatcaggatatctttctcaagaagaactcctgagaagatctccaaaattttggtcaaagaatttgccacaaatccaaaggtccaaatatgggatggtgaaggttcaaatccacatatgggacatctggcctgggctgatgcctttgttatcactgctgattcagttagtatgttgagtgaggcctgcagtactgggaagcctgtgtatgtaattggagcagaacggtgtacatggaagtttgctgacttccaaaattctttgcagaagcaaggggttgctcgaccattcactgggaatgagaatatgactgctgaaagctggagttatcctccactgaatgacaccgcagaagctgccagtcaagtggttgctgctcttgctcagcgaggatggactatccagtgcttgctagctgaggccgtttcgttctattga

SEQ ID NO: 39609 - DNA, 774 bp, Glycine max
  Peptide Sequence Number=SeqID_131294
atgggaaatatgccaccaggttatcgcttctaccccacagaagaggagctgattttgttctatcttcacaataagcttgaaggagaaagggaagacatgaatcgagttattccagtcgttgatatatacgactacaacccatctcaactcccacaaatttcaggagaggcaagtatgggagacacggagcaatggttctttttcattccgaggcaagagagtgaagccagaggaggaagaccaaagcgtctcacaactacagggtactggaaggccacagggtctcctaatcatgtttattcttcggataatcacatcatcggaattaaaaggactatggttttctatagtggaagagctccaaacggaaccaaaaccgattggaagatgaatgagtacagtgccatcaaaggtgaaccatcatcctctatttccaataaggctgttcccacgttaaggaaggaattcagtttatgccgagtgtacaaaaaatcaaagtgtttgagggcatttgatagacgaccacctccaaggagggacgtagttagctattccggtgctcaaaatgtagaagagcaacaaaagggttcaacattatatgattatcatcataaaataatggtgaagagaagtacaacgtgttcaccagagacttctacttcctccggagaccatgaccagccccctcttcacggtgaggaaactactcaaatggatgttgacccttttttggattgggagaaagtggattttttcttgggatcagaaccatga

SEQ ID NO: 39610 - DNA, 390 bp, Glycine max
  Peptide Sequence Number=SeqID_131295
atgccgctcctccctctgctgcttcactcctcttccagagaactaatgctaaccctgcaacccagtgcatttatactctccattctagggtttcaatttcactgctcactaagccttcctgggccttcgaattggatggattcgtacccatttgtgatggcacttgctacgtgcacccagcattattgctggggcacccagcaaacagtgaagtggcgaaactgcccttcagcaattattcttccggaagaaggttcttccggaaaacaatttccggaagaacgtcatccggaatgtttccggaagaagcttcttccggaagaattccagtgtcttccggaagaagcttcttccggaagtcttccggaagaagcttcttccggaagttag

SEQ ID NO: 39611 - DNA, 858 bp, Glycine max
  Peptide Sequence Number=SeqID_131296
atgtattacaagggaatctatcatctattctaccaatacaaccccaaagggtcagtgtggggtaacattgtgtgggctcactcagtgtcaaaggatctcatcaattggaggtcccttgaacatgcactttacccatccaaaccatttgacaagttcgggtgttggtctgggtcagccaccatagtcccaggtaaaggaccagtgatcctctacaccggagttgttgacgacaaacaaactcaggttcaatgctatgctatacctgaagacctaaacgacccactcctccaaaaatgggttaaacctgacaaattcaacccaatcttggttgctaacaagggtgtcaacggtagtgcgtttcgcgacccaacgacggcatggttgagcaaggacggtcactggaagatattggtgggtagtagaaagaatcttacaggtatagcttatttgtataggagcaaggactttatgaattgggtgcaagccaaacatccgatccattccaagggtgaaactggtatgtgggagtgtcctgatttttatccagttttgcttagaggcaatgcagggttggagacgtccgaggaggggaatcatgtgaagtacgtgtttaagaatagtcttgacattacaaggttcgactactatacagtgggaacatattttaaagataaggatagatatgcccccgataacacctcagaggatggttggggtggacttaggtatgactatggtaatttttatgcttccaagtcattttttgaccccagtaaaaatcgaagaatcttgtggggttgggcaaatgagtctgataccaaggaagatgatgttcgcaaaggatgggcgggaattcag

SEQ ID NO: 39612 - DNA, 759 bp, Glycine max
  Peptide Sequence Number=SeqID_131297
atgttgggaaaaaagagtttcaagaaactggcaaaaaaggtgaagaagggtgtaggtggaattgaccctgaccctgtacgtcacgagtgtttgctgaaggaatatgaagaagaatgtgctactaacacacccccaattggtttttttgcagtttatgtcggggaagagcgtcaaagatacgtggttccgacccgttacctttctcacccgttattcaagatgctgttggagaaggcttacgatgagtttggattttcacagaggaatggccttgtaattccatgcagtgtttccacatttcaagaggtggtgaatgctattgaatgcaacaacgacaagtttgacttgggaaaagaggcttactcaagcttgaggatagagacttcccaagctatttatcttctctctcagagaggcttactcaagcttgaggatagagacttcccaagctatttatcttctctctcagagaggctctctacttggattgactcattatacggtggctcgctcaagcttgaggatagagacttcccaagcaatttatcttctctctcagagagactctctacttggattgaatcaccctatggtggctcactcaagcttgaggaaagagacttttcaagctatttatcttctctctcagagaggctctctacttggattgagtcaccctatggtggctcactcaagcttgaggatagaaacttctcaagctatttatcttctctctcagagaggcttactcaagcttga

SEQ ID NO: 39613 - DNA, 1482 bp, Glycine max
  Peptide Sequence Number=SeqID_131298
atggaagccgtaacaggctcccaccatttttccactctctccctttctttctctcacaacaaaaccttgcgctcttcttctgccaaatcaatcaggctttcctctccttcgaccaacgcttccttatcttccagaaactggttcgcgaaagaggtatggggttgggtgaactccaactccaaaggcgtcgccgtgagaaggtacacacgcggagtggtggtcagggctgaaatgttcggccagttaacaagtggccttgagactgcatggaacaaactcaaaggagaagaggttttgtctaaggagaacattgtggaacctatgcgggatatcaggagagctctcttagaagctgatgttagtcttcctgttgtcagaaggtttgtgcagtctgtcagtgaccaggctgtgggtgttggtgtcattcgtggagtgagaccagatcagcaattggttaagattgtacatgaggaacttgtacaattgatgggtggagaggtttctgaactggtttttgccaaatctgggcccactgtcattttattggctggacttcagggagttgggaagacaactgtttgcgcaaagttggcaaattatctcaagaaacagggaaaaagttgcatgctagttgctggggatgtttacagacctgctgctattgaccagcttgctattttgggaaaacaggtggatgtgcctgtctatacagcaggtactgatgttaaaccttcagaaattgccaaacaaggtttagaagaggcaaaaaagaagaaaattgatgttgttattgttgatactgctggtaggctgcagattgacaagacaatgatggatgagttaaaagaagtgaaaaaggcattgaatccaacagaagtgttgctagttgtggatgcaatgacagggcaagaagccgcagcgttggtgactactttcaatcttgagattggaataacaggtgccatcttgacaaagcttgatggcgattcaagaggtggagcagctttgagtgtcaaagagcctgacaatggaatgttgatgaactcttctaagattttggtttgccctcagctatgggaggtatccggaaagccaattaaacttgtaggacggggggaacgcatggaggatcttgaacctttctaccctgatcggatggcaggacgcatactaggaatgggagatgttctttcttttgtagagaaggcacaacaagttatgcgtcaagaagatgctgaagaattgcaaaagaagattatgagtgcaaagtttgacttcaatgattttctaaagcaaacccgtactgttgcaaaaatgggttctgtctctcgtgtcattggaatgattcctggtatggggaaggttactcctgctcaaattcgagatgcagagaagaatttgctgaacatggaagcaatgatagaagcgatgacccctggtcttttctttctactgatcaatgatgttacatctgttgaataa

SEQ ID NO: 39614 - DNA, 309 bp, Glycine max
  Peptide Sequence Number=SeqID_131299
atggaccgcgtagctgctatagcttatgaggctcattgtgctttgcacttcttgcattgcataggcttggcatacacagtggaattacaagcagaactgaaccaattgagagaagagaacgcccaactgaaacagggctgtattagtaattcaattatactgacaaggatcttgcttttattcttcatgccgagcccgagaggaaaagaaagcaacagttcatatcaagggtacacaagatattggtgtaacattgtcctttcacgttggtgggcactattgccagatattcagcatagaagcaattaa

SEQ ID NO: 39615 - DNA, 372 bp, Glycine max
  Peptide Sequence Number=SeqID_131300
atgactgaccctgatgttcctggccctagtgacccttatctgagagagcacttgcactgtttgaagttttgcaagatatatgcacccctttcatcacatcaaactatggacaggatagtgacagatattccaggcacaacagatgccacatttgggaaagagttggtgagctatgagatcccaaagcctaatattgggatccataggtttgtgtttgtcctgttcaagcaaaagcgtagacagtgtgttactccacccacttcaagggaccacttcaacacacgcaaattcgcagcagagaacgaccttgccctccctgtggctgctgtctacttcaatgcacagagggaaacggctgcaagaagacgctag

SEQ ID NO: 39616 - DNA, 348 bp, Glycine max
  Peptide Sequence Number=SeqID_131301
atgtgtgacctttatccttttcttccctcttgggacaagccgaaagaaaccattttttgtgtgctttcaagacagggcactgtgaatagtttctgggaaggaattgttctcacaatcatggaaaggctgaactcagagttgtactaccagaactgtcacatgatcaaagagaatgaaaggctgaggaagaaagctcagcttcttaatcaagaaaatcaacaacttctgtctgaactaaaaaagaagctctccaagggaaatgcaaaaaccaatgctgctccaaacaccattcttgacctgaaccttggatcaagttctagtcataatccttctggttccagcaattaa

SEQ ID NO: 39617 - DNA, 735 bp, Glycine max
  Peptide Sequence Number=SeqID_131302
atggcggaagggaaggaagagagtaaatctagcgaggaaagtgtgaagctgttcgtagggcaagtgccgaagcacatgaccgaacccgaactgcttgcaatgttcaaggagttcgcgctcgtcgacgaagtcaacataatcaaagacaaagcgactcgtgcttcccgaggttgttgcttcgtaatttgtccgtcaagggaggaggcggataaggccgtcaatgcgtgtcacaataaaaggacgttacccgggcttttaagtgttttgcattgtgctgtattttctcctctccggggcttatttgtatttgcatctagtccattacaagtgaagtatgcagatggggagttggaaagattagaacacaaactcttcattggcatgcttccaaagaatgtttctgaagttgaaatatctgctcttttctccaagtatggaactataaaggatttacaaattttaagaggctctcagcaaacgagtaaaggttgtgcatttttgaagtatgaaaccaaagaacaggctcttactgctttggaggcaatcaatggaaagcataaaatggagtattttggatcttcaagcggcattcagccacgaaatcctgttggctcaggcttgactcattatttatatggcaggctcgaactggatccaagcttggaaaggggaactcaagctattgcttgtgatgctcattatatgcttgcaataaaatgtgcccaagctgaataa

SEQ ID NO: 39618 - DNA, 2136 bp, Glycine max
  Peptide Sequence Number=SeqID_131303
atgggagaactaccggtggctagaacctatgccgtggagagccaccaccacaacttgctagaggctgcgattggagacaagcaattagccagagagtccaaaatacatagttatggaaagagcttcaacggattcgttgcacgacttttaccacatgaggcggagaaattgcaagaggaggacagtgtggtatctgtgtttccaaatacacaccgtaaactacacacaacaaggtcgtgggactttttaggaatgcccctaaacgtgaagagaaactccaaggtggaaagccatatcattgtgggcgtgttagatacaggtatttgggttgattgccccagtttcaacgctgagggctatggacctcccccacgtagatggaaaggcaaatgtgaaacgggagcaaactttactggctgcaacaacaaggtgatcggagcaaaatacttcaatctggcgaagagcaactcaccctcggacaacctgagtccggcggacgacatagggcacggcactcacacggcgtccacggcggccggagcagcggtgaagggtgcgagtctctacggcattggcaaaggcacggcgaggggcggggtcccctcagcccgcgtggccatgtacaaggtatgctggttagacgactgcaacgacatggacatgctcgccgcctttgacgaagccatcgccgacggcgtcaacatcatatccatctccattggaggcccctcccatgacttcttcaccgacccaattgccattggatcgttccacgccatggggagagggattctcacttcttgctctgccggcaacggtggccctcgccccatgacggtcgagaatgtcgctccctggcttttgacggtggctgctagcgccgttaatcgccagttcactacacttgttgctttcggtgatggaaagaacataacaggactttctattaatacctttgcccccaagaaaaagatgtatccattgactagtgggctccttgcgtcgaaccttagtggagaaggctacggcagtgctagtggttgtgattatgggactctaagtaaggaaaaggtacagggcaggatagtgtactgcgttgggggaacaggcactcaggatttaaccatcaaagaattagggggagcaggtgccatcataggccttgatgaggaaattgacgcctcctacaccacagtcattccagggacatttgttgaagccagtactgtgggcaataccattgatctctacatcaattccacaaagaatgctagagcggttattcacaagacaacaactacagaagtccctgctccattccttgcttctttttcatctagaggtcctcaaacaatcaccccaaatatcctcaagcctgacttggttgccccgggagtgaacatactagctgcatattccaaattggtaacactaacagggtaccatgaagacaatcgttacgatgtatttaacatattatcaggaacatctatggcatgtccacatgccactgcaaccgctgcctatgtcaaatccttccaccctgattggagtcctgctgcaattaaatctgctctcatgaccactgcaactcccatcaaaatcagtgacaatttcacggaactgggatctgggtcgggtcagattgaccctgtaaaagcattacatcctggcctggtttacgacatgagaataagctcctacatcggcttcctttgcaaggcaggcttcaacaataccaacattggcatactgataggcaaaccaaatttcaattgcacaagcattaagccttcgccaggcactgatggaatcaactaccccagcatgcatatccagctcttgagtgcaagtgatagaatttctgcagtttttcttcgaactgtgactaatgtaggatctcgaaattcaacttacaaggctaaagttacaacacccaagggtctttctgtgaaggtcaagccaaatatattgaagtttagtcggttgcaccaaaaactgtcgtttaaggttgtgctgaagggacctccaatgccggaggacacatttgtggaatctgcatcacttgaatggaaagactctgaacacactgtcagaagtccgatacttgtctttaagcctatgactgtgtattga

SEQ ID NO: 39619 - DNA, 288 bp, Glycine max
  Peptide Sequence Number=SeqID_131304
atggaagaaattgaggtaggggtgtggagaaggtcggtggtggtggtgatcacaatttatattttgagacacatagccttcaacggtgccgacaaaggaaggaatggtcctgttatggatacgaacgcagatgaggacattttcaaagaggttgcaaccactgttgactttgaggatgtgggcacagagtgtgttggtgctttctcgcattctgatatgggcttcaattccttcttggaccttggaccccttcatagggtgccgtggttgccactccatcacgtctag

SEQ ID NO: 39620 - DNA, 1515 bp, Glycine max
  Peptide Sequence Number=SeqID_131305
atgaacaacgtctccatgatggatgcggaatcggagaagcgctctgcttccaccatctctttttcttcttcatcttctaactcgtcttcctcctgccaccgtttggatcggctcgtcgacgccgaggagattcaagcggcggagactctcgcgcagttggcaatgcgcgactctcattccgccgataaatggtgcaccaaacaggacacaacccgagtcactcgcgagtcaccgactcttcttcattcggatctctcacttgggcctgggggccaagctattgcaggtcagtatccagatgaaaagatatccactacaactgtagaaacagaaatgtttcagcaggatgactgctcgagacacatgaaggtggagcaggatgctgatgtattacctaacacaagttactccttagttcgaagccgcaagtcaaggcgaaatttaactgaggaagaaaaagaagtaaggaggatacgtaggatattggcaaatagagagtcagctagacagacaattcgccgtaggcaggctttgtgtgaggagttaactagaaaagctgcctctttggtggtggagaatgaaaacctaaagagggagaagcaattggctttgaatgagtatcagtctttggagactacaaataagcacttgaaggcacagatagccaagtcaataaacactgaagtggagaaaactcctgttgagcctgggtcatctgtggctgaggtaacacctttgtctggtaacggtccatggttcctttataaccattttccagttccacagatattttggccttccatccttcagttttctaatccggttcatttacaaaatacatcattgaattccttctccattccacctaatgcctatgttccttgttcttccgaatctgaatcacgtcacaagcaaaataaccttataaatgataatcgaacacaaaatccattttacatgtttccatgtccttggttattccctcttccacagtttggaaatcaacaatcatctccttccagtagcctgaaagatgaacaagataatctatctctaggtaaaccatgtagttctagttcatctttgaatacaatggcaaatgtggattatcaagcagcgttacctatcaaacttaaaacagcagcttctggctggacagaggccatatctattaatggccctggttgggccactccaagatcttctttggatggaggtgagaagaaaacaggatgttacattatagaaaaatatcatgaaccttcacttggttgtaatggtcatgcttctgctgtcaaacaagaacatgaatttcaattacattctgctcctaacaataaagtatcttcaacagcttatattgcaacttcttcactggaaaagaaacaaggacagtgcatttgccaggggagaaatctagtggatgcagttgctgctgcagaagcaagaaagaggagaaaggaactaacaaagcagaaaagcatccataaccgccagtcccggatgcactgttga

SEQ ID NO: 39621 - DNA, 1349 bp, Glycine max
  Peptide Sequence Number=SeqID_131306
ataatattaagccatggatgatatggggctattacatttctcctatgatgtatggccagaatgccatagtaataaatgaatttttagatgaaagatggagtcaaccaaatacagaccctagaattggtgcaactacagttggaaaggtgcttcttaagtctaaaggtttttttactgaagagtattggttttggatatgcattggagccttgtttggatttgctcttcttttcaaccttctcttcattgttgcattgacttatttgaatcctttcagtgattcatcaaaagcattcatcatggatgatgatgacaagaagaataaaaagtcaacaaataaacaccgtatcattgaagtaggtccatgtatagacatagcagtgaaaaaatcttcagaacttgttggttgtcctgatcaagaacgaagaacaagaatgatccttccatttcaacctctttccctttcattcagtcacgtgaactattatgtagatatgccttctgaaatgaaaaatcaaggaatcaatgaagatagacttcaacttctgcgtgatgtcagtggtgcattcaggccaggcatattgacagcacttatgggtgttagtggtgctggcaagacaacccttttggatgtgttagttgggagaaaaacaggtggatacattgaaggtagtattagcatctcaggtcacctaaagaaccaagcaacatatgctcgagttagtggatactgtgaacaaaatgatattcattctccctatgttactgtatacgagtcattattattttcagcatggcttcgccttccatcacatgtaaatacacaaacacgaaagatgtttgttgaagaggttatggaatgggttgagcttaaaccaatcaaagatgcacttgtgggtcttccaggcatagatggtctatcaacggaacaaaggaaaaggcttactattgctgtagaattggttgccaacccttcaatcatcttgatggatgaaccaacatctggccttgatgctagagctgctgctattgttatgcgaactgtgagaaaaacagtagatacggggagaactgttgtgtgcacaattcaccaaccaagcatagacattttcgaagcttttgatgagttattgctgatgaaaagaggaggacaagttatctatgctggacctcttggtcaccactcacagaagctcatagaatattttgaagctattgcagggattcaaaaaattaaagatggctataatcctgccacatggatgcttgacatcagcactccttcaatggaggctcaacttgacatagattttgcaaagatctatgttaactctacactttaccagtaa

SEQ ID NO: 39622 - DNA, 2454 bp, Glycine max
  Peptide Sequence Number=SeqID_131307
atggcatccacatcagtgagaaatgatttggtcagcggaaaaagaaaccagcggagctggccctcatcgagtttcagagcagcaagttggagtgcatctccattcacaaagagtgctggacgcagcagtggagaggataatgaggaggatctcaaatgggctgccatcgagcgtttgccaacgctagatcgcatgagaaaagggatgatgagtgtagtgcttgacaacggaaaggttgtgtgttgccaagttgatgtcactcatcttaagttgcaagacaagaagcaactattggatactgtactcaaatatgttgacgatgataatgataagtttcttcgtaaacttagagacagaactaatagggtggggattaaaattccaaatattgaagtcagatacgagaatttatcggtggagggaaatgtgcatgttggaactagagcacttcctaccctgcttaatgttactctcaacacctttgagaggattctggagttgtttcgccttgcaccttccaagaagaggaaaattcatattcttaaagatgttagtggaatcgtcaaaccatcaaggatgaccctacttctaggtcctccaggtgcagggaaaacaacattacttttagcacttgcagggaagcttgacccagatttaaaggtttcagggagaataacttattgtggccatgaactgaaagaatttgttgctaaaaaaacttgtgcctatattggtcaacatgaccttcactatggagaaatgacagtgagagagacattagatttttcaggacgttgtctaggtgttggcacaaggtatcaaatgttggaagaacttttacgaagggagaaacaagcaggaattaaaccggatcctgagattgatgcatttatgaaggctacagccatatatggtcaaaaaactaatttgcaaacagattatgttcttaagataattggattggatatttgcgctgacactttggttggtgataacatgagaaggggtatctccggtggacaaaggaagcgtgtcacaacaggggagatgctagtaggtccggcaaaggcactatttatggacgaaatatcaacaggattggacagttccaccacttttcagatatgcaagttcatgaggcaaatggttcatataatggatgaaaccatggtgatttctcttctacaaccagcaccggagacatatgaactatttgatgatgttatccttctttcagaaggtcaaattgtataccaaggtcaacgagaacatgtgctagagttctttgaaaacatgggtttcaaatgtcctccaagaaagggagttgctgactttttacaagaagtaacatctaagaaagatcaagaacaatattggtttagaagagatgaaccttatagatacatttcagttcctgaatttgcagagtgcttccaatcgttttacataggagaacaacttgcaacagagtttaaggttccttatgataagagtcaaactcatcgtgctgccttagctaaagacaagtacggtatatcaaattgggaactactgaaggcatgtttctcaagagaatggttgcttatgagacgcgaaatgtttgtctacatatacaggataatacagttagttgtcttatctattttaggctttactttgttccttagaactgaaatgtcagtgggcactgttgaagatgggatgaagttctttggagcaatgtttttctctataatgaacataatgttcaatgggttttcagaacaagccatgcttgtttcaaggcttcctgtcttttacaaacaaagggatttcatgttctaccctgcatgggcatttgggttacctatatgggttctcaggatccccatttccttggtggaatcaggaatatgggttgttttcacatactacacaattggatttgctccttcagctagcaggtttttcaaacaattcttggcactgtttggcgttcatcagatggctatctctctatttcggctcgttggtgcagttggtagaacatatgttgttgctaatatcctgagtggcttgacttttcaaatagtattggtgcttggaggatttattgtctccaaaaataatatcaagccatggttgaaatggggctattatgtttctcctatgatgtatggtcagaatgccatagtaataaatgaatttttagacgaaagatggagtaaaccaaatacagactctagatttgatgcacctacagttggaaaagtacttctgaagtctagaggctttttcactgatgattattggttttggatatgtattggagccttgtttggttttgttcttcttttcaatcttctgtgcattgttgcattgacttatttgaatgctatgggtgattcaaaagcattcatcacagacgaagacgacagaagaatgaaaattcaacctttagacacatgtcaatag

SEQ ID NO: 39623 - DNA, 1335 bp, Glycine max
  Peptide Sequence Number=SeqID_131308
atggaggaagaagccaatcaccacgcaatagacatctcaaatataatagacagagagaggcttgcttcgatggagctcaagatttcggagaatcccaagtttctatgcaaagccgcggggaagagatcttgctgcatcttccgggtcccacagagcctagttgaggtaaacggaaaagcttatcaacctcgtatcgtgtcgataggaccatatcaccgtaaccaacctcgcctcaacatgatcgaggagcacaagtggcgttacctcggttcccttctctccagaacaaacaccatcggtttcgttctagaagatttgttcaaagccattgcacccttagaatccgaagccagagagtgctactccgaaaccatcaacctcgactctcacgacttcatccaaatgatgatcctcgatggctgcttcatcattgagctctttcgcaaagtcgccagattagtaccctttgaacgcgaagaccctcttctcaccatggtgtggatattacccttcttttacagagactttctcaagcttgaaaatcaaatcccctttttcattctgaaccagttataccaagttacaaaactacccggagaaaagtcaacgccaacactgtcaactctcgcgttgctcttcttcaacaactcgttgcaaaagccagacgaatccttgcaaaacgacgtgcagggaaagcatttacttgacttggttcgttcgagtttcattcccaaaaacgatgaagaaacagagccacgaaaaagagtcatgacgccaacgcacgtgatcctctgcgtgtcgaagcttcgtcgcgcagggattaaaattaatccaagcaaggaaagtgagagttttctgaacgtgaagttcaggcgcggcgtgattgaaatgccaagccttacggtggatgatttcatgagctcttttttgctgaactgcgttgcgttagagcagtgctacagcggttgctcgaagcacttcactgcctatattaccctcttggactgtctcgtaaacacgtatagggacgttgagtatttgtgcgatcggaacgtggttgagaaccaccttgggacggagggggaagttgcaagcttcataaacaacgcgggaaaggatgtggcggttgatttggacttgtgttacttgtcactattgttcaatgatgttcacaaatattatataaatagttggcatgttcagtgggctagcttcaagcacacttactttgatacgccctggtccttcatctcgcttctcgccgcctccattttgctgcttcttaccgtggctcagacttacttttcggcttctcagtattttcatcagacttaa

SEQ ID NO: 39624 - DNA, 1896 bp, Glycine max
  Peptide Sequence Number=SeqID_131309
atggaggcacttaccgttcagcgtctcatctcagaacaggaccacatttatggtgtttttcacttctccctactgaacagggcaataggaaaaactaggattgaatttcagaatttcaatcctagggacattgttgaatttcaacatggtgctattgagccaaaaatcaacacatatgtcaattttagagatgatgtattgcctcgaattaaaaggcttggctataatgctgtccagattatggctatccaagaacattcttattatgcaagctttgggtaccatgttacaaatttcttcgcacctagcagcagatttggaactccagaggaacttaagtctctgatagacagagcccatgaactgggtctgcttgttctgatggatattgtacacagccatgcatcaaataatacattggatgggctgaacatgtttgatggaactgatggtcattacttccatcctgggtcacgaggttatcattggatgtgggattctcgcctttttaactacggaagctgggaagtaagtgctggctccaaagaattcattggcatagtttctgacaaaattttccgtaccttctgttcaacagttctaaggtatctactctcgaattcaagatggtggctggatgaatacaagtttgatggatttcgatttgatggtgttacatcaatgatgtacactcatcatggattggaggtagcatttactggaaattacaatgagtattttggttttgcaactgatgttgatgctgtgatttacctgatgctgactaatgatgtcattcatgggctgttccctgaggctgttacaattggtgaagatgtgagtggaatgccaacattctgccttcctacgcaagatggtggggttggctttgattatcgcctgcacatggccattgcagacaagtggattgagattctcaagaagaatgatgaagactggaaaatgggtgatattgtccacacattaacaaacagaaggtggctggaaaaatgtgtagcttatgctgaaagtcatgaccaggccttggttggtgacaagacaattgcattttggttgatggacaaggatatgtatgacttcatggctttagacagaccatccacacctattatagatcgtggtatagcgttgcacaaaatgattaggcttattaccatgggtcttggtggtgaagggtatttaaattttatggggaatgaatttggccatcctgagtggattgattttccaaggggtgatcaacatcttcctactggcgtaatagttccagggaataacaacagttttgataaatgcaggcgtagatttgacttgtacatgtacttgttgtcggaaaagagaaaaagaacaatttacaaaggcaatagttcaaagttacaaaacttatcttctgtactgcttaatcagggtgatgcggactatctaagatatcgagggatgcaagaatttgatcaggccatgcagcatctagaagaaaagtttggtttcatgactgctgagcaccaatatatttcacggaaaaatgaaggtgacaaaattatagtcttcgaaaggggcaacctcatctttgtcttcaattttcattggaacaacagctattcagattacagagttggctgttcaacccctgggaaatataagattgtcttggattcagatgatgccttgttcggtggcttcagtcggctcaatcacactgctgagtacttcacctcagaaggatggtatgatgaccgacctcgatcctttcttatctatgcaccttctagaacagcagtggtttatgcccttgcagatgatgttgaacctaccctagcagatgaagctgaacctgccctagcagatgaagctgaaccagagccagttgatccttga

SEQ ID NO: 39625 - DNA, 1567 bp, Glycine max
  Peptide Sequence Number=SeqID_131310
atggaaatgcctgccagaagatccatcaactactccctcctcagccaaactcccgacgacaaattaacgccgccgttgttcggttcctcctccggcgacgctaaaatcaacaacagcaagttcgagagagtctccgattgggactccggcgtcgatcaccgccaggggaatcggatcgggaatttgcactcctcgtttgggatgcagcggcagtccagcgagagcagtttcggcgagagctcgctctccggcgagttttacgcgcctattctgtcgaccgtcgcggcgaatgagatcgacggattcagaggcaggtttccgggaaattcggcaatgaggagcggaggttcctctggcaagagctgggcgcagcagacggaggagagttatcagttacagctggcattggctcttcggctttcatcggaggccacgtgtgctgatgatcccaattttctggatcccgtgcccgatgaatccgcgttgaggccttcgtcttcgtcgttttccgcagaggcagtgtcgcataggttttgggaaaatgaccgaattcctccacttgagacactaaaatctataaatccttcttctgactcttcacttgaagtagtttttgtggatagacgtagcgatcctagcttaagagaactgcaaaacagagtacaagacatttcttgttgctgcatagaaacaactgatgttgtagaccagcttgcgaagctggtttgcaattgtatggggggttcagcttctgtatgggaagatgatctttttcctatatggagggagcgcattaatgatctaagagattgcttaggatctgttgttgtaccaattggcagtctatctactggactttgcaggcatcgtgctgtattattcaaagtaatacttgaattctatgtgatggtcaaggctgtactagctgacaccattgatttgccttgtcgaattgctaagggctgtaaatattgttcaagagatgatgcctcctcatgtcttgttcgatttggacttgacagggaatacatggttgatcttattgggaagccgggttgcttatgcaagcctgattccttgatcaatggtccatcctccatttcattttcttcacccttgcgctttccaagacataaaccagctgagcctaccattgatttcaggtcactggccaaacaatatttctcagattgtatgtctgctgagcttgtctttgatagtagttctgcagaacagtatgaaaggcagtacatgggcaggaaccctgggccaattccaaatgataacaacaaaagttctctcgttcctctgcattcacaaccttattgttcaagtgcacatgatcgaggctctgaaacatttaaatcaggtaaccctgctcagaatgctgtagagccgacaatgacaagccgggattcattgcctttaaagcataaccgtcctggtcatagagatacaaagacccgactactgattcctagcaaaccaactagagagttttcccttgatatggaggatttggacataccgtggactgatcttgatttaaaagggagaataggatcag

SEQ ID NO: 39626 - DNA, 384 bp, Glycine max
  Peptide Sequence Number=SeqID_131311
atggatatggagaataaggatttcttagaagggtcctcttccctagaggcaatgcccttcccacagatgcacaaaagtcctgtccaagaaaacccattctcccacttcttaggctccctccctcctaacttgtctcccttttcatcctttgttgaggagatagtttgttgcatttgtggtatgggaagtggacaaacaaacataatcgaaggcatgcatgtcaagatatttgtgatgctggttacacctgaaattagtagagagctagaccatagctgcaaccgaggtgaaaaggaggaagatcttatgtcaatttatatcctttccatcctccacctttctttaccctacttatcctcatgtattgagattgcaagaaattaa

SEQ ID NO: 39627 - DNA, 4977 bp, Glycine max
  Peptide Sequence Number=SeqID_131312
atggaggttggagaaacagagagaaacaagcttcaagggcaggttccttgggtccccaccacccctttgatgcccattcttccaaaaccagggccgatctggactcctatggagggaaaccacctatactctcattccaatgggttaacagcatgttttgaaccctcctgttgcgcagagataaacaactggtctcacccccggtcagaacctgtggttttagcctatggcaatgccaaaactcgagtaccaatatcctttgatgaaattcccagttcaagtaacggcattgctgaacttttaactcagggagatgctccatccgcatattcaaatgcaacacatgctgggttttttaaccaatttgctcatgcgtttaatgcacagttcaacccccacccgacctatgcattacttagccatcaatatcatctctctcgtgaggaaccttttgtcaacactgtccatgatcagttccaagatcttcagggtaagcattgtattaaaacttcttcatttgagaaccatctggcacacagccagcactggcactttgcgggtgtcaattaccagcgatgtgcaccagctgaagaaagcacgtcatacttttcttactgtagcaagacatttccccaaattgccccacatttagataatgccattgcagcagaaaccagacaagatgcaatgacacagatgactatagaagaaaggaaccgagagggagaagagaaaaatgtcccagcagcaaagtgcaataatccacacagcaaactctatgaccctgttacagaaattgctgctgtatctacaccacacaaggagaatcacaaccacaaggaaataagccatgattttgatctgaataaaacacctcaaccaaaaccaagaagaagaaagcaccgccccaaggtcataaaagaaggcaaatccaaaagaactagcaagcaagtcaatgcagaggttctgtcaaaagaaaagctaactgacaagagaaaggcaaggaggaaaggattgaacacaacttctactcctcaaacagaaatgacaggagaatggacaaaaccattgatgcctgaatctgccaaaaagacatgtagaaggtctttgaattttgacattggagaaccaagagatgacaattctgcatatggagaaactatgcactttggcagagacaccagtgtggtgattgaagaaacacgggcttggatgattgcccacaatggacatgaaaagagtgcaaaaacactatcaaaatcagtagcacaatcaagtccaaatgacttgaacagcacagggtcaggattacatatagttggttccaaaagaaaacaatctggtattgaacaggtagataatagcagcattaaccagattggagcacaatacaatgctgtgcaggcatactgccaaaagtattcggttcaatttccaaatgttcagaagaaaaggagaagtgaaaaggggagaatttcaaaggcatcccataaatcttccatgactgccacaaaagatgtacgactggcaacatgcccacaagaagatgctagatcacattcttatgcatcaagtctcaactgctgggcttcttctgaatataatgcagctggggtctctgtaattacagatacagaaagagctattcatgataaacctcaatcattagagtacaacttatctttagggcagaggaggccaaccaaaagaagatcaagagtccctactagaattcatgattgttctttactgaccataaccagaaactctgataccaaactagcacttactgcaaaagaaacatgcagttctgacagacaaacatctggggatgcaaaaagaccacagacatgcattgatgctttagttgcagagatgcgaggatcactcacaaaaaagaaacgaactaggaagagaagtattcctgtcaattcaaaatattcctgcacaaatgaaatgcaacagcaccataaagttgtgttggaaaatcatagcatatcacactcacacaacgcattaggtgttgcttgtgaagacatatggaaaaacatacatactgtggacactttaaccgagcaatttgaacgtctaaacatatacagagaagccagagagattgtgttgcatgggcaaaatatgcttgtcccttataaccagcaaaatcagaagaacaagcgtcttgtccatgaatacggcaccatcattccgttcgagggcccatttgatcccataagaaaacagcgcccacgacctaaagttgaccttgatgaggagactaatagagtgtggaagcttctaatgttggatataaacagtcatgggatcaatggaacagatgaagacaaggccaaatggtgggaagatgaacgaaatgtgttccgtggacgagcagaatcatttattgcacggatgcatcttgtacaaggagacagacgcttttctccatggaaaggatcagttgtggattctgttattggagttttcctcactcaaaatgtctcggaccatctttccagttctgcattcatgtccctggctgctcgatttcctctaaggtcaagtagtaactacaaaacatgccccgaggaaagcacaagtttggtaatcaatgagccacaagtgatcattgtggagccagaagaaaatgaaaaactggatgagaaaatatcggatcaatctgtttgtgaattgaattctatgacaatagacatcattgagcattctgaagaaagagaagttgttgacaggaacaattcctgcagaactaatggcggcttaattggtgtagcagatgaatcaaacagcaaattgctggaatcagctcaaagacataacagtgaacatagtccagtggagagtggagcaattagtgctgtgactggggaagggccaaaaaatttatgtcatgggagtcttgggaaagagttaaatggcgtattttcatcccaatgctctgccattacatctcaaatatcaggaggtttttcaattgatcaaaatcctgaaaagataggatcattctcagatagcaactcagaaatagaagacctgtctagcgctgccaagtacaatagttattataatagaatttctttcagtgagcttttagaaatggcaagttcaaccatgttgcatgaagttaacagtcaaagaagcaaatcaactgagaacttaggagatacatgtgatcagtctatagacatgaagcatgacaacctggcagaaaacttggaaaaatcggatgttactcaaggctccgcagaagcacccatcaccaatggatatacttttaaaataaccccaaactcaggagtacttgaggttaactgttatgatcctctcaaaatagaagtcccatcaagtggctcctcaaagggtaaagatgagaatgacaatagatctagtttcccaacagagtctgactgccaggctgcaattgtccattctcaaggtatgctatctcaatcccatcctcagcaacaaagtaatcatgagcagcataacgttttccacatttcaggacaaactgaagatccaatgcagaaagcaaggggactagattttggtaggaatgaaagcagtaagatagattcttcccctgtaaaattaaggagcagggagcatggaaaagagaaaaagaataactttgattgggatagtttaagaatacaagcagaagctaaggcagggaaaagagaaaagacagagaacaccatggactccttggactgggatgctgttagacgcgcagatgtcagtgaaattgccaatgcaatcaaagaaaggggcatgaacaacatgcttgctgaacgtattcagagtttcctgaatctattggttgacaagcatgggggcatcgatcttgagtggctgagagatgttccacctgatcaagcaaaagaattcttgctcagcataaggggattgggattgaaaagtgtggagtgtgtacgactcttaacactacaccatcttgcctttccggtggacacaaatgttggacgtatagcagtaagattgggatgggtgcctctccagccactgccagagtcactacagttgcatcttctagaattgtacccagtgttggagtccatacaaaaatatctctggccccggctctgcaagctagaccaaagaacattgtatgagctgcattaccagctgattacatttggaaaggtcttctgtactaaaagcaagccaaattgcaatgcttgcccaatgagaggggaatgcagacactttgcaagtgcttttgcaagtgcaaggctcgccctgccaggatcagagcagaagagtatagttatcacaactggaaacaatgcaactgagcagaacccatcactagtcatcaatcagctgcccttgcttctccctgaaaatataaaccaagcagaacttcaacaaacagaagtgatcaggcaactagaagcaaaatctgaaatcaacatcagccaacctattattgaagagccagcaactccagagccagaatgctcccaagtatccgaaaatgatatagaggataccttcaatgaggaatcatgtgaaattcccaccatcaaactagacatagaagagttcactttgaacttacaaaactatatgcaagaaaacatggaacttcaagaaggtgaaatgtcaaaggccttggttgctctacatccaggtgctgcatgcattcctacacccaagctgaagaatgtgagccggttgcgaacagagcattatgtttatgaactccctgattcacatccccttctgaatgggtggaacaagcgagaacctgatgatccaggcaaataccttctagctatatggactccaggggagacagcagattctatacagccaccagaaagcaaatgcagctctcaggaatgtggccggctctgtaatgagaatgaatgtttttcatgcaacagtttccgtgaagcaagttcacagatagttcgagggacactcctggtctga

SEQ ID NO: 39628 - DNA, 1602 bp, Glycine max
  Peptide Sequence Number=SeqID_131313
atggatcgtttttcttctagtaccattctccccgaagcgtttcaaggtgccaaagatgacttcaccatgcagcttgcattggtctggaaccaaatcaaagcgccactcattgtcccgttgctgagaataacagtgtttctgtgcttgatcatgtcggtgatgatgttcatcgagagggtctacatgggcattgtcatcactctggtgaagttgtttgggagaaagccagagaaacgttacaagtgggaaccgatgaaggacgacatagagttgggaaactcttcttacccaatggttcttgttcaagtccccatgtacaacgaaagagaggtttatcagttgtctattggagcagcatgtgggctttcttggccttcagataggatcatcatacaagtccttgatgactccactgacccaacaatcaaggagttggtgcagcttgaatgccaaagatgggcaagcaaaggggtgaacataaagtatgaggttagggacaataggaatgggtacaaagcaggggctctcaaagaaggcatgaagcgtagctacgtgaaacaatgtgattgtgttgctatctttgacgctgattttcaaccagagcctgatttcctgtggcggaccgttccattcctcgtgcacaatcccgaattagccctcattcaagcacggtggaaatttgtgaatgccgatgaatgtttgatgaccagaatgcaagagatgtcactagattaccattttactgtggaacaagaagtggggtcttccacttacgccttctttggtttcaacgggactgcgggagtatggagaatttcggcgctgaatgaggctggtggatggaaggatagaaccacagtggaagatatggacttggctgtgcgagccagtctcaaaggatggaaattcttatacttgtcagacttgaaggttaaaaatgagttgccaagtactttcaaggcctaccgctaccaacagcaccgttggtcttgtggcccagccaatctttttaggaaaatggccatggagatcataaacaacaagaaagtgtcattgtggaagaagatacatgtgatttacagcttcttctttgttcggaaggtcgtagcacacatcaacacgtttgtgttttattgcattgtattacctgcaacagttttggtgcctgaggttgtggtcccaaagtggggagctgtctatatcccttccatcatcactattctaaatgcagttggaactccaaggtcactccatttgatggtcttctggattctctttgagaatgtcatgtctctgcatcgaacaaaggcaacaattattggtctacttgaggccagtcgagtgaacgaatgggttgtcactgaaaaacttggtgatgctctcaaggctaaagcaggaggtaaagcacctaaaaagcctcgattcaggattggagacaggattcacttgttggaacttggtgtcgcattctacctcttcttttgtggctgctatgatgttatgttcgggaaaaaccatttcttcatcttcctctttatccaatcttttgccttcctcatcatggcatttggatatgttggcaccattgttcccaactcctag

SEQ ID NO: 39629 - DNA, 1563 bp, Glycine max
  Peptide Sequence Number=SeqID_131314
atgacgaagatcgttggtaccctgggtcctaaatctcggtcggtcgaggttatttctgcttgtcttaaagctggaatgtcagtggctcgtttcgacttctcttgggatgaccctgaatatcatcaggaaactttggagaatctgaagaatgctatcaagactactaagaaactctgtgctgttatgctggacaccgttggtgcagagatgcaggttgttaacaaaagtgagaaagcgatctcgcttgaggccgatggccaggttgttctgactcctgaccgaggacaagaagcatcgtcgcagatactgcctatcaactttgatggactggcaaagtcaatgaagaagggagacaccattttcattggtcaatacttgttcactggaagtgaaactacttctgtatggctagaggtatccgaagttaaagggcaggatgtcatttgtactataaagaattccgcaacattggctgggtcattgttcactttgcatgcctctcaagttcatattgacttgcctaccctcactgataaagacaaggaggttataagcacctggggagtaaaaaacaaaattgattttctatcattgtcatatactaggcatgctgaagatgttcgccaggcccgtgaattcctttctaagttaggtgatctaagccagactcaaatatttgcaaaaattgaaaatgttgagggattgacccattttgatgagattctacaagaagctgatggtattatcctttcccgtgggaatttgggcattgatcttcccccagagaaggtatttttctttcaaaaatctgccctttacaagtgtaatatggctgggaaacctgccgtgcttacacgtgttgtggatagcatgactgacaacttaagaccaactcgtgcagaagccactgatgttgccaatgctgttttagatgtgaaattcaaccaacctataggacatagaaatatgagcaatgctctggtacagtgttgtgcttgtgcttgtatgagaagtgaatgtgctgagaccttacgtgggttataccctgttgagactatttccacagttggaaaaatttgtgcagaagctgagaaagtttttaatcaagacctttattttaagaaaaccgtcaaatatgttggagaacccatgacccacttggaatctattgcatcctctgcggtacgagcagctattaaggtgaaggcttctgttattatttgcttcacttcttctggaagggctgcaagattaatagcaaaatataggccaaccatgccagttctctctgttgtgatcccccgactcaagacaaatcagctgaaatggagcttcagtggagcttttgaggctaggcaatcacttattgttagaggcctctttcccatgcttgccgatccccgacatcctgccgagtcgacaagtggcacaaacgagtctattctaaaggttgcccttgatcatggaaaagcatcaggagttataaagtcacacgaccgagtagttgtttgccagaaagttggtgatgcgtctgtggttaagattatcgagcttgaagattaa

SEQ ID NO: 39630 - DNA, 2166 bp, Glycine max
  Peptide Sequence Number=SeqID_131315
atgaccactcgctcccacctcccccccaacgagtacacctacgtcgccgttttaaccgcctgctcttcactcctccaccacttccatttcggcctccagctccacgccgccgcactcaaaactgctcacttcgactcccccttcgtcgccaacgccctcgtctctctctacgccaagcacgcctctttccacgccgcgcttaaactcttcaaccaaataccacgcagggacattgcttcgtggaacaccatcatctctgctgcgcttcaggactccttatacgacaccgcgtttcgcttgttccgtaacatgcaggccacggacgcgtttagagtcgatgacttcactttatccatacttctcaccgcgtctgcgtcgttgatggaaggtcaacaggttcacgcccacgctgttaagttagggttggaaaccgatttgaacgttgggaatggactcattgggttttactctaaatttggtaatgttgatgacgtggagtggttgtttgaggggatgagagtcagggatgttataacttggactgagatggtcacagcgtatatggagtttgggttggtcaatttggccttgaaggtgttcgatgaaatgccagagaagaattccgtgtcttataacacggttctggctgggttctgtcgaaacgaacaaggttttgaggccatgaggttgtttgtaagaatggtggaggagggtttggagttgacggattttagtttgactagtgttgttgatgcttgtggattgcttggtgattacaaggtcagcaagcaggttcatgggtttgcggtgaagtttgggtttggatcgaatggttatgttgaggctgcattgcttgacatgtacacgaggtgtgggaggatggtggatgccggtaagatgtttttgagatgggagttggaggagtttagctctgtggtttggacggcaatgatatgtggctatgctcggaatggacaaccggaggaggcgatttatcttttccacgttggtcgatcagatggcaaggtgattatggatgaagttgcagcggcttcaatgcttggtctttgtggaactattggtcatcttgatatgggtaagcaaatccattgccatgtgattaaatgtggattgggatttaatttggaagtcggaaatgcagttgttagcatgtattttaagtgtgggagtgtggatgatgcaatgaaggttttcggtgatatgccttgtactgatatagttacatggaatactttgatttctggcaatcttatgcacagacagggtgatagagcattggaaatatgggtggagatgctgggggagggcataaagcctaaccaagttacatttgttttgatcatttcagcttacaggcaaactaacttaaatttggttgatgattgccgtaatttgtttaattcaatgagaacggtttatcaaattgagcccacatccaggcattatgcttccttcatcagtgttttgggtcactggggtcttctgcaagaagcactagaaactatcaataacatgcctttccagccttctgctcttgtttggcgcgttttgcttgatggttgtagattgcataagaatgaattgattggaaaatgggctgctcagaatattctggcccttgaacctaaagatccttcaacatttatacttgtttcaaatttgtattctgcttctgggagatgggaccgctctgaaatggtcagggaggatatgagagaaaaggggtttcgcaaacacccagctcaaagttggatcgtttgtgagaagaaaataaattcattttatccgagagatagatcacatccacaggagaaagacatacagagaggtttggaaatcctgatcttggagtgcctaaaaattggatatgaacctgacacgagctttgttctccatgaagtagaggagcatcacaagaaaattttcctattccatcacagtgctaaactggcagcaacttatgggatactgatgaccaagcctggaaagcccattcggattgtaaagaatatccttctttgtggggactgccatgcattcttaaaatatgcatctattgtcacaaagagggatatatttctgagagattcttctggatttcattgtttctccaatggccagtgctcgtgtaaagactgctggtga

SEQ ID NO: 39631 - DNA, 1569 bp, Glycine max
  Peptide Sequence Number=SeqID_131316
atgatttccctgcagcttcagcaggaatgggagatagcggtgaatcattatactggtgtgatgacagcaaattggatttcaaacgatttgttgagaccatttctgttctttatcacccgtatctcaactaagcatcggaaggtccacagcaagagaatagattctatgaagctgtgctttacaatcctactggaaagcctgaaatcttctggatggaaaggcattacagatgacaaccacttagatgcagatttagcagtgaaagatttaattcagttcctggggggtaataaaagtggttgttatgtgtctattggcagatatattagtgcattagaaaatcattcctctcagtcaaagagtatcacccaggcagatgatttttttttcattactgcaagtgcaataactatagctgtgcggccattttatctgacaaactatgatgtagaagtgcctggtgcactggatgtcaaccatgctgctgagcagttttttgtttatcttctgactataccttggctagtgcaacatctcccacctgttcttctacctgctttaaagcacaaatctattttgtttccatgcttccagactctattgactttgaaagagaaagttttgccagagatgtcagagtttgtcaaatcagaaatacttgtctctttcaaggctattccaccagttggttgggctctcactaacagtatatgcctcgcaacagggaatgagattgaatccttcaatcaaggtttagagtatgcattgtatgtccgtgttgttactactctaccagaggccctactggcttgtcttgataacattggatgggtcaaaaggaaaaagaaatcccttcaaactgatgttgaaagttcaacacagccagttgatacaattcagcatgagggtgaagcaaccaatgaatccttaataatgtcatacatggatcaatttaggcctgtttgtcagcagtggcatctcaaaaatcttttggcatcaatagatagagatgccactaacaaggctgaggctgtgctctcaaatggcctggcatgtctggggaagctagaattgtgtgatgttgcacttttttattctaacttacttagaatattttcatttttgagtccaattcgtggctcattgtcagttctcaacatgctagcattcactcctggatttcttgtgagattgtggggtgtactggaagattcctttttttctgaagacaaacataattctgataatcacacaagtgaaagcagcaaacataaagcctttgagaagatgcaaaaacatgtcagtaaagacggggctaataagtgggtcagcgtacttcataaatttacaggaaagtcacaagcagcaatggattgcacagattccattggcagtcactctgagcctagcagagtgaatgatgattcatcagatgtatgggacatagaatctatgaggcatggtccacaaggcgttccaaaggatatgtttgccatgcttcatcttttctgtgcaacctattctcacctgcttttagttcttgatgacatagagttctatgagaaacag

SEQ ID NO: 39632 - DNA, 1266 bp, Glycine max
  Peptide Sequence Number=SeqID_131317
atggaaaacacaacatcaaagtctgaggtcctaataaagccaattatcctcaaagccggtgttcctttggctgtgtcttttgctggtttcatctatgcttggttcgtggcaaagaaaagcctctctaagacctcttctttgtcaccaaatgaagcaagttcctatgaagaaagttgtcatagtcatagcctctcttgtatggaagatgaaggacatagtacaacattggatgaaagtgttgttgctgaaagttcgatgatcaatgacaccccatgtttagaagaagagattaatggcctaagaagcaggattgaaggtatgcatatgaaggagttggctttacgtttgcagtttgatcgttattgtgacttgaaagagcaagaaactgtggttggggagatcaaaaacatgttgtcacttgagactgctcgtgttggcttcttggatagggagatttcgtcgatggagacgcagaataagaggttggagagttttgttgctcaatatctcagagttgtggaacagattgagcgttggaaatctgagaatagaacgcttaggaggaagtttaagaggttaatggagaaatcaaaggcacaaactcgcctcgcgaaggagcaggctttgaagatcaaactggaagaagaagaaatcttgagaagccgtgatgccttggaaacaaaaattgatgtcgttggtaaacttgaggatagaatggaagagctgcagagagctttggatcaattgcaggatgagaagaatgaacttctgaagaagctcgacacagcagaaaaatcctatgcttccaagattgaagatggagatgtaagtagggaagagtgcaaacagcttctagatgaattggagcaagtcaagaaagaacgagcagatgaagctaaagaactcatttacttgcggtggacaaatgcttgtttaaggcatggtctagtgaggcaccatgaacaacaacagaatcaggataaaaaccatttagaattggaatttggaagaaatgatgtagttatcaattatgattcggagcatgaactgcacaattcccttttggagcatcacagtgatccttcctttgatgagcatgctagtggtcatgatcacagtgacattgcttgttcaaaaaggacaaagttgcttgaaaggctaaagagatgggttgatggcagtgaaaaacctagagttgggcattctatttccaaaggggcagaggaacatctagttcctagaaggaagtcatgctctagtgcttga

SEQ ID NO: 39633 - DNA, 692 bp, Glycine max
  Peptide Sequence Number=SeqID_131318
atgcagcaaactctgcagttcaacataacatttacatccttttacttcactaatttcacagacaacgttaatgaagtgaggctctgggggaagtttaagatttggggagatgtgcgtgaagttttcattgccaaacgtcgtaacaaggagggaagaaggttcggcttcgtgaggttcaaggacgtttcggacgtaaagcttttggagacgcacctggacaatatcttcattgatgaccataagctgttcgttaaccttcccaggttcacaaggctagcgtcgaatgttcatacgcatacaaaagtagataaaaaggaaaagcaaagtaaagaagctgtcaaggattctcaggccactaatagacctcgggtgagatcatatgtggaagtggtggctcagaaaggaggcttaggaggaacaacgacagctgtagatggcattccaacaattaccatcgtacctaataaaggtcgggaagtctggtgtaaaggggcttgggttggtaggttgaagaaaccgatgcaggcggagaagatggaggactacatatcgtgggagctgggatatagcatcagcgctagatccctcggagacgacatagtactaattactggtctttcagcggataaggcccaacagcttatcaactcagagacgaacggcggcaataccctcttttattccctcgagag

SEQ ID NO: 39634 - DNA, 447 bp, Glycine max
  Peptide Sequence Number=SeqID_131319
atggatgagattgaaggcggtgagcgagggaaggcaacaaccgttggatgtttggagatgttctttggcgcttacgttgcgtctctacgttgccacaatacaactcttgaagctcggctacagcaacaatcgcaggatggttcttcgcagtcacagtcgtggtatccgccatcggtggtgagttcacctacttcatcgaggcctgttacaccgactgcatcttcttcttcattatcgcagaggccttcgtctcatgttccaccttccgaagctgctgcagttattgccgttttgaaggacaagagtgttgatgagttgcggaagcttttatctgacaaagatgcgtatcaacagtttttgcattcgcttgatcaggagatacagcaccctccacagatgaaaaccctactaacagaagctttaactaaaagctatagacatatttga

SEQ ID NO: 39635 - DNA, 1254 bp, Glycine max
  Peptide Sequence Number=SeqID_131320
atggcttctcgcaagcgccgtgccgtgcccacaccaggggaagcgtccaactgggacacctcccgcttcacatctgagatagcttggcacaggtaccaagacaacattcagctccggaacatccttccggagaggaatgttgaactgggaccagggatgtttgacgagttcctccaggaactcaggaggcgcagatgggaccaggtgctgactcacctcccggagaagcggattgacgtggctctggtgaaagagttctattcgaacctttatgatccagaggaccacagtcccaggttctgcagggtgcgaggacaggtcgttcgttttgatgctgacaccattaacgacttcctcgacaccccggttattttggaggacggggaggagtatacagcatacaccagatacctcagcactcaccccgatcctgacaccatcgcggctacactgtgcactccaggggggcgctttgtccttaatgctgatggtctcccctggaagctcctgaggaaggacatgacgacacttgctcagacatggagtgtcctttcttactacgatcttgcgcccacttctcacacttatgatgttaatcttgacagggcccgcttgatctacggtttggtgagccgcatggacatggatgtgggcagctttatatcacagcagatcagccagattgcccagtccagcacctcgaggctcgggttcccagcgttgattacagcgctgtgtgacattcagtgggtggtttctgataccctgatctttgagtcactcaaccctgcgatcaacctagcatatgtgaagaagaattgctggaaccccaccgacccatcgatcactttccctgggcctcgccgcacacgtaccagagcttcagcatcagcttccgaggcccctcttcctacccagtcccagtctcagccatcccagcgaccgcgacatccacctgcttccacctcagcatccatggacatgcatgggcagatgctgagatcccttcatgttggacagcagctcatcatggagaatatgcacaggctgtccctacacctacagatggaccccccgctcaccactccagaggcttatcgtcagcgagtcgcctggccaggagaccagccctccactgacaggggggaagagccttctggagccgctgaggatcctgcagtcgatgaggacctcattgctgacttagccaccgctgactggggcccatgggcggacttgggcggaggcagttga

SEQ ID NO: 39636 - DNA, 1312 bp, Glycine max
  Peptide Sequence Number=SeqID_131321
atggaagatccagctccaccatccgaagcatccaatcgcccccctcgtaagaggggcagacctcccaaacacctccccaaggaacacgacgccgacgccgaccggaccaccgtgcaagccgaccgagagagttcgcccgacgacttcgacgaagcacccgctaaatccaagagaaatcgtgcttccgaaggaacctccagcgtcgcgcacaaagtctctgaccaaaccctaattgaggtggtaaaaggtaatggcaagtttattccccaggcagtcaagttttgggttgaatgctatgaaaaggatccaaaacctgcaatggttgatctcttgacaatgctgtttgaggcatgtggagccaagtactgcgataagagtgatcttgtggatgagactgatgttgatgaagttgtaattgctcttgtcaactgtgctaaaaggggtgaagttgaagattatcaaaattccaaaaagaaagagattaaaaacttcaaagagaatctagaatcattctgggacaatttggttcgtgagtgtcagcatggcccattgtttgatcaagttttatttgacaagtgcatggactatatcattgcactgtcatgcacccctccaagagtataccgtcaagttgcatcattgatgggtcttagtctggtcacatcatacataactattgctaatatgcttcgtgctcaaagagagactactcagagacagttggaagctgagaaaaagaaaagaactgaggggcctcgagtggattcactaaagaaaaggtcttctgatactcatgatagaatacagttgttggaggagatgatgcgcaagatatttactgggttatttgtgcatcgctacagagacattgaccaaaatattagaatgtcatgcatcgaatcgttgggtgcatggatcctgtcatacccatcacttttcctgcaggatttgtacttgaaatatcttggatggacgctgaatgacaaaaatgctggtgtaagaaaggcttctataagtgctctgcaaaatctttatgaggtggatgataatgtgccaacccttggtttatttactgaaagattttctagccggatgattgagcttgctgatgacattgatgtttctgtggctgttcaagccataggtcttgttaaacaattactaagacatcaacttattcctgaagatgacttgggtcctttgtatgatttgttgattgatgaccccccagaaatcaggcatgccattggagcattagtgtatgatcacttgattgctcaaaaatttaatagcctccaatcaggatcaagag

SEQ ID NO: 39637 - DNA, 1494 bp, Glycine max
  Peptide Sequence Number=SeqID_131322
atgatgctcagaattcgtagccgcgacggcctggagcgagtgagcgtcgaaaacccccacagcacaacagtgtcatacctaaaacggatcatcgaaacccaattgggaatccctgttcacaaccaaaccctgtccacaaaccagaacctcctcttggcaaaatccctagaagatctccaccgattcaccgacatgtccaaccccgacgcgcctctctcgtctctcaacctcggccacggctccatggtcttcctggcctacgagggtgagcgccgcgtggccggccccgccttcaaccccgccggctccttcggccgcaagatgaccatggatgacctcatcgccaagcagatgcgcgtcacgcgccaggagaatccgcactgcgagctcgtctcctttgaccgcgactgcgccaacgccttccagcactacgtcaacgacactctcgccttcgccgtcaagcgcggcggcttcatgtatggcaccgtctcggaggagggaaaggtcgaggtggacttcatctacgagcctcctcagcagggttcggaggacaatctcgtctttttcagggataccgaagaggaaaagtttgttgaggctattgcggtggggttggggatgacgaaggttgggtttattttcacgcagacgataactcaggataagaaggattacactttgtcgaacagggaggtgcttcaggctgtggagtaccatgcggagagtgggttgaaggagtgggttactgctgtggttaagcttgaggcgaatgaggaaatgggtggtgcagatgtgcattttgaagcgtttcaaatgagtgatgtgtgtgtgaggttgtttaaggaagggtggttcgagacggagatcaaggaggacgatgatcccaagttgtctaagatgaagaaggatgtggttgttggggttaaggatactagagaggttgacaatgatttcttcttggtcgttgtcaaaatcgctgatcatcagggtcctctttcatcatcgtttcccattgagaaccggaacactcaagtgcctatgaaggctttgaagaatcatctggaccggacaaaaaatcttccatttgtgaagcgaatttctgattttcatcttctccttgtattagcgagggttttagacctgaatgctgatgttcctgcattgacggaatgtgtgcagacacagacttctgttccagaaggttcgttgttgtgggaagatcgttcttctcgtcttctttggggaaacctggaacgcttggtagtggaacggagtactggaggggctattaccagagccttcgcccaactcagatgggcctatgtgtcggccagggcattttatgagcctattcctgcgattgatttcattgaaagtcattttagggtcaatccttccaggccgaatcaagccatggtttatgattcaatcgccgccgtgctgattccctccgccgcaaacactaggaatccgaggaagaagaagagggtttga

SEQ ID NO: 39638 - DNA, 1923 bp, Glycine max
  Peptide Sequence Number=SeqID_131323
atggctcaaggccacatgatccccatgatggacattgcaagactattggcacggcgtggtgtgattgtttccatattcaccaccccaaaaaatgcatcacgattcaattctgttctttctcgtgatgtttcatcaggcctcccaatccggctagtacaactccattttccatccaaagaagcaggactacctgaagggtgtgagaatttggacatggtagcttcaaacgatttgtacaaaatattccacgccatcaagctgctccataagccagcagaggagttctttgaagcactaacacccaaaccaagttgcataatctcggacttttgcattccttggactgctcaagtagctgaaaagcatcatattccaaggatttcattccacggtttttcttgcttctgcctccattgcctgtaccagatacacacatcaaaggtttgtgaaagcatcacttcagaatccgagtacttcactattcctggcatacctgacaaaattcaagttaccaaagagcagctacctgcaggactctctaatgaattgaaggactttggagagcaggtgattgatgctgacataaagtcatatggggtaatcataaatacttttgaagagttggagaaggcatatgtgagggaatacaagaaggtgagaaacgataaggtgtggtgcattggtcctgtttcattatgtaacaaagatggcttggataaggctcaaagaggcaaccgggcctcaattaatgagcatcattgcttgaagtggttagatttgcagcaacccaagtctgtggtttatgtttgttttggaagcctgtgcaatttgattccttcacaacttgtggagctggccttggccatagaagatagtaaaaaaccatttgtatgggtcattagggagggaagtaagtaccaagagttggaaaaatggatcagtgaagaagggtttgaggaaaggaccaaagggagaggccttataattcgaggttgggctccacaggtactaatattatcgcaccctgccattggaggattcttaacacattgtggttggaattcaacacttgaagggataagtgttggagtgccaatggttacctggcctctatttgctgatcaatttttaaatgaaaagctcgttactcaagtgttgaagattggtgtgagtgttggggcagaagttccaatgaattggggagaggaagagaaaactggtgtgttggtgaagaagaagaacattgagagggcaatatgcatggtgatggacaatgatgaagaagaaagcaaagagagaagagaaagggcaaccaaactctgtgagatggcaaagaaagcggttgaaaaaggggggtcttcccatcttgacatgactttgcttatacaagacatcatgcaacaatcaagtagcaaggaggatagcataacatctgagtcagagtgctttgttctgcctggtatccctgacaaaattgagattaccatagcacaggctggacaacccatgaacgaaagctggaaaagattaatgaagaatttggggaagctgaaatgtctagtaacgggtggttggaactctaccttagaagcaatttgtgctggggtgccaatgcttacaaggccactttttgcggatcagtttttgaatgaaattctagtcgtgcatgtactaaaagttggagtggaaattccgcttacatgggataagaaagtggaaattggtgtgcaattgaagaaggaagatgctgaaagggcaatagtaaagttgatgtatgagacaagtgaaagtgaagaaagaagaaaaagggtgaaagaacttgctgagatggctaaaagagcggtagagaaagcgggttcatctcattctaatatgaccttgcttatcgaggaaatcatgcaaaaaaccaagagagatgtgtga

SEQ ID NO: 39639 - DNA, 1467 bp, Glycine max
  Peptide Sequence Number=SeqID_131324
atgggtccccaagaacaacaactccactttgtcttgtttccattgatggctcaaggccacatgatccccatgatggacattgcaaaaatattggtgcaccgcaatgttattgtgacagtagtcacaacaccacataatgcagctcgtttcacttcaatctttgatcgttatattgaatctgggttccaaatcagattagctcaacttcagttcccatgcaaagaagctggagtaccagatggatgcgagaatctcgataccataccttcacttggcatggctgcgggtttcttcaatgcaacaaactttctacgtgagccagcagaaaaactacttgaagagttaacaccaccacctagctgcataatctctgatatgtgtttaccatatacaaaacacattgctagaaaatttaatattcccaggatttcatttgtcggagtaagttgtttctatctcttttgcatgtctaatgtacgcatccataatgttatcgagagcataactgctgaatcggagtgctttgttgtgcctggtatccctgacaaaattgaaatgaacgtagctaagacaggaatgacaattaatgaaggcatgaaagagtttactaatacaatgtttgaagctgaaacagaagcttatgggatgatcatgaattcttttgaagagttggagccagcatatgcagggggatacaagaagatgagaaacaataaagtgtggtgtttcggacctctatcatttactaacaaggatcacttggataaggctcaaagaggtaaaaaggcttcaattgacgatggccacctgaagagctggcttgattgtcaaaagccagggagtgtaatatatgcatgctttggaagcatatgcaatttaacaccttcacagttgatagaacttggtttagccttggaagcatcagaaagacccttcatttgggttttcagggaaggaagtcagtcagaagcattggagaaatgggttaaacaaaacggatttgaggaaagaatcagtgatcgtggccttctaattcggggttgggctcctcagttactaataatatcgcaccctgctattggagggttcataacacactgtggttggaactctaccttagagacaatatgtgctggggtgccaatggttacatggccactatttggtgatcagtttatgaatgaaagtctagttgtagaaatattaaaagttggagtgaaggttggggtggagagacctattacatggggcaaagaagaggaaattggtgtgcaagtgaagaaaaaagatattgaaagggcaatagaaagtttaatgggtgagacaagtgaaagtgaagaaagaagaaaaaggataagagagcttgcagagaaggctaaaagagctgtagaggaagggggatcttctcattctaatgtgaccttgcttatcgaggatgtcatgcaaaaagtcaagagagatgtgtga

SEQ ID NO: 39640 - DNA, 690 bp, Glycine max
  Peptide Sequence Number=SeqID_131325
atgcatcaaagtaacaagtcaaacctttctaagttcattccagagcttgtagaagctggcattatgatcatcatggacattatggcaaagctcatgaagcatcgcggagttggggaggcagcagaaacggagagtatccctgggccggaggatatggtagccacggccatggcaagagtgggaagaggagtgacccacgtgccacccgggaaaggacggagaggagcttgtgggtatgatgatgttgttaaagatggttatgggcttgacatggcagcattgagctcagttttgtttaaccacggtgacaatggaggatggtgcaaccctccacgccagcactttgatttagccaaacctgcgtatctcaaaattgcacagtataaggctggcatcgtcccagtccaatatcgcagggtaccgtgcaagaagcaaggaggtattcggttcacaatcactgggaatccttacttcaacctagtagaagtgtggaatgtgggaggagctggggacatcacaaaagtgcaggtgaagggtgacaagaagctgctcaattggacaaatttgaagcgaaattggggtgagaaatgggagactaatgccatgttagtgggagagacattgacgtttagggttaaagccagtgatggcagttttggtcaaacctttgaaggcaaaaacttcccataa

SEQ ID NO: 39641 - DNA, 300 bp, Glycine max
  Peptide Sequence Number=SeqID_131326
atggaagaaacatctgtgctatccaaccctggcaatgatggacatgttttagtgcagttttatggaaatcttcccagtgcctggattgatccaatgacagatatttcaacttttgaggattcttttgaagacaggagcaacaacccttcagaagattttcaaaaggctttaaagcaggccttacagaggaaggcacaacttagttcttgccaaaagttgactcctgataggtctgctcactatgatctgcaagaacgttcatctgtgggttgttacaaaaagggtcatgatggaggatga

SEQ ID NO: 39642 - DNA, 1071 bp, Glycine max
  Peptide Sequence Number=SeqID_131327
atgtctggccccgtgaccatagctgattattcaaatggaggagcactttcttgtgcagagagaacaaaatctgttgatgcgattcctgaattagaccatctgtcaatattgacaaatggtgaaattgacggctttagtgttggacaactcttactttttaatggggagtcatattctggatccctttatggcaatgtttctgaaggccatggaacgtacgtgtggtgtgatggttgcgtatacgagggtgaatggaggagagggatgagaaatggttatggaaaactaagatggccttcaggagcagtgtatgaaggtgatttctctggtggatatatccatggtacgggcacatacattcgttctgataaattgaaatataaaggtagatggaggttgaatcttaaacatggtttggggtttcaagtttatcctaatggagatacctttgaagggtcttggatgcaaggaacacaagaggggcctggcaagtatacctggaccaatggaaatgtgtatgtagggaatatgaaaggtgggataatgtcaggaaaaggaactcttacttggataaatggggactcatacgaaggaaactggttaaatggcatgatgcatgggtttggagtttatacttggagtgatggaggatgctatgttgggacttggacatttggtctaaaagatggcaaaggaaccttttacccgagaggtagccgtcttccttgggtgcaagaaatttacctcagtgccttgagaaaaagagggttgctgccagatttgagaaaacagaaacaggtgagagatgtcaaggtaccagagaaccatatgtcaagtcatgtttcatctgataagtttgcaaaaggaaacctgttaaatctggaagagtctaatagaagaaatgtctctctcgaaaggcgttggagtcttgaggtgtctattgagaaggtgattggatatgattcagcattaagatttgcagaatctgtaccagaaagtagagatggagaagttgatgcaatgatcccaattttggaacgagacacactcaagccgctttacttgttataa

SEQ ID NO: 39643 - DNA, 828 bp, Glycine max
  Peptide Sequence Number=SeqID_131328
atgaattcaaggcatcgtccattacatgcttgtggagtctccatcttagcaactgttgactttgccataggaaaaacacaacatatcaatggaccaataggttcaacactgagaagggtcgcaaaattagccaaatttgccaccccttttatctacgccatgcaaatccaatggctaacatttctctcctttatcgatgatgccattctagcaattgaaaaaattaccgagaaattgtttcccccttcagcccgcgtgttcgacaaagttgatgaaattgtgctaatgatagtgttcctcccagaaaaatttgatggtgcgctgaacaagttttctacaataatccaccgagtgccattcttagatcgggcaccgacccttgtgatcacaagtttgaacagtttggtttccatgctgaactattggggacatgaaaattcaagagtaaacgagaaaacaataggtgttgataggagttgcaatatggattcctcggatgatattaaccatgcgagtttggaaaactttcctccgatgatatcagaatgtgaacataaagcggttcatgacatttcattgtcgagtcgtgtgaaagggtcatacaaagaagcactggagagggggaaagaagagaccccaaatgagataatggagaaagagttcttatacgatcttctaacaaagatggacggaggtggttgtgagtgtgaaggaagaaagaagaatgatggaaataatgatgagagtgatgatgctattatgaaatgtaaagttggagggagcgaaagtgtaaaggatgctcttctgaaatgtgttaattatgcgtag

SEQ ID NO: 39644 - DNA, 1284 bp, Glycine max
  Peptide Sequence Number=SeqID_131329
gaccctcgtgagcgcgagtatttgaaaaccatattgcaccgtgtgtatgggaaattcatggttcatcgtcccttcattaggaagggcattaacaacatattttttcggtttatatatgagactgagcggcatagtggtattggggagcttcttgagattctggggagtattattaatgggtttgctttgcccatgaaggaggagcataagttgtttcttgctagggcgcttctgcctctgcataagcccaagccggttggggtgtaccaccagcagttgtcgtattgcattgcgcagtttgtggagaaggattacaaactcgcggacacggttattaggggtttgttgaagtattggccagtcactaattgccagaaggaggtgctcttccttggggaactagaggaggtgctggaggccacgcagaccgcggagttccaacgctgcatggtccctctttttagacaggttgcccgctgcctcaatagttctcactttcaggcacaccttgcaatgcaggttgcagaacgagctctctttttgtggaataatgagcatattgtcagcttaattgcccaaaacaggactgtagtattacccataatatttgaagcattggagaaaaatatcaagagtcattggaaccaggctgttcacggcctgactgtgaacgttcggaaaatgttcatagaaatggatgccgaattgtttgaagagtgtcagaggcagtatgaagagagggaggctaaagcaaaagaattagaagagcagcgggaattgaattggaaaagactggcagatgcagctgcacagaatgggagtgcagaagagagtagagtggaaatgtcgaaagggggttcgcttcaaaaggacgtgccatggagagcatcgtcttcttctgcgaagcccatccccagaattcatcacagtccgcttcttcgcgtttctcgaacacctgtttccgattacggtatctccgtcatgaggcatccggaccctatagggggtggattgggtgacgaggccacagtggaaccagctggccctgattgcctcgtccctggccagaaaatgcccatccaattacttggccttcaggtctggccaatccatgttgacctgaagtttttggaaccggttgggcgagaacttaagatgcttggaaaggaaaaaatgacacttcttgaagttgatcttgatgagctatttgcatttgatattgatgaaatgctacggaggttttggatgacgccacttccagtgaaggaagataagtcagggtag

SEQ ID NO: 39645 - DNA, 1791 bp, Glycine max
  Peptide Sequence Number=SeqID_131330
atgctcctccaaacaacctgcatttttctactctcagttcttctgagctcgttttcaccacttggaacagcaatgctcaacctcactcttcccggagctcatcctgaccccgaagccgttgcccacgaagttcataggaaggttaatgcttcaatcgcaagaagggaaatgctatcagtgtctgaaaaagacgggtcttcgtgcctaacgggaaatcccatcgatgattgttggaaatgtgacccagattggccaaataaccggcagaggctagctgactgcgtcattgggttcggtcagtacgcaaagggaggaaaaggtggtgaattttacgttgttactgattcctctgatgatgaccctgtgaacccaaaacctggcacgcttagatacgcagtgatacagaacgagccactgtggatcgtgttccctagtaacatgatgattaagctgtctcaggaactgatttttaacagctacaagaccattgatgggcgtggagctgatgtgcacattgtgggaggagggtgcattactttgcagtttataagcaatgtcatcattcacaacattcacatccatcattgtcatccctcagggaacacaaacgttcggtcaagcccggagcactacggattccggacagaatcagacggagacggcatctccatcttcgggtcgaaggacatatggatcgaccactgcaccctttcacggtgcaaggacggtctgatcgacgcggtgatggggtccacagggataaccatctccaacaacatgctatcccaccacaacgaggtcatgctactcggccacagcgacgactacctccctgactccggaatgcaggtcaccatcgccttcaaccacttcggggagaagctcgtccagcgcatgccccgctgccggaggggatacatccacgtcgtcaacaacgacttcaccgagtgggagatgtacgccattggtggcagcggcgagcccaccataaacagccagggtaaccgttacatggcaccggaaaaccccttcgctaaggaagttactaagagagtcgacacgcaacagtccaagtggaagggatggaactggcgctccgagggtgacattctcctgaacggggccttttttgttgcgtctggtgaagaacttgaagttaagtatgagaaggcatacagcgtccaacccaaatccgctgatcgcatctcttttctcaccatgtccgcaggtgttctcggtaatgccagggacaacaaccttggcatgtggagcagaggacctgccgatgacaccacggagtccggaatggaatacacggatgacatgtccaccactgcaacaatgcttctgtcttcttttttgcttctcttcttcttgtcttacacgatattacgcttgacggcaaataatatatctgctatacaaatacacggacaagacaaattaatcgatacacaagcaactgcaatacttaagattagagtttatttacgtattttaagtttaaccagttcccgtgaagtggatgtagacattgtagccaaatttcgaggaaacagtaatctacatataccatacttcataagaaagaactcaagctgttccatcccatctccctctctgatgagaatcatgaaactggccaaatacaggctaaaggtccaagtggagaaggacgaaggcctaagtggagaaggacaaagcccccaagtggagaaggataaaggcccaagtggagaaggacgaagacccaagtggagaaggacaaagcccccaagtggagaaggatga

SEQ ID NO: 39646 - DNA, 438 bp, Glycine max
  Peptide Sequence Number=SeqID_131331
atggagactccgttcgaactacccgacgacgacgtaacagtcattgcaagggcagcggaacatggaatcaccacggtgccgtatcgcgtagaagagtatggatcaaacaaacaccgcataaccaaagacattgagtctctgctttgccctatttgcatggacgaaacagtaattgccgtagatgaagaatctcagaagagaattcggtcacctgaggccaaatgtgctgcctttgaaagtaaggagggcaagagcgaaggacaggttgcagagttattgagtcagtatcctcgtcgtgttgatgcatttaaggagagaattgctaagtctgagcatatggctgttgagcagaggattgctatcattgagcaactaatggaggccgtgatgctgtggcttgcagattttgagcggaggttgaggccccactttgagtag

SEQ ID NO: 39647 - DNA, 1518 bp, Glycine max
  Peptide Sequence Number=SeqID_131332
atggattcaacactatttctaaaccccgcagactttgaattaccccacgactacgacgaaaacgcagaagcaaatctcattgaaattcccgcagactttggattatcccacgacgacgacgacgacgacgaaaccgacgatgaagaagaagacgacgacgacgacgaagacgaagagtatgttcccgccggggcgcctcctagggtttcgcacgacgctccccgtgtcagtacatccaacagcgaagtcgttaccctcatcgaatcgcagaacaagcgccgtagaaccgaaggaggcgaggcttcttgttccttcgcgaatgggagcctgagccaagagaacgagtgggccagccctgacgttgacggtctcctttgccctatttgtatggacgcttggaccaataacggcgagcatcacatctgctgtctcccttgtggacacatatatggcatgtcttgcatcaaaaaatggcttcaacaccgcagaaattccaataagtgtcctcaatgtaaagtgaaatgctcgttgaaggatgtgaggaaactctatgcctctcaagtagtggccgtcgaggaagaaaatcagaagagaattcggtcacttgaggccaaatgtgctgcccttgaaagcaaggtaagtaattggcacaagaaggaaactggatggcagaaaagggaagctgcattgagttttcaagttcagaagcttacagagggaagtgatcgccacaagaaagaagccggatggcagaagaaggaagctgcattgaatcttcaagttcagaagcttactgagagaaacacttatttggagatgctactagatatgcagagcaggcaattgatgttcaattttgaattgcagaaaacgtttgatctggatggtgctcgtgtttttgatatggacatttcaaatcaaattttattaattgcacaaaagcgaaaggcaataggtggaatgcacttgttaactaaaatgagcttgatgtctccatttgagatgcaagacatcttactgccttctggcacaaatggtgttaaagacctacacatttctgcttctcatagtagtagtagcctggccctcttttcttctctaggaaagaaattatcagtgctcagcttggacagcggcaaccttgttgtcaattatgacctacagcttttgggtggtttcacctttactagaattgtattccaggttcctgcatggtcttgttcatgggatctcaacaattcacattacatatatgctggactacagaatggttctgtcttggtgtttgatatgcgccaaactgcaggacccatgaaatcccttgttggtttgactagcaaccctgtgcatactgtacatgctcttgcacaaacttcaagtttgtcttctggtgttaaaaccatcctatctgcatctgctgttggcctttgtcagtggaacattgattctgaagagcgggaccaaaagggactcgaaagtgcttgtatagggattaaaagggatgattttaaagtgtga

SEQ ID NO: 39648 - DNA, 468 bp, Glycine max
  Peptide Sequence Number=SeqID_131333
atgcaggtgggcaggagggaaacatcaatgtatctggaaagacacataaaaatgtttgatcttttgatttcccaccagaccatttcacattccaacaagcacagcaaaaccaaccccccacattggcatttcatcaagcaagatgtgttcacatgggaaagtgaaagtgaaagtgcagaacaaacccttcaggcttcaaccatggtctcctataagaagactcaaaaacgcaaacaaacccatcacgggaactgggtaaccaagaatgcaaaaggggctatgaaacgaaaagggaacatagtggatgatgcacccaatgttgagaagaaggcattacctgagggttggtgtgggaaggtggtgaagatacagttatgggttttagtagcagtaagcgtctctttagccaacttgaaaattgcaattgcgggggcatacaaacaagcaccacacctttgttggttatga

SEQ ID NO: 39649 - DNA, 1850 bp, Glycine max
  Peptide Sequence Number=SeqID_131334
atgcctgcaacgccattctcgtgttcgttcctcactcttcaaccgcgcttcaactcctacgttaaccccatcttccgttcactcaccttccaactctcttcttcgccgctcccattcaatgccaacttctccagcgtcagactccactcttcgctctcgcgagcggcggagaccgattctccgaccggcggaaggtccggcgcgctaactcccggtcccgccgtcgccggtgaagttcaaaagatcgacgtgaatcctcccaaggggacgcgcgacttcccgcccgaggacatgcgcttgcgcaactggctcttcaatcatttcaaagaggtttcgcggttgtatggatttgaagaggttgattacccggtgcttgagtcggaggcattgttcactaggaaagcaggagaagaaattaaggatcaggtaatgccagtggacaatgggtgtgatggttgtactccgtttgttggtttagtgtttctaccctggcgcagcagtaaagttgcgctttggggactagttggtcatgagtttgaatcccgaaacaacctctttgcatatgcaaggctttattgttttgaagatcgaggcaatcgccgtgttgcattgaggcctgaacttactccttctttggcaaggctggtgatccagaaagggaagtccgtgtcattaccaataaagtggttcactgttggacaatgttggcggtacgagagaatgacaagggggcgtcgtcgtgagcactaccaatggaacatggatattattggtgttcccggggttatggctgaagcagagcttatagcttctatcgtcactttgtttaagcgaataggaattacagaatcagatgtcggatttaaggtttccagtcgaaagattgagaaaattccagctgacgagataaagaaagagttgaaagctgttggtctatctcaagaggctgtccaggagctattgcaagtcctttctgtgaagtcattgaccgagttagaagagagacttgggagcagtggggaagcagttgctgatctgaaacagctattctcccttgctgaaaaaattggttactctaaatggcttcaatttgatgcatcagttgttcgaggtcttgcttactacactggcattgtatttgaggatgtaggttcaggcaaccaccctttctccagccccttcaccttcacgaaccccaacaaccaccctccttccttagcctcttcgtcactttgttcccttgccgccaccgtcatcgcaacctcttcctcccctctctacccatttgatcaatttgatttggcgaacccagatcctaacaacatagagaaagaaaatgcacacaaagacagacttagaggaaagctgcgagctatctgtggtggtggtcgatatgatcatttgttctcaacttttggtgctgatgacattgctgcatgtggttttggatttggtgatgcagtcatagtggaagggtggctgcaactaaggtggctttccaacactccccttcacgcccaagactaccagcctggagcatggaaaatgctgttgctcaaagagaagggtctgttaccggagcttaacttgcaaatagatgacattgtgtgtgccttggacgaagatcttcaaggatgtgctgctatggtcgctaacattctcagagaaaaagggcagattgttgagttggttttggaaagcaaaccacttaaatgggtttttaaacgtgcagcccgattaaatgctgagcggcttgtgttagtggggaattctgaatggcaaaggggtgtggttggtgtcaaaattctctctactgctgaacagtatgaggttaaactggatgatctgaa

SEQ ID NO: 39650 - DNA, 321 bp, Glycine max
  Peptide Sequence Number=SeqID_131335
atggcagtgaaggaaagcaacacaagccaaaatattcagcagcagcaacaacaacaacaacaacaagaagcttgtgatccttgcaagtcctttggccaaaagtgcagtcacattgtcaagaagcagcgtgcaaaattctacattcttcgccgttgcatcgccatgctcttggtgggtccattagaggagacagcaagaatcgtaatgagaagaaaagatgagttgtgggtacgacccggtgctgtgccaagctgctcccctgaccctgaccctcgtgcggccctctctgcaccgtgggctcactcctttcctaacccttag

SEQ ID NO: 39651 - DNA, 177 bp, Glycine max
  Peptide Sequence Number=SeqID_131336
atgaaggaggtgacatggccggtgccggtttcgacgagggtgcgaaaagaaagagttaaaagagaaaggaacaaaaatgtgaggaaattggaggagaaagaggagaatgattctttcaagagggtaagaaagaaggtggctggctctatgggagtgggaggttgtttcacgcgctag

SEQ ID NO: 39652 - DNA, 4158 bp, Glycine max
  Peptide Sequence Number=SeqID_131337
atggagcttggtgtgcattccgtttctaaaggagtgaaatccattttggattctagagaagtgctgttactagtgatgcaaagggagtactttgtcacgtatcatggtcttgctcatgctcacaaccgctggattccagaatcaaaattgcttctcgaggctcctaagctcttggccaagtttaagaggaaactgcaggaagtatccatgaaaataatttcttcttttgatgccaaattaccaggttaccaccaggtggaaaagagattggagtataccccaccgggtcttggttatgataatgctacttgggagttagatgatgcttcatttttgacgtcacctgaaggcaggaaagtcatagatgattacgaaagtcgtcgcaagagagcagagagactgtcaaaaaatcattttgaagctaatgaggagagaaaagcttccttttctgaattatcagtgttgccaactggagattcgccaggattttataaccagcatttgacttatgtgaacaagcttcgcatgtgttggcacaaaggtcagagtgctcttattgtagatgatcaaattgaccaggagcgggttatgaaggtgattttgtttatattatctttgaattgtaatgtgaggaggccttttctcatcatctcaacttctgctgccctctctgtatgggaaacagagttcttacgtttggcaccatctgccaatcttgtagtttacaagggagacagagatgcacggagtagcatcagggcattagagttttttaatgaacatggtggaatattatttcaaatactgttatcatcttctcatattattgttaaggacttgcatgaactaagatgcattacatgggaagcaataataattgatgaatgccagcaatccagaatttcaggacacttggacgatatcaagattctaaaagctgaaatgagactccttcttgttagtggacaaatcaaggaagatcaagctgattatatcaaactgctttcattactcaagtccggacagcatggatcaagtattgctcaagtggaaacttatttctctgcttcttctaccatttccaatttgaagagtcaattggaaaaatatgttgtattcaaatgcaaatctggctccactaggtttgtagagtattgggttccagcctgcctttcccatttgcagcttgagcagtattgttcaatgctgctttcaaacttaatgttgttatgctcaggccaaaagtccgactcagttgatgccctccatgaccttattatctcaataaggaagtgctgtgaccacccttatctcctgaacccggaactgcaaagttttgttactaaaggtctacctgatgaagagcgtttaaatattggtatacaagcaagtggaaaactgcaactccttgaaaaaatccttttggaagcaagaagtcgtgggttaagggattcagctagttctctttcacttaaaaaactgcagtcaacttgtggctctggatcaattggagatattttggatgatgttctctgtcagagatttggtaaggattgctatgtacgatatgatagaggttataccccaaaatcaaagcaagctgctttagacacatttaatgatggagaaagtggaaaatttgtcttcttgatggaaaaccgtgcctgtctctctagtgttaagctttcttcagtggacactgttatattgtttgacagtgatttggaaccacaaaatgacctaagaggcttacaaaggatgtctatcagctcacagtttaaacagattactgttttcagattgtactcatttttcactgttgaagaaaaaattttaatgcttgcaaaagagggtatagctcttgacagcaatgtgcgattgcttagccagagtatttgtcccaccctgctaaaatggggtgcctcctatttgttcaataagcttgatgatttgcatgccagtgttgtttctactccagacactgtagatatgtcacttctatgtgatacaacctctgaattatcatcccaattggtttgtggtgctgatgatactgattgtcatggatggtcattcatatcaagaatacagcagaatggaggggaatatgcgagggatgttttattgccaggagaaagaataatgaaatctggcggtgagccatgtggtttttcctggagtgatcttgaaggaaggcatcctaaatggaaatttttgcctgtttcatctcagaggatcaggaacacagtcaaacattttgattacggactaagagaatctgaatgtgaaaaatacacctttatagaaaagaggacagcgtcgaaggataatgttgatcccaagaggagaaaagtgtccaaggataatgctgatcctgagtggagcaaatggaccatgaataaagttgatcccaagaggagaaaggtgtccaatgatgttgttgattctaaaggaagggaagcgtccaggaatattgttgattccaaatattggaaaacaaggttgaagagcaagaagaatacaagtgttgtcaatagagcaaataaatcaaatgggcatcccttgaccaatgaaactacgggaaaaattgcaacgaacatgcaattttcagagaaaaagaacccgcctgacatacgaaatttgccaaagccagatatatcagcttgtttgttggaacatgagattgatatgaaagattcacttgctctagcaaaactgtacttgaacttcgattgcaaggaagaggaagccaccgatgtttactcagaactgtggaagcatgtgaaggatttttctaattgtgtacaaaatggactttgcgtcgagaaatgcaatagaagtggtgcttcagactccaacatgcctgagctgaatgatttggcagaggaggagaagcagaaggattttctgggtacttgtgtttcaaaacttgtgaaatctgtcacaaatgaactcaatcttcaaatgaaatctcccacaacagtggtttcacaagacctgagttgtactcatgaaatttgtttatctccaaatacacctggtagttttcctgtggaaggagatgctatctccatggaatctggctcagaagatgacagagtgaacgctataacattaataactgcagaagattcatccgttgatcacgggagtaatgatgtcaaccctgttactggttctttggaaagacagagccctattagaagtacagatattacacaatctgatggcaatgtttttgaagatcctcaaattttagtgaataaagtggttgctattgacaatggtatgaatatgtctactcattctgcgcagcttgacagtgttgaggcagatgctggaacttctgctagtactgctgttcctgaggtcagacggtggtacagtgtaatgagtcctgtatgtgatgagtcaactgctctgaagtttcctgagactaccttaccatatatgcaaccatcggattcaaatttgtggccattgcctcagatggcaatgtctgctattccatcttttccggagaacaatgcggctagtacagtcatgcctctagatgatatttttcgtcatagtggtgaggatcatcgctatattcatgaggctgaagtaatattggaagcaccaaaggaccttaactcttcctttgtttcacctgtgataccgcaacccttcactagtgtgcccatgaatgaaaatgcgacacatgcacctcacggcattactattcctggatttatgaacagtgattactctgaagctcactctgtgacatctgaagtgtcccaccttgcctacacagacccactactgggtgaaatgtcgataatagaaaacatgaatgaagaagctttcatagatctactaccaatagaaatggagagaattgaaaaggagaaagaagaagccttcaagatacatgagcaaaagatattgcagctccaatctgactatgaaaaggaggttgaaaagttaagtgtaaagtacaagatgttgcttcagaatgttaatactgaagtagctctaaaaagaacggaacttgagacacaatgtgaattagtgttaaggaacaaggtattagctcaagtttggacccataatcttgatagttgtgaaggagatgttgtacagtgctcagaacaaggtacggatcacgagtaa

SEQ ID NO: 39653 - DNA, 309 bp, Glycine max
  Peptide Sequence Number=SeqID_131338
atgtccagttctttccaagatatgggaaatatctgttaccccaaagtgaagctctgtatgtggagagtgctccttgactgcattccttctcgggcaaatcttgttgctcgtggcattactttacaattgcacctttttccactgtgtgagctccaacaggaatcaactgaacatattttgttgcactgccctatagcatactctatttggttgcaacagtggcaagtaaacacaacgtactgtctgcatgttagaagcgcttggttttgcgttgctggtcaaacttgtgcagaactgccttatcaatga

SEQ ID NO: 39654 - DNA, 385 bp, Glycine max
  Peptide Sequence Number=SeqID_131339
gtgctcctctgccccaagttgccccgtgaaaaagaaggtgcaaaggagtttagaggaccctacaatacttgttacaacgtatgaaggagagcataaccatggtcatcaaagagctgaaatatcacttgtctcaaaccaaagagaagcccctccaaaagggtcaagtcctgtttcctcacctacacccacaattcgaagtgctgcttgccccaccgtaacgtttgatttggtcaagtcaggtttggttgaacttgaaagtgcccaaaagtcatctatccagcaatttttggttcaacaaatggctacttctttgacaagggataccaatttcacaacagcacttgccactgccatttcaggaaaaattctagaggcccaatggtga

SEQ ID NO: 39655 - DNA, 294 bp, Glycine max
  Peptide Sequence Number=SeqID_131340
atgggcactagtaagaacagaaatctacctttggagggcaagtgtggagaggatgatgaaggcttttggggaggaagacatgggaactcaggcggggcagatccggtgatggaggaaacattagaagtaatttcaaataagttgagtaaagtacacgatatatgggcagagataggaagtacggatgttgagaagggtgaaaaagtagtcatcaaaatggaaaatattgagaaagatgttcaaaaaggccgaaagcagattgaaaaggaagaagaaagcagggaagaggtgtag

SEQ ID NO: 39656 - DNA, 354 bp, Glycine max
  Peptide Sequence Number=SeqID_131341
atgtctcctgatggcctcaatttggcatctggtgatgaagacggcacaatcatgatttgggacctctctagtggctgttgcatcacgcctttagttggtcacacctcatgtgtctggtcactcactttcagttgtgaaggttctcttctagcatctggatccgcggattgcactgtcaagtttggggatgtaactacaggtataaaagttccaaggaatgaagaaaaaagtgggaatactaacagactcagatcatcgaaaagcctgcctaccaaatctgcttcagtttactctctccagttttctagaaggaatcttctttttgcagctggagctattgcaaaaagtggctga

SEQ ID NO: 39657 - DNA, 960 bp, Glycine max
  Peptide Sequence Number=SeqID_131342
atgattagaaccagaggattgcatcgggctttaagaagagttataggaagagcgttagggacacatgttaatggtgatgcagatgaagcccatcagtatcgaaggtcgatagcatatgcacgtagacaacaggcagttgcagctgttgctgataatgttgagcatgtggatcatcctgctgacgaagttcatgagcagtctcaggagcccctactgatgatgtacatgctgatgcctagggttttccaggcgggccccaaatttatcaccacagtttgggtaggagaggaatgtcctaagttgaagttgtcctctcatgggaggaagtgttggatctacgagtatttccctactattgcttcatgtgttgctggagagaattatcttgagaggaaaccacgtgcttgtcaatggaagtctgggaaggcattactggtgtcaatgtatcataagcggtttgatagattgacgtctgatgctgtctgctggattccttatggtgaccaccgttcattaagagaatttgagctcatctccttttttttcggacaaatcagatggtgttcatctattgtgatacaccgaccaaagagggtagtgcgacgtttggttatgtgcagaccattcctccacacccctattgctccatcttcatctatagaggagattgacaatagatggattcacatttctgaataccttgcaccggtgagtcagatttgtgttgctcctggacagtgtgcagcagactacataaagtggttttacatgatatctcaccccttcatgagtccgacacaacctggggatccttctagacatccacctgtggtgcatgatgagacatttattgtactagatcctcctcaacagctcttcgatgcaacagctatgccaaaatcacctgcacctgcacctgcacctgatgatgtagacatgcctcgacatgcagtggtataa

SEQ ID NO: 39658 - DNA, 312 bp, Glycine max
  Peptide Sequence Number=SeqID_131343
atgagtgaggaaaaaaatgaagtgggaggaataagggaggtttttgggcagtttgtgaaactgcctgcagttatggattgcacgcttagcgagggacatggtgtggctcaacgcccattcttgcacttagcgaccgtgctttgcgcgcttagcgtgtggaatgaatttctacacagaggagtttctaggcttagcgcgaatgttgcgcttagtgagtgggatccatgcttaggtctgagtttggcgctaagcctaaaatggaatatggtcagccagatgggttttggacttagcatcataggatgcgcttag

SEQ ID NO: 39659 - DNA, 978 bp, Glycine max
  Peptide Sequence Number=SeqID_131344
atggcatcgaagaagaagcgtgcttcctcctctcgccctcaagagtcctatgactcttcccggcacgtcgagttagcatactcccactatgatgagttcctccacgagctggagcatcgacaatggcaccgaaacctcacccgccagatggagaaccgcatagatatggctttggtcaaggagttctactccaacctttatgaccctaaggatcgctctcccaagaaatgcaaattgagggggaagctgatcaaatttgatgccactaccctgaacaacttcttggagaccctagtgattctggaggtaggggagcgctatccggagtactctcattattgccacacctaccccgatcaccaagccatagcagccaagttatgcattccaaggcaaggatttatgttgaatgttgagggagccccatggaagctgctgaggaaggacctgactaccttagctcagacttggagtgtcctatcttactccaaccttgcccccacctctcacacctccgaccttaacgtgaacagagctcagttggtttatagacttgtcatgaagatgaacatggatgtcggtctctcaccttcgagtccctcagcccgaccattaatatggcctacatccgcaagaattgttggaaccccgatgatccctctatcacctttccggggtcccgcaaggccagggccagggctccaacagaggcaccccagttgctcctccccttcccagatcattggcatcttccaactcttccacttccttaaaccagctcgtgcccatgttgtagagtattcatcatggtctctgcctcacaatctagaacatgcaccatctctctcagcagtagccattcatttccctgccaaaattcatggagcaggtgtcgctgatactgagatggatgcggattatgtaactaatatcactttagcacagggagcttgggacccatggcccacccatgattga

SEQ ID NO: 39660 - DNA, 307 bp, Glycine max
  Peptide Sequence Number=SeqID_131345
atgggtgcggtgaaagtgaaggtgcgttgcggtagtcggtggcggcaaacgagatacgcaaaaagtggtgactgtgtcgcgaacatgtacgaagatgagtggatgtatgaaataatgtctgaacaagcggatatgaattatgaaaatgaagaagcatgtggtgcgaatgaaccacatgttgattgttccgatgcgttcaatacttctcaggtgtttgagtgccgagatgatgttttgcggtgggctcgatccgttgctcatgaaaacggatttgtggcggtgattttaaggtcggatacaaacccag

SEQ ID NO: 39661 - DNA, 198 bp, Glycine max
  Peptide Sequence Number=SeqID_131346
atggagggttttatagtagagcaactgaggaatttgtatgcaaagatgcttgggacaagaattattaatttgaaaggtcaaaacaattctagaaagattacagaaaacaattgggaagtgcaagaagcaacaacccttgacatgggaggagtgaagacatttctacctaggccattcttagttaacctaaatacctag

SEQ ID NO: 39662 - DNA, 183 bp, Glycine max
  Peptide Sequence Number=SeqID_131347
atgctggactacgtagagtctcttctgcatctgcccgtggttggcgacttgcatgcctttcagcccgtgcacgtggatgatgttgtacagatgctggtggagttattgatggtccctacagaggcttccagggctgagacagcgcaatgtcgtggaccgagaattataagcaattgggcttga

SEQ ID NO: 39663 - DNA, 684 bp, Glycine max
  Peptide Sequence Number=SeqID_131348
atgaattcgggtcgtatttgtgggcctttaaaaaccgctgggacccaagttggttaccgagggaaagcgttcttcaatttcagagttcgggcttcatttcagactcagagtaacactacagtacagagtacaaacatcaaacaccttctctgcacgcaaaaaccagaatcgaagatgcagagatttaaagctctgctacctcaacaaactaggtcctcacttcgcactttctgttctcaccgtcgagctttctccgctcaaccaaattactcagagcaccacgacgacgattctcaggaacagattttggtcgaaggaagagcgaaatcgcgagcagccattctcaacaggccgtcttcgctgaactcgctcaatgcttcaatggttgctcggttgaagaggctgtatgattcctgggaagagaactctgatattggctttgttctgatgaagggtagtggcagagctttctgttctggtgcagatgttgttaggttgtatcaatcactcaatgaaggctcttcgctatgcgaaggtatgggggagggatgttgtacgcagccttacccttgcatatgcaaagaggctgtttccggattcgaacccatgaccaacaagtcaccaaggcacaactttaccgctgcaccagggctcgccctcttctacaaattaacttatgcataa

SEQ ID NO: 39664 - DNA, 315 bp, Glycine max
  Peptide Sequence Number=SeqID_131349
atgtggtcctccgtgttaaaggtgcttagtatggttgatgaagatggacgtggaccatctcaagcagcagttgatgttgtcaaagctcggttgggcacaatgagagagagtggctggaataatttttttgccgatgtccaaggattttgtgtagctaaaagtattccggtaccaaatatggatgacgaaataccggttcggggtcgtttaagagcagaagggaggactatcactaatcttcatcattaccgtgcaaagatttttaatgttgctattgataaaaatatgtgtggagatggatcaccgctttactga

SEQ ID NO: 39665 - DNA, 795 bp, Glycine max
  Peptide Sequence Number=SeqID_131350
atggctgaattcacagaaaatttgcaaagaattggaccctcctcatttccattcttggacattgatccaagcatggaactcctaaaccaattcatagggatgaaccaattatatgttctagacaactcaaacttgatgccttatttctcctttgacaccttcttattgggcccccaagaacctgagtttccaggaaacttggaagaagattttccttttctcttcaatcatgtcaaccacaataatgcacttcctatttccctccccattttccaagcagaaaatgagatccatgaaggtaaaaagaggaaatcaatggatcttcctgagaccagttcagtaaactcaactcctaaagtttctgagagtggaaacaagttcaaacatagttctggaagaggaaagagagtgaaaaacaatgtaacagaagaggagaaggcaaaggaagtggttaatgtcagggctagaagtggtcaagctactgatagtcgcaatttagcagaaagggtcagaagagggaaaatcaatgagaaattgaggtacttacagaatattgttccagggtgttacaagacaatgggtatggcagtaatgttggatgaaatcataaactatgtgcagtccttgcagaatcaagtagagttcctttctttgaagcttactgcaccaagtaccttttatgacttcaattccgagatagatgctttggaaacaatgcagagagcaagggcatccgaggcaaaagagttaggcatgtataagagagaagggtatggaggggtttctttcttttaa

SEQ ID NO: 39666 - DNA, 1572 bp, Glycine max
  Peptide Sequence Number=SeqID_131351
atgacgaatatcttcttacacactgttaaagtcaacccaaatctcccatctcaaaacccagttccctcccatccccatgaaacggacacaatgggtgagaacgagaacgccaccgtcacaaccaagaagaaaaccagcaaaacccttctcaccctcctaacggaaccatttcaatggattcaaaagctctcgtcacagctaaacccaaccttcgtaatcggcgtgttcctaatctacggcataggccaaggcttctctggctcactcttcaaggtagtggcagactattactggaaagacgtgcaaaaaatccaacccttcacagtgcagctctacgtcggcttctacttcatcccgtgggtcctcaagcctctctggggaatcctcaccgacgcattccccgtccgcggctaccgccgccgaccgtattttattatctccggcgtgataggcgccgtctccgccgcggttattgctttcgccgggaacctcgccgccgtcgccgcgctgatgtgcttcgtcggcgtttcggcatcgctcgcgatcgcggatgtgacgattgacgcgtgcattgcgaggaacagcatcgaggtgagggagctcgcaccggacctgcagagcctctgcgggttctgctccggcgccggcgcgctcgtcggatacctcgcgagcgggttcttcgtgcaccgccttggaccccaggagtcgttgggtcttatggcgctttctccggctttgacaattgtgctgggttttgtgatttatgaaaacagaacaagtgggtcgcatattgaaaagaagcaggcagtggagagtgtaggaatgaagattagaagcatgtaccaaacaatgttgtatcctcatgtatggaagccttctctttacatgttccttgccctggctttgaatgtaaccactcacgaaggccatttttactggtatacagatccaaaagccggtcctgcattctctcaggagtttgtgggggtgatctatgcaataggtgcagtggcttcattgataggggttctaatctaccacaaggcactaaaagactacccatttagagacctagtattctatgcacaactcctatatggcatatctggtgtattggacctgatcttcatcctccgttggaatttggtcattggaatccctgactacttctttgttgtcattgaagaaagtgccacaagaatcacaagcaaaatcaggtggatgcccatgatggtactcagcacccagttgtgccctttaggcattgagggaaccttttttgctctgttaatgtgcattgatagcattggtgccctcttatccagatggggtggaggggtgcttcttcgtgtccttcacatcactagaactgactttacaaacctttggttggctgttcttataagggacatgcttaggtttgctacacttgctttggtttttcttgtccctaagactgatcaatatgaggaactgcttccttttgaggtttcaggaaagaacacgagtgataaggtagatgaagaagagactttggagcttgtccccatcaatggcaagactgaagtttag

SEQ ID NO: 39667 - DNA, 600 bp, Glycine max
  Peptide Sequence Number=SeqID_131352
atgcagatggcggacagaggtagaggtggtggtcgtagaacatttaatcgtggtagaagatgtggttttagtttgggagctccaattaccaccaacccttcctcttcatccattcacatatcaacctcagagtcgatgatacatgtcgttgcacagactccaaacacacttcctacatctcaagaccaaccaaatcctacctttgtaagggagtcaattcccactacccctgttagagatgcttcaccttcagcaccagatgattctcttacacctgagtacccactggatccaaattgtgaacatattgttgatcagaggcctttcattcgtgcatataaaggagagtttcaaccaacatatgggtgttctaatttcatatcaaatatcattagggaaaaatttgatgaactagctgcaagttggttgaaggtgtcagttgaccttcgcgataggtggtttggagagtttaagaaagagtataggtggcacccacaagaaaagcgagccattagagctgtttttgagacaaaaggttcacgcattttgaaaagtgcaatgaacaaatcaaaaatggttaagataaatgaaaatggataa

SEQ ID NO: 39668 - DNA, 1116 bp, Glycine max
  Peptide Sequence Number=SeqID_131353
atggcgcttgcgggattggctggattgtcctccgtagaaaaatctgcccacaatggtgttgatcaaccctcttatttgctacgtgggtttatgttcttgtggaggttgttaatcgcgtcttggttgatttatttggttgcgtctaacccttgcctgggaggtttcgtcaaaggtagccttatggatagctccaagttgaaagcttcctcaaggattgtagtgcggttggccattagggtcagtcttggtgcttcgttctctcttgtcgagcttttgttcggcttgtctaaatttgttcctgaatatggacatttcttccatctagatgtagcccttgtcttgttcatgcaactcgtccattctactagggatttggacaacaatgtgtgcaaacctatccatgaatttgtggagaaattcatcatttgcttatcgcagactgctattgatggaccttggaggaagtccaccgtactaagtcaatgtcacacctttgagggacattgggaagacacgccacaagattgcattgtcattggtgtacaagtttgcttggggtatgttagcttccatgatgtggtcgacgaaggggtgtcaatgagtagtccaccctgtaggacggtggatgtgggagagacttggatcatcttgattgttgactatgcgtgggcctttaactttcttagatcctccttgtggcgtcgctccatctccacaatgcggttttcgcgttgctggagagtattagtatctgtcatggttgttggtggaggattggagctttcgaaaaaggtctcgcgtctgaggctagaccaagtgctaaccatgggtgagagagaaagaggtaatatgatactgcgaggtatgttttaccacgaccccacggtggacgccaaatgtacttaccaaaatccaaagttggcacacgttagggtggacgtggcaaaggaggctgaaggggggacctgcaaagcaaagggctctgacactcaaggagtacaagggaacctggtacttataggagtgagtggaagttgtgagtatttgtttataggagttgttacagcctttgtagataattatcaacttgtagatacagttagagataatgcatag

SEQ ID NO: 39669 - DNA, 1302 bp, Glycine max
  Peptide Sequence Number=SeqID_131354
atgattgcggagacaaagccctttggcagtgacgggaatggcgaagaggaggagaaggaaggggtggtggagatttgtgtccctgaccatggtagcacacacaacaaaaagggagaagcggatgtcggagggaaggatgccgtggctggagggctttgtgtgggaccggtgactggcggctgggaggagtgggaagttgtcatgggaagggaaggcggcgtggtttctgctgttggtggaggcggcgtggtttctgctggtggtggtggcttagcagaggaagaagataggttggttaccttgggaagcagaggcggcatgggtggtgacttcatagaggcaaaagatggaaagggttgtctgggtaccatggtattcaatatccagagaatggcatcaagtttggaagccatggaagtttgggctgcagcaagtttggccatggcggcctcgaggcgatccatgcaggcagcggaaagttcggtgtccaccattgaagagtggcaggctttgagagcaaaagtcttaaaacacttagatggagcttggaaagaagatgaaaatagtggtctctccctccttaagtgtctcgtgcaagatgagaagaatgaagtggagtacgataggcagggcattcgtcaatacaacatgcagcaagtacacctagtggaggttacagcaaatcgaggagatcattcaaacatgtcatctgaggagatcaaggagtaccgggaacatctgaggcagttggagtcgacgtctgaggagcagagtgacaattcttccaagggcacgtacaaggtagcattaagcgtggctttggcacttcgttatcttcatgaggatgcagagcaaagtgttcttcatagggatattaagttggctaatgtgttgttggacacagattttagcactaagcttggtgattttgagatggcaaagttggtggatccaaggttaaggactcaaaggacaggagtagtggggatttatcggaggacttacaaagatggggaatttcttgtgcctcttgtgaattggatgtggcaattgtacgtcgaaggaaaagttctggacgctgctgatgagaaattaaacaaggagtttgaggtggatgaaatgacaagcttaattattgtagggttgtggtgtactaacccaaagaacaaggaaaggcccacggctgtacaagtaacaaaagttcttcggcttaaagcggcattcccgatgcttccacttgaaagtgtaatcgagtcctcctctttctctaaatacgtatacgcatgcataatccacttatga

SEQ ID NO: 39670 - DNA, 939 bp, Glycine max
  Peptide Sequence Number=SeqID_131355
ttacccgttgtgcgtctcaatgccttcaatctagcacagggctatccagagcgagaaggtgataatgtggcaaggaaccatggcatgcaggtccaagaaaagagggaatcccgaggattaagatctcaacccagtgggcatagggcacggcgaatccaatgggcgtatgctactcgtggtggacgccgtgaatcttctcgtccccccaattgttgtcgtgacgatggtggcggtgaggggaacgaacatgcgtatgacgtctttatagcacttaaagacgaggaagaggaacagaattttgtggcactagaggaagtaatcggacttggcggcaaagtagttgaactagagggtctccgtgaaggtgaggttgcggcccaacgctgccgcgacctctgggatggaagcgtaggggagcatcatcaccggaaccctaggattgctggcagcgttggatgtgatgtgagagaggggaggggccaagggagcgtgaatgccaccgtgtattcttcaactacgtttctcagagaccgtgattctgcaaaaatcagatcagatggtagcactctcggcctatacagtgacacccaaaataacatcgttgctgtcgaatttgacacttttgtgaacgataatgacccaccaatgttgcatgtagggatcaaaaataactctctggcatccatcaattatagcaggtttggtattgagagaaacttagggaagatggagcatattgtcctaggggaaattctactagagttgatcagtactgttgagttttcaggtgcaacagggtcgtcaagtgaggaaaatgttatccattcttgggaatttgcgttaaccctgaattccatgagtttagagttgttctatttttttggtgctcgtggttattggtgtttcccggttgatcttcatcaagaaaagaagaagtga

SEQ ID NO: 39671 - DNA, 675 bp, Glycine max
  Peptide Sequence Number=SeqID_131356
atgttcgggaactctatcagagcaattagaggaaaaaattggaggaatctcagggaactgctagagatgctgctatcgctggctaaagacacgagaaataaagaaattcgaagcaagcaagttattccacacactggtggatccaaagctaatcctagaagaagaaatgagttgtttttagaaactgggaagctaccaagtcgtggacaattatatattgaaactcataaaaggaaagatggatcatttgtaaatgaagcagcaaagactatagcggaacaaattgaagtaggattgactcagagaatagttgatgaatttgaagtttctcctcttgatgttgttggtagagtgttagggttagagcactctgggagagtgcgatgcatgagattaggagttgttccttttaatacattcaggaacacaagacttcgagcttttagtctgagctcttcttcatctggtgttgcctttccatcttcaaaccaatggcaagagaaatacaacaatttagaatcagcttttaaggcctacatgataatgaaggaaggaaggatccctaaagaattagcttgttatttcactcctgatcaaacacatccaaatgatgcttcaagtgttcctaatacacctttggatgcaagaggatcttctggtgctagcaacccttag

SEQ ID NO: 39672 - DNA, 840 bp, Glycine max
  Peptide Sequence Number=SeqID_131357
atgcaggcatatactgaaacttccggaaacctgaagggcttaccacaaggtataatacaagctacttcagatcttgagttaaggcatttatggtcgccaagtaatttgaggtcaaagggtagagtttactccaataacaacttattggcagttgaagtttgttatgagcagaggatagagtttcttggattcgagtgcagagataacattcacactccaagctttactcataatccttcaaatgagcaggaggtgttaggtgcagaaaacagaacctggatcccaaatgaaagtaggtgtaggaatgagttcctaaagattgttgcggagatagagccatttggcaatgacaagaatgatgaagacgatgaggaggaaggggtggtggagatttgtgtccctgactgtggcagcacatacaatggaaagggcgaagcggatgtcggagggaaggatgtagcggctgggggctccatgcgggactgggggtcggagaagggtgcgaggtgtctggcgttaacagggaggtgggaagttgccatgggaaggggaggcaacatggtttctgctgttggtggtggttttgcagaggaagaagatgggaaaagttggctggttaccttgggaagcagaggcagcatggttctggctgggggtggtgacttcgcagaggaagaagatggagagggttgtttgggtaccatggtattcaatttcaggagaatgacatcaagtttggaatccatggaagcttgggctgcgacgagtttggccatggcggcctcgaggcggtccatgcaagcggtgaaaagttcggcgtccaccattgaagagcggtag

SEQ ID NO: 39673 - DNA, 409 bp, Glycine max
  Peptide Sequence Number=SeqID_131358
atggctttctcaaatggagcattgatgctcacaaacatggatggtgaaaagcttccttcgcctgtgaattctgatgacatcaaggctcaacgtgctttgcctttatgtttcataggactcaacgtcctcgcctttacgtttcattggactcaacatcctccttctttatgtttcataggactcaacgcgaggctcacgggtgcgttttccaaaggaggaaaatgcgtggagtcgccaccaacgtttatttgtggaaaacgtcagaaaaaccgaaggaaaccggtcaaaaagaatattccaagttcgggagttgtatttacgtttgaggaaggtattagcacttctcacgtcgacaaaagcggggctcttgctcctacgtaccctccatcgaagaggaaatcaaacctac

SEQ ID NO: 39674 - DNA, 351 bp, Glycine max
  Peptide Sequence Number=SeqID_131359
atggatgccacaaatgctaaagatgtgtggagtacactgttagaggagtttaagggtagtgacaaggaagaatttgaggttggactatctcaatctaggtttgatgttgcaccaagtgttggtgaatcacaactcactcctttagaccctgctaaagaacaaagacttaggactcaatgttgggttacagctgcgggaccaaagcgtaagggacgtctttatggtactggagatcttgctcatacttataaatatacacaaggatcttccagtcatgctcaagattcagcggagattaaccaactaagggaggagcttcgtcgatcaaaggaggatattcgtgtattttag

SEQ ID NO: 39675 - DNA, 972 bp, Glycine max
  Peptide Sequence Number=SeqID_131360
atggatcaactccaacgtcaagctttccacaagacatatggaaagatctgggatttggctatgatagaagtgtctgttgaagccattgcatccctcgttcaatattacgaccagctgctcaggtgcttcacgtttggggactttcagttagtaccaaccgtagaagaatatgaagggatcttgggatgcctgctaggaggaaggaggtcatatctattttctggattatacccctccatggcaaggatagccaaagtggtcaaagtcttgacgcaagaattggaccaagtaaaacaaaacaacaatggtgtgattgggataccaaggaagcatttggaagagaaagcaaaagccttggcagatcaaggaaaatgggcctcaatcattgatgttttagcgctattggtgttcggagccatcctctttccaaacatggatgggctagtagatctagcaccaatcgatgtttttcttgcttatcaccacagcaaggaaagtctggtcgttgctatgttggtcgatgcctatgacacatttgaccgaagatgcgagaagagtgaagcaaggattgtctgttgcacacccgctctttatgtatggctggacaaggagcttagaggaagcagcaatgggatcattggcggctatcacaagtggctgaaggctaggacgcaagagataacttggctcccaaagctaggggtttcaaatgaggaagaggctaaggtccctgaggagagcaaagaggtgcaagccttaaaagtggaattggaaagaacacaaatagtcaaggaaaagttcaagacgacaaccatcagagtcagaaaggaatgtgatgagctgagggatgtcaacacggctacagccgcaacattggaaccagaaacaagtttcgaggggctttatggggcagcaacatcgaactcaagctccaaaggtctgaaagggaccagtagagagtcgaatgtatga

SEQ ID NO: 39676 - DNA, 660 bp, Glycine max
  Peptide Sequence Number=SeqID_131361
atggcggggagacgggtacggatcatgtgcaccagcatgaccacccttacgcagatatggatgacgttgctgctcaaaaacattttccccagtagccataattcagacctccccctgcagaagtgtcagttagtctacaccatcctgactcagtttgcagggatcacaccgcctagacacccagtggacccagggaagtccaacaggacactggagttccctactttgatcacaggcctttgccaattctatggagtgtcggtcactcccaccaagcttatccggccccccatcagcgccgcagcagccagaggaggaccagcagcagccagccacaggtgcactattgccccctctagaggagacaccgtccctggggtccatctccgctcacctgcagaggctatagctccagatgcggctaaccacaggggtcaagtgcagctaaatgagacattctaccggtacactatgcaccagcagagccaggacaccagtcctttcccgtggcctaccgccgagcagttcaaggccacagttgcctggcctggagatgcgctcgattttgagacaagggtaggacccgcagaggtccctggggatgacgatggagctcaggaggatgacgatatggctgatgtgctagatttcttcacttga

SEQ ID NO: 39677 - DNA, 204 bp, Glycine max
  Peptide Sequence Number=SeqID_131362
atgtcagagattgaagtacttgacgatggctacagatggaggaagtacggaaagaaaatggtgaaaaaatgcccaaatccaaggaataactacaggtgttcagtggatggatgcactgtgaaaaagagagtggagagagacaaggatgacccaagggacaaaggtagtaaacttttgaggaaatataggaaatcaaagctttga

SEQ ID NO: 39678 - DNA, 693 bp, Glycine max
  Peptide Sequence Number=SeqID_131363
atggaggcttccacaatttctcgtagtctgaatcctttcttgaatccttcaactacaaaactaaaggagtccggtgccgatctcgagtgcggccttggggagatgcgtgggcttgcgagggcgcaggttgcccgtggttctggatttgaggcagtgggggtaggagtcagggttggaggagttgggttcagaggcgtgatcggaggggcgacggaagcggtagtggtgagcggtggtggtggtgagaatgagagagagagtgaagaagctgcgcagcttaaggtggaggaaggaatgtggtatggtatggaaattagagagagttggtttgattttattctttctttctctcttcgtgttctgctgcttaaattgggggagaagggaaaggaggtgttcgcggagcgcgccattgcgactcttgggaagctcgaagcttggattctagggtttgcgacgatacgtgcaaattgtaacgatgaagggcttcaatgcaaggtgggagttgagatgctaaaagtgtttattgttataggggatggtggtgaattttatcatgaattaatagaccatggttaccctgatggaaatgaaaaggctttatggacagaggctcttctagttggcagtggaacgtcgactggtactgttgattggcttcttgaagagcttctaaaggataagcttcaatag

SEQ ID NO: 39679 - DNA, 930 bp, Glycine max
  Peptide Sequence Number=SeqID_131364
atgtcaatgatcagaaccatgattcttcttggtacgaggaaatcatcgatgatgatctcaaatggtcttttaaactcaacagccattagcgagtaccaggacatagctctcttagatacaaaacgttttggaaaggccttggtgcttgatgggaagatgcagagtgctgaaacggacgaatttgtttatcatgaatgcttgattcatccacctcttttatgccaccctaaccccaagactgtgtttataatggggggaggtgaaggttctgctgctagggaagcccttaagcacaggtcaatggacagagtgatcatgtgcgatatagacaaggaggtggtaaatttttgccgaaaatacttgattgtaaataaggaggcgttttctcataagaagctggaccttgtcatcaatgatgccaaggctgaattggagaagagaaaggaaaagtttgatatcattgttggagatttggcagacccacttgaagatgggccatgctatcaactctacaccaaatccttctatgagaagatcctgaagcccaagctcaatgataatggcatttttgtgacccaggctggaccagcaggtatcttcacacacaaggaggtcttcacttctatatataacacgatcaaacaggttttcaaatatgtgattgcatacacgactcatgtaccatcatttgccgacacatggggttgggttatggcttcggaccaaccactatcgatttgcgctaatgaaatggacagaagaatcgaagcaagaatagatggggaacttctatatctaaatggtgcttggttccattcatctacaaccatgaataaaactgtttaccaatcgctgcaaaatgaaactcacgtgtacacggaagaaagtgctagatttattcctggacatggcatggcttttcatctctaa

SEQ ID NO: 39680 - DNA, 450 bp, Glycine max
  Peptide Sequence Number=SeqID_131365
atgacttcccctggacctgttttctccttctccaggactccaactatcacaactgctaaactaaagtggaaaaattacccctcatggtctgcttccgtagaactttggtttctcagtcaaggacaccatgaccacttggataaagcttccgattctgtttcaagtgacaaaagagtcgaatgggagaagcttgactatcaactgtgtgctgtgttatggcaatcagttgagccggatattttggatatccttagatcatttaaaacgtgtcgttctttttggaagaaggctcaagaaatttttgccaatgatatacaaagcttatttgatgcgaccatgaaggttacaaccctcaagcaaaccagccatgacatgattgctcatgtgggtaaggctcgggctgccgtggaagagctgagaaagtttcttgtggctgattcattagaataa

SEQ ID NO: 39681 - DNA, 213 bp, Glycine max
  Peptide Sequence Number=SeqID_131366
atggtgatggttgtgtcagtggtaatgacgacattggtgtcaatggtgagagtagtaatgacaatgataattgttagtattggtggtagtggtattagttgtggtggtgataatgatagtggtagtagtagcactagtggtgatggtggcgataatgccaatggaaatggagatggtggttgtggttgtactagtggtggtgatggtgggtag

SEQ ID NO: 39682 - DNA, 195 bp, Glycine max
  Peptide Sequence Number=SeqID_131367
atgaagagggttgggaaggataggagttgggaaagggaaggagaggaagagagggttaggaaggagaacaattggggaagagagaagaggaagggagtgccaggaaagaggggcaagagcatgggggagagggaaggttttctgctatccgctgtgagatttaatttgttatgcgaaaagtatgtgacttattaa

SEQ ID NO: 39683 - DNA, 258 bp, Glycine max
  Peptide Sequence Number=SeqID_131368
atggtgggttgcccaacatcaaatatggaatcagatagcatagacgtgtttgaacgagcatacattctcgatgacagagtcattggtgtatctgagtgtgtgactggaatgcatgtcatcatcgcagacaaccatggcattgtcgcgaacgaccatgacgccattgcactgacaatctttaatttggatttgaatggagttctatttgggagtgagagaaaaaggggctaccagagacaacatgtagccggaaaatga

SEQ ID NO: 39684 - DNA, 402 bp, Glycine max
  Peptide Sequence Number=SeqID_131369
atgttgcatgcatgcctcgatatcaaagctatcatgttaggaaaataccactatgttctctacttcctcattttggcaatgcagccaagaatgttgtggattgtggatgagaacataaagcctctatcactgtgtgtttgtgttggccaagcagtaaatgttgttggacaagcaggtcatcctaaaacaatcacgggctttcagacccactacacccctgttctcctctctgctggggacaaggcaaagctggcaacggaaaaataccttcccctgtcaccaattcttgaaggttttgtaaatttgaaggagaatccagattacacaaaataccttcccctgtcaccaattcttgaaggttttgtaaatttgaaggagaatccagattacacgaaagagtga

SEQ ID NO: 39685 - DNA, 903 bp, Glycine max
  Peptide Sequence Number=SeqID_131370
gttgcgacactttggcatcatcaaaacattcagcttgatcctttgtctacaccccgatcacattggcgtggtcggaatttccaaatgatatccctttgtaaaacccgaaatgctctcaacgctcttatgtttgcgtggaatcgacgagcaaggacgaagaagaaatctccaagtgacacaatgaggaaattgcgggtagctcacaataggtcttcttcttcttcttcttcagcagagcttgtttcctccttctttgaggatgaaccttcttcttcctgctataacatttgcaaaaattcctttagattcttagttaggatctcctttgactttgatcttgctaaaaatgctgccagatgtgacttttggttcaagaacacagaagtttctggatcagctgctttgaggaattctggatgggattggaaccagagttttacatgctctggatctgctttggatgagtcaaattgtgtccaccattttacaaatgcattggatggctccggtttgattgaggtaatctgggtttatgacccttctaaattggttttctgggtggatgacccagcctgggttggtgacccagaagaggttgatgatttcttagtggttggctctggaagagccagtcttgatcctttgcctgtacttcatcctccccttagggagattcctgatgccttaggaggcattaccacttttctcgacgaggcgggttgttacacatcaggccgcgggcgcaccaccaccaccttggcaggtctattcgactggaccactgagcttcgagcggggcagggttttgccccttttgtatgccctaccctggagcagtttagggctgaggtcgcttggcccgaagactggcccgatgcccagacaggggaggagcctgcataa

SEQ ID NO: 39686 - DNA, 327 bp, Glycine max
  Peptide Sequence Number=SeqID_131371
ggctacacgccctcaccttgggtactagctaccctcaccgttgagaggcctacacgtcctcgccttgagaggactacacgtcctcatatcagagggctgcacgccctcacctctagaggactacatgtcctcgccttgagagggctacacgccctcaccttgggactacacgtcctcgccttgagagggctacacgccctcaccttgggtactagttaccctcacgttgagaggactacacgtcctcgccttgagaggactacacgtcctcaccatcagagggctgcatcgccctcacctctagaggactacatgtcctcgccttga

SEQ ID NO: 39687 - DNA, 162 bp, Glycine max
  Peptide Sequence Number=SeqID_131372
atgtacccatgtcaaaaatggcacgggaattcttcccaaatgaatgaaatggctccgagaaagctttccgcaaagagatctaggaaggacgccgcggctgaagggaccagtgccgctcccgagtttgacagccatcgtttcaggagcgctgagcaccagtag

SEQ ID NO: 39688 - DNA, 412 bp, Glycine max
  Peptide Sequence Number=SeqID_131373
ggtccttttaaccaacaaggacagtggagatcacaccctggcaatcaattcaacaaggaccagggtggaccttccaataggccaattcaacaaaggcctaacatctttcagaggactactaagctggaggagactttgactcagtttatgcaggtaacaatgtcaaatcataaaagcactgagtcagcactgaaaaaccttgaggtccaagtgggacaactgcctaagcagatagctgacaagtcatccaacagttttgtggcgaatacagaaaagaatcccaaggaggaatgcaaagctgtgatgataaggagtaaaaggtttgtggaggtggaggatgaggatagtgttgtatccaagaagaaagctgctaaaaagaaaggtactgataaaaacaaagatgatgcgagag

SEQ ID NO: 39689 - DNA, 276 bp, Glycine max
  Peptide Sequence Number=SeqID_131374
atggggtgtatgctggggcaacatgacgagtccgggaaaagagagcacgccgtctactacttgagtaagaagttcacggcctgcgtcccaccgtctaagacaatacatgttgagccataccacctggctgatatccaagatggaccaggtcaagcgataaagggaagcgccttggcggattatttggctcagcagcctctcaacgactatcaacccatgcatctcgagttcctgaatgaggacatcatggccttgtttgagaaaaaagctagatga

SEQ ID NO: 39690 - DNA, 231 bp, Glycine max
  Peptide Sequence Number=SeqID_131375
atgggatggatcatggatatacttacggagttgagacacatgaaagacattgtgaagattacaaagagacggaggtatgggttttcaggatttcaaagctcgaccaaccctagtccaaggagtgactctcaagaatacatgatcaccaacctcgaattccagatctttcctcctcttatcaagataacttttctgcctgctctgagcagtcctcatcctttcttggattaa

SEQ ID NO: 39691 - DNA, 283 bp, Glycine max
  Peptide Sequence Number=SeqID_131376
atgactaggggcaatccaggtgatttacaaccctttgatccggaaatagatagaacctttcatagattagttaggcatagtgtgcatcctgatcattctgtgcattttgagcattctgagtattctgttgctagtgattctgaatattttgattttgagcattcaactactaattttcatactgagaacatggctcaacctccacctcatgagaggaatcttagggagatggttgcacctgatttcacttatgaaagtttgtgcattcaatatcctgatgagg

SEQ ID NO: 39692 - DNA, 315 bp, Glycine max
  Peptide Sequence Number=SeqID_131377
atggtagcctggcctgggacccaaccttctcttcatagggaaggtgaaggtcctacagcccaggtaagacaggtagctgctgccactcctgagagatctattgaggccacttcaaagcctcttgcaccagtggtggacctaccctcatctcaacatacaacagacccctccactcctatcctagagataccagaggacccgactacaccagtcctaactatggacacttctcctccagctactccagtacttcatctgacagatgaggaggatgttcaaacacaggatactcaggaccagtcacaagaattctaa

SEQ ID NO: 39693 - DNA, 483 bp, Glycine max
  Peptide Sequence Number=SeqID_131378
atgtgttcggtacaagattctttggacgagcaggcgtcacagggatcgttcgtcccccatggacgttgggatatcctgactgctgccattgggcgaccagagcaccctggtcgtgttcgtgctgttggagtcggtgtcaccataaaacaatactttggatcggcttcacgaacatcccgcagttcttcctccatgccacctgaagacctagaacagctgacccaacaaatcagagaccaactggaggagtcaatcacagaaaaagtgactcgaaagatgatggcatccttcagccagatgcagtcccagtttcagtcccagatgcaatcacatggacttgcactacctccagagccagaggttggtccctcaggtcctcgtgtcagcacaaaggagagttgtgtcgctccctcatggaatgatccatggacgggtgactcagacaaatgcgggctatacattgaagaaaatccttcccggctg

SEQ ID NO: 39694 - DNA, 522 bp, Glycine max
  Peptide Sequence Number=SeqID_131379
gattatgataccgctctggccgatgcccagcaggctaacgccgccgtggtggccgccaaagcggccgtcgaaaccgcacgtattaatctggcctataccaaagtgacctcccctatcagcggtcgtattggtaaatcttccgtcacggaaggggcgctggaagggactctggagttctccgatgtgacggtcgaccagactaccggttccatcaccttacgggcgattttcccgaaccctgacaaaaatctgctgccagagggtgtgacccgtacgccacgtggcgatgcgagcgcgctggttgtcggggcggatgacaaagtcgaaatgcgcaacattaccgccactcaggcgattggcgataaatggctggtgacggaaggtctgaaagatggcgatcgcgtgattgttactggtttgcaaaaagttcgtcctggtgcgcaggtcaaagcacaggaagtgaaatctgacgataaacaatctgcttcggccgctgaccagtcagaacaaaccaagtcttaa

SEQ ID NO: 39695 - DNA, 186 bp, Glycine max
  Peptide Sequence Number=SeqID_131380
atgatgctttattggcatagagttacaggttgtaccatctgtgctgaggctcatgaaacaggccaatgtgttcccattgaagaaaacactcaagaagttcactatatgggaaatcaacagagacaaggatatactcaaggaggattttcaggcttccagcagggtccttataaccaacaaggatag

SEQ ID NO: 39696 - DNA, 192 bp, Glycine max
  Peptide Sequence Number=SeqID_131381
ggaggaagaggaggagaaggaggaggaggaggaggaggaggaggagaaggaggaggaggaggaggaggaggagtggaggcagaaatacacatgtacatggcatccttaggacttcatccagctgatgtttgtcgccaatttcatcatccaccacccttaccttctctgccttctcatgtttattgttgttaa

SEQ ID NO: 39697 - DNA, 450 bp, Glycine max
  Peptide Sequence Number=SeqID_131382
atgattatgaggggcgaagacatttatagtagccaagatgaagctactacttcacctttctctagtgaacttgaagaagcaaaaggggaagaatctagtgaagaaatctacccccaagaagaaggacaaccattaattgttaaggaggagtgtaaggaggtaagtgtctcctccaagaggttagctaagaaggaaagtcattttacaataaagacaaacactaaagaaacttcccctcttagacaacctccacattttctcctttgtaaaaagacacttgttagcattgccacacctcttgggcttgaggttattcctcaagtaaaggagttgttggatgagggtgtcgagggaaggagcccagagtatgaagaacctcgggatttgaggtcaaatcctttccaaggtgacggggatgatgcaatcctaccccccaagggtattggatag

SEQ ID NO: 39698 - DNA, 974 bp, Glycine max
  Peptide Sequence Number=SeqID_131383
ccgcgattgatgctttcctcgcatatcaccatagcaaggagagtctagtggtggctatcttgacagatttgtttgacacatttgaccggagcgcaatcaattggtttcctcgatggaaggaaggcaaggagggagtccttttctcatgtggggactaccctaatgttccgttgttagggacaaggggttgcattaactataatcccgcacttgccataagacagttagggtaccccatgagggatctaggcgcgcaaagtctcaaggttatacaaagagtccacaaggcatggagaagttcgttgaggaaagacaaggagcttaggggcatccgtaatggcgtcatcggtggttatcatggatggctaagagttcacacgcgagggttagattgtctctccaagttgaaagttatcgatgaggaaaacttcgaagctccggaggaagatgaagaagagaagttcaaatcagccgctacacacatccggaaagagtgcaccaagttacaagaggaaaacgcggccattgcaagagcccttgaacaagaaaccaaaagggcccgcaaggaggaacatggccaagagaaattccgaggagcattgtggggtagcaacaatgagctcaagctccgaagagaggaaagagaccggtcacgggtgcatggcatgatcttaaaagaagagttagctgcttgcacaaggtccaagaggagtttggctcaacacttggaagctacggagcaaagcatgctagctatcatagggcagtacaaggaagagttgaaccagtctgtgacccatgaacaaaagctagcggaggattttgcacaagtgtacgccgaaaaagaagcaagagggagggtgattgatgcattgcatcaagaagcgactatgtggatggataggttcgccttgaccttgaatggaagtcaagacctcccgcgtctattagccaaagcaaaagccatggccgaa

SEQ ID NO: 39699 - DNA, 213 bp, Glycine max
  Peptide Sequence Number=SeqID_131384
atggcacgcagcgtgtctgcttcgtgcccctattcaagggacctatatgggagggagctaacaaggcttttagtgataattcccaaggtggtcatatctcacttgatggtctctagaggtatcatccccttcaaagaacatattgcaacagtagggactactagcaacaatatgtcatcgaagagaaaaactctagatgagggttcactataa

SEQ ID NO: 39700 - DNA, 519 bp, Glycine max
  Peptide Sequence Number=SeqID_131385
agggtacatctacttggggattctaagtaggaaagaagctgaagtccctaaggaaagtgaagaagtgaaagctttgaaagcggagcttgaaaaaacaagagtggtcaaggagaagctaaagatgacagtcactagggtcaggaaagagtgtgatgtgctgagagacgtcaaaatgactatggtcaaagccttagagcgggcaactaaaagggcccgaaaggaagaatggagcaggaacaagttccgaggggctttatggggcagcagtaacgagcttaagcttagaagggctgagagggatgagtcaagattggaaagcatggtgttagaagataagttgaaggcttgtcaaagggcgaagagaagcaaaggctggaggatgaacgaacatgcgaaggtatcgactctgcaaatggaaggggaagcaaaagagagggtgatagaatcattgcacagggaagctatgaaatggatggataggttcgctctaactctaaatgggaatcaagagcttccagg

SEQ ID NO: 39701 - DNA, 222 bp, Glycine max
  Peptide Sequence Number=SeqID_131386
atgtcacgaaatcttacggattacgcaaccgtcccctctttggcttctggaatgttacggaactttacggattgcacattaacgcttcctttcgactcccgacatgttgcggaacttcacggattgcctaacgatgggtgtcaagcgaaggtcgcgtcccaccaaacagatggtccccggacgaaattagggtatgacaggatcgtttcaagaaattcttag

SEQ ID NO: 39702 - DNA, 459 bp, Glycine max
  Peptide Sequence Number=SeqID_131387
atgcacacaattgaatttcaaaaaagaggatttcctcatgtgcatttattgctattcttacacccagataataaatatccatcttcagatgacattgaccacataatatcagcagaaattccttcgcatgaaaatgaccctgaactctatacattagtccaaaatcatatgaaaggttatgacagagtcactgctgttgttattcatgatgctaatggtacacttgagaatgctatcaatcaaaatgatgagattaaagaatatgtggattgcagatatatttctccatgtgaagctacttggagaatttttggttttccaatacatgctagaaagcctgttgtggagagattacattttcatctgccaggacaacacagtgttctttatgaagatgatgatgatatagatgatatcctgtcaaagccaagtatttcagattcaaaattcttagcctga

SEQ ID NO: 39703 - DNA, 963 bp, Glycine max
  Peptide Sequence Number=SeqID_131388
atgattcatgttgttgcacagactccaaacacacttcctacaactgaagaccaaccaaatcctacctttgtaagggagtcaattcctactacccctgttagagatgcttcaccttcagcaccagatgattctcttacacctgagtacccaacaaatccaaattatgaacatattgttaatgaaaggcctttcattcgtgcatataaaggagagtttcaaccaacatatgggtgttgtaatatcatatcaaatattattaaggcaaaatttgatgaactagctccaagttggttgaatgtgtcagttgaccttcgcgataggtggtttggagagtttaagaaagagtataggtggcacccacaagaagagcgagccattagagctgtttttgagacaaaagcaaccttggacgaacattggggttctacagatttcctaaacaatagctccactgccaaggcgaatcgatctattgatagaggagcctcagcatactatggtggttccatatctactgcaactcactttgaaaagctggagaaatatcaacattatcgagatgaaatcttacaacgttcaacagaggaaggcacatctacacagggttcccctaacactactacttttgttaatgataatgaaatatatttgaatgttgttggaggtccaaattacaaggggaacgtgtacggcctaggtactttgagcaaaaggtttagttgctcaaaatcagctccatctacttctattgctcctgtggaagaccaaatagaggaaatgcgtgagacaattaataaattgaatgctgagtttttggcaaaggcaaataaggagaagacacttgaggaaaaagatcctatcataccagctcctagtctatcacctaccatagcagatggaacagaccaccatgttaatgatactcaggttgatcgtccttatgacatggaaaatgatcattga

SEQ ID NO: 39704 - DNA, 267 bp, Glycine max
  Peptide Sequence Number=SeqID_131389
atggatcatgctgaaccatcaattgaccaatacatagaacaacagggtgtaattgagacagaatgcatgaaggagaatcctaatcctgaagctcaaaagttctttgatatgcttgcaactgctcaaacaccatttgatcggtacttgacggttaataggagaggaattgaaaagaagtttcctattaaaaaaatgtggtactttccactcattccaagactaaaaagattgtactcttcaatggccactgcatctcacatgagatga

SEQ ID NO: 39705 - DNA, 606 bp, Glycine max
  Peptide Sequence Number=SeqID_131390
atgaactcgctaggcgagcatgctgcactaagtgagttcatcagttctcattgtatagaggcgttctctgaagaactcgctaagcgtgcctaccgcgctaagcgagttcatcctttgaggatgaatactcatcctcttgctgaactacctttggtgcctctaagcgtagcctttaaggagcttagcgcatatccttgcgagaagaaagtagagatatatcattctgagctagatgagtttaaggctgaattagagaggcgtaatttccataaacacctcaccaatttagtcgatgggggcatagacctagctttggtgaaagaattctatgcaaatttatacagttctgaggatcatccaccaaagcagtctagagtcagaggtcatttggtgaagattgatgctgacagtctcaacatattcttggagacacctgtggtattagctgagggggagaccttacccgcttacaccagatactgtaggttgcctccagactatagagagatagaggctgccttatgcatacctagccaagggttcatcttgaactcaaagggccatcctgggaagattcttaggaaggatctgactacactagctcag

SEQ ID NO: 39706 - DNA, 385 bp, Glycine max
  Peptide Sequence Number=SeqID_131391
atggcagaaacatcaaagaagagaaagggttcatcctctacaaccaccattgcaggacaacgccatcacggcacatccggtgacccaccggcaccacccaatccttatttttcttctccacggtcattgaatctattttctttagatgaacaacgtcaaaggtactattccctattcttgaatcgtgtcattctcgatcataaatatctagacatagaattctttgatggggaaacctttgattgttatcagggtgttccttttgagagcactctggttgatgattggaagcatatctattctagtcatgatgcccgtaaaatggtctgtaatgaccatgctgatatgaccgacagattgcttgctggctcattcacctttgaat

SEQ ID NO: 39707 - DNA, 593 bp, Glycine max
  Peptide Sequence Number=SeqID_131392
atggcttctatgatggaggccatgctaggaatgaggaaactcatggaaaagaacgtggccaccgctgccgctgtcagttcggctgccaaagcagccaccgtgaaccatcctcccccaaatacgctaggacgaggaaggaacacactggggcacaacaacaacccccatttgggatacaaccgagcggcttacccttatggattgccgcctaattacacgccgccagtcatgcaagatgatgcgtgccatatctcttctcccgtccttgaaaggaagcctcctcgacagcccgatgaggtccacgaagatcatcaagagtatgcccaaggggatgtcgagttctaccccccgattcccgtcgagggaccgacacccaatactttgcctcagcccaacctcactgcacaaccgataatcttgtccacagaaggggtcccctcggcgaccgaagaaagaaggaaactcgatctcctcgaggagagattgagggctgttgaaggctttggtgattatccgtcagcggacatgacagatctttgcttggtaccagatgttgttatccccccaaaattcaaagtaccggacttcgacaa

SEQ ID NO: 39708 - DNA, 870 bp, Glycine max
  Peptide Sequence Number=SeqID_131393
atgaccggcccggcggaaacctttgtgctggcgggcgatgcgtttcgcctgcattacattggcccgcaacctgaggtccaaacgtcgattggtctcgcaatgagcggcattcagcccttaccggaatggctcccggcggggagcctgctggtcctgcccggcgtgagcgactcccgcactcagttttcgacaccgcaggcgttgcagatccagcactggctgatgcgcctgcagccagccattcagcgtcgggatatcacggtgatgtgcgtctgttcgggggcattgctggcggcgaaatccgggttgctgaatcaccggcagtgcaccacacatcatgatgtgattagccgtttgcgtaccgcggctccctcggcggtgattaaagaaaaccggatatttgtgcaggatgagaatatctggaccagtgcaggcatcacttcaggtatcgatctggcgctgcatatgattaaccgcctgtgtggccccgaaaaggcgctggccgtggcgcgtgagatggtggtctggttccgccggtcgggagacgatccgcagctttctccgtggctacgctaccgcaatcatcttcacccggctatccaccgtgcccaggatgcgctgaccgccgaaccacaaaaagcctggagcgtcccggatatcgccgcgctggcgcacgtcagtccccgccatttaacccgtctgtttcagacgcatttaggcattagcgttcgcgattacctggagcagctgcgtctggcagtggccgagcagtggttattgcaggggcgtggcgtggagcaggcttccctggcggcagggttttcttccccgcgccagtttcatcgcgcccgactgcgcactgttaactga

SEQ ID NO: 39709 - DNA, 372 bp, Glycine max
  Peptide Sequence Number=SeqID_131394
accacctggtgctgagagaccagtggtccacgttgatcctggtaccggcaaggctgacggtccccacaagaagaaattaagaacatattctgggattgtggcgcgtgataaggcggaatttgaaatcccagaggcttctgacagtaggacgaaaaagaagttgcttcagactgacggtgtggacgacactgtctgtgagaaatacgacataagcaaggaaaaatgggcccagttctgccagactcgcagagacccttcatgggaggatgtgtggaaaaaggcacaggccatccagaaacagaacactgccccccacgttttgtctcgtgggggttatgaatatttggagcagaagctcctggctgagaagac

SEQ ID NO: 39710 - DNA, 110 bp, Glycine max
  Peptide Sequence Number=SeqID_131395
gggaaaaaagggaggtggttgccgcccagctcgcccatgcgagctgggttgcttccaccagatggcaccaccttttgttggaacatcctggaaggcccaagtgggtctga

SEQ ID NO: 39711 - DNA, 699 bp, Glycine max
  Peptide Sequence Number=SeqID_131396
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggggcgaattggagctccaccgcggtggcggccgctctagaactagtggatcccccgggctgcaggaattcgatgttctcgttgagctcatcttaggacacctgcgttatcttttaacagatgtgccgccccagccaaactccccacctgacaatgtcttccgcccggatcgaccgcccgaagccgtccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaa

SEQ ID NO: 39712 - DNA, 318 bp, Glycine max
  Peptide Sequence Number=SeqID_131397
atggtgaaagttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgttcacgctgcgcgtaaccaccacacccgcccgcgcttaatgcgccgctacagggcgcgtcccattcgccattcaggctgcgcaactgttgggaagggcgatcggtccgggcctcttcgctattacgccagctggcgaaagggggatgtgctgcaaggcgattaa

SEQ ID NO: 39713 - DNA, 522 bp, Glycine max
  Peptide Sequence Number=SeqID_131398
atgggtgatcaagaggagacacaggaacagatgaaagccgacatgtcggctctgaaagaacagatggcttccatgatggaggccatgttaggaatgaggcagctcatggagaaaaacgtggccaccgctgccgctgtcagttcggctgccgaagcagacccaactctctcggcaaccgcgcaccatcctccctcaaacatagtaggacggggaagggacacactggggcacgatggcaaccctcatctgggatacaaccgagcggcttacccttatggattgtcgcccaactactcaccacctgttctgcaagacgatgcgggccatattgcttctcccgtccttgaaagagagcctccccaacagcccgatgaggtccacgaagaccctcaagactatgctcgcagggatgtcgagttctatcccccatccccgaagggccggcacccagcacgttgctcagcccaacatcacgacacaaccaatagttttgtccacggaaggaccgcccccggcaactga

SEQ ID NO: 39714 - DNA, 699 bp, Glycine max
  Peptide Sequence Number=SeqID_131399
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgattgccgctggcgattcagtggtgcttttgcatgtctttccgggttggactcaagacgatagttaccggataaggcgcagcggtcggactgaacggggggttcgtgcatacagtccagcttggagcgaactgcctacccggaactga

SEQ ID NO: 39715 - DNA, 741 bp, Glycine max
  Peptide Sequence Number=SeqID_131400
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgttctggacattcgccagaccgcgcagcaggaactgacggaagcccatcaccgacttgatgattccgaataccggttccaccgtctgcttgcgctgcccataggatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgagaaaaaaggctgcaccggtgcgtcagcagaatatgtgatacaggatatattccgcttcctcgctcactga

SEQ ID NO: 39716 - DNA, 450 bp, Glycine max
  Peptide Sequence Number=SeqID_131401
atggcatctgagctacttggtatgtcccagcaaggacaaactattccacatactggcctctctggtagtgttgtatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgtaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccagcccgtcagtag

SEQ ID NO: 39717 - DNA, 97 bp, Glycine max
  Peptide Sequence Number=SeqID_131402
atggcaaatgctaagcacatggctacaccaatgagcactgcttgctatttacatcacgatgaaaccggtcattcaatagatgttaagcaatatcaag

SEQ ID NO: 39718 - DNA, 153 bp, Glycine max
  Peptide Sequence Number=SeqID_131403
atgccaatctccccctgcagatggatcgcgcccacaagacacctcagtggacccgaagaagtccaacagggacctgaggttaccagctctggttacgggcctctgtcagtcctacagggtgaccgttcccctagcgaggtcatgccatcgtga

SEQ ID NO: 39719 - DNA, 603 bp, Glycine max
  Peptide Sequence Number=SeqID_131404
atggctaagtttgaccctgaggtagtcctggagttttatgctaatgcttggcccacagaggagggagtgcgagacatgcgttcatgggtgaggggtcagtggattccttttgacgtagatgccctcagccagttcctaggtgacccgctagtgttggaggaaggccaggagtgcgagttcagccagaggaggaacatggccaatgggttcgacgaggaggccattgctcagctgttatgcacaccggggcaggatttcgcccggaacgctgcagggaggcaagtgtggatcatgcgcaccagcatcaccaccttgacccagacgtggatgacattgatgcctagcaatgtcttgcctagcgatcataactccgatctccctctgccaaagtgtcagttgatgtatgccatcttgacacggatgagcgtccatgtggcccaggtgattgctgacaacatctacttgtttgcaggtatgccacccacaaggcaccccttagacccggataagtctaacagggccctagggtttccggcattgatcatgaccatttcaatttctcgagagcttctgttgttcaatttcgagagtctcaatatgtaa

SEQ ID NO: 39720 - DNA, 756 bp, Glycine max
  Peptide Sequence Number=SeqID_131405
atggctacctcaccaaaagaaatttccgcttctggttcacccgctgtaccatcatctccgcaccaggaacaaccagaattcaacatccaacccatacaagtaattcctggtcaagcttctgtccctgagaaactggttcccagaagacaacagggagtgaagattgatgaaaaccctagccctgcaacaattcctagggaagtagacacggagatggacaagaaaatccgcggtattgtgagtagcattctgaaggatgcttctgtgcctgatgctgagaaagatgttccaacatcttccaccccagatgtttctgtgcctgatgtcaataaagatgttccaacatcctccgctccaaatgctgaagccctcccttcacccagtgaagaggaatcaacagaagaagaggatcaagcctcagaggagacccctgcaccaagggcaccagaacctgctccaggtaacctcattgacttggaagaagtcgaatctgatgaagaacccattgccaacaggttggcacctggcattgcagaaaggttacaaagccgaaagggaaaaactcccattaagaggtctggaagaatcaagactatggcccagaagaagagtgctccaatcactcctgccacatccagaagaagcaaggttgctatcccctccatgaaaaggaaagaaatttcctcatccgatactgatgatgatgtcgaactagatgtctcgacatctaagagggccaagacttcagggagaaag

SEQ ID NO: 39721 - DNA, 94 bp, Glycine max
  Peptide Sequence Number=SeqID_131406
atgggggttcaaatagcaaccaggcccacctgggccttccaggatgttcctccagaacgcgctgcttctggaggaagcaacctacctcgcctgg

SEQ ID NO: 39722 - DNA, 351 bp, Glycine max
  Peptide Sequence Number=SeqID_131407
atgacattgctacttagcaacattctgcccagcgagcgcattgccaatctccccctgcaaaagtatcagttggtctgtgtcgtcccgacgtggaaacgaaatgctaacatccaggatctcatttatggttatgggggatcccatcagcagactctccttccctgtggagaaaacaccgagactttttcaagtctcacaagttatccagaactacgtaggtctgagttcctcattggaggatacgtaggagcaagagcctcgcttttgtcgaccacaccgccttttgttgccatgacccaagagctggtagcccgcggagacaccttacggttatccgcatctcgagtgtga

SEQ ID NO: 39723 - DNA, 470 bp, Glycine max
  Peptide Sequence Number=SeqID_131408
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtatccccctggcggctccctcgtgcgctctcctgttcctgcctttcggtttaccgttcgctccaagctggactgtatgcacgaaccccccgttcagtccgaccgctgcgccttatccg

SEQ ID NO: 39724 - DNA, 621 bp, Glycine max
  Peptide Sequence Number=SeqID_131409
atgagtatcacatcctccaccgcttcaaccagaatcagatatccaattgaaagaccacctgcaatcatccaattcagagcagctttgcacaatgaccagacattcatagaaatacccccattctaccatgaacaatgggcaccaaattacccacaagaggtgcggttcaaatacaatggagcaacctacccaatacgagtccaacaacaccgaggcagatatttttttgcagatggactcgcagacttcaaagcagatttaaaaatctacgagtctatcatcatcaacttctttgcctgcgatgataacaccattttttatctacattttacacctcccctgaatcaacagacatgtggcagaccaatacttcattcccgtcaacatatctggacaacagaaataacccaatgtatactgggtgctccccaaccactggaaatctcatcacatgcaaggaaatatctgaaagaatgtgacaatcacttgacaattttaaggaagaatgcacctcctctgcaatgggacgtggttacgctcgaccacgacattaaagataaaagtatcttccggtcatggtataagtttctcaaggaaaatgacttccatcatggagacgag

SEQ ID NO: 39725 - DNA, 540 bp, Glycine max
  Peptide Sequence Number=SeqID_131410
atggacatcctgacacttttgatcttcggggtggtcctctttccaaatgtggatgggttggtggaccgggcagcgattgatgcttttctctcctttcacgattgcaaggaaaacgcatttgtcgctatcttagccaatctatatgacaccttcgaacgaagatgtgagaagaacagtgcaaggatcgtttgctgtacaccggccctctacgtatggttggtttcacaccttttccgccaagaggtgagacatgcttgcccgctagaaggccaccgctcatgcacagagaaaaaagaggcaaattgggaccaactattagcaaacaaagaaggagcgtctgtcaattggttcccccgatggaaagaaggaagaaccgagattcttatttcgtgcggaggatttccaaatgttcccttgatggggacaaggggttgcattaattacaatcccatcctcgccataagacaacttggctaccctatgagaggggcaccattagaggaaggcctcacatctgttattgcgcgaggtttcaaatag

SEQ ID NO: 39726 - DNA, 244 bp, Glycine max
  Peptide Sequence Number=SeqID_131411
atgcttttgagcctccctcctccagtttacgttgatgatacaccatggtcatccacctccatgctaggtggttgttgcataggttcattattaggatcatcagctataccagtagaactttctactggagtcgagaggtgtgaagacagcggagtaggatggtctgaagactgtggagttggttggtgtgaagacagcggagtaggatggtctgaagactgtggagttggttggtgtgaactag

SEQ ID NO: 39727 - DNA, 324 bp, Glycine max
  Peptide Sequence Number=SeqID_131412
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggcgcgtcccattcgccattcaggctgcgcaactgttgggaagggcgatcggtgcgggcctcttcgctattacgccagctggcgaaagggggatgtgctgcaaggcgattaagttgggtaacgccaggttttcccagtcacgacgttgtaaacgacggccagtga

SEQ ID NO: 39728 - DNA, 357 bp, Glycine max
  Peptide Sequence Number=SeqID_131413
tccatgatgattggatgtggaattacctggatgttgtggaagcttgggaggattgatggggacccggcgttgagaggaacgaggataagggctacgtgggagtacgtgagctcagttggaggtgggcaacaggggatggtgggttatacgtcatttgtggatgtggagaatcgttttgcaccatcgcccgaccgccacctagtacctcatgtgatggtggtacctggagatatatcgcgggggtcaggagaccttggggacgtcaggcgagctcctggcagtcaacagataaaaggaacaaagaccacaaagcaaggaggcttgtgtggtggctggccagctgtgaactttgattga

SEQ ID NO: 39729 - DNA, 159 bp, Glycine max
  Peptide Sequence Number=SeqID_131414
gggcaggatcatcttaagctaccttctgggttggggacaaaacatggacagcagaaaccaatcaaggaacggatgcaagtggggatggagtcacgaccgactgatcgttgccctttctctgcgctaaacaagcagaggacgttgctgcaaggcagcccc

SEQ ID NO: 39730 - DNA, 63 bp, Glycine max
  Peptide Sequence Number=SeqID_131415
atgaatcgctttatttggacgatggagaccttatccggtctacagcaagctgccacagcgtag

SEQ ID NO: 39731 - DNA, 181 bp, Glycine max
  Peptide Sequence Number=SeqID_131416
gcagaaaggaatagaggtggatctagaaaaggtaaaagcaatcctcgaaatacccgagccatgtaccgagaaacagcacaatgaatccagaaatagggaacgggccatctactacttgagcaagaagttcacagcatgcgagatgaactactcgttgctagagagcacatgttgtgcctag

SEQ ID NO: 39732 - DNA, 258 bp, Glycine max
  Peptide Sequence Number=SeqID_131417
atggcaatccaaggagaggatagtgaagctggaaagaagatggaggaacataagcaacagctggcacctaagccagcacctaaacctatttctgatgttgtagaacttgaagagattaatgaggagactgaagatgacaaggaggagaagacaccaataaaagtggaagaaaaagaaagaataaaggaagaagaaaaagaaaaagaaaaagaaaaaaagtccaaaaatgaaaaacaaaaagagaaagttgttgattga

SEQ ID NO: 39733 - DNA, 165 bp, Glycine max
  Peptide Sequence Number=SeqID_131418
agacttcaggatgttctgactgctaccattgggcgatcagaataccctggtcgtgtgcgtgctactggagtcgatgtgaccatcaagcaatactttggatcggctccatggacctcccacacttcttcctccatggctcccaaagaactagagcagctgacttaa

SEQ ID NO: 39734 - DNA, 429 bp, Glycine max
  Peptide Sequence Number=SeqID_131419
atgtggtatcatgtcactctcactaagtacaatcataaggtgaccagtcagggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 39735 - DNA, 486 bp, Glycine max
  Peptide Sequence Number=SeqID_131420
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatcccccctccaaggctttcaacttgcatagcccccatcaagtccatgtgaagttagttccagcacccttggaaagtggtctgatgttgaagcttctggtgggacatcttgacttgctttccaatctgacattcaccacagattctgccttcttctattttcagattgggaatgcctctaacagcacctttggtcaatga

SEQ ID NO: 39736 - DNA, 984 bp, Glycine max
  Peptide Sequence Number=SeqID_131421
atgaaaagagaaaaacatgcctcctatagtagtcataactcttgcaagagcctaagtgaagaacttcgtgactattatgaaggaaggcataggtcacatcttagacctcactcccatagaagagaaaaggaaagaaagcctcaagaggctaacattaacctcccatacttccatgggaaggacaatgtagaggctaacttagtttgggaaataagggtagagcaacaacttaaaaagaagtctacatcaaaattttatggctctcactcttatccaaagaaagaccaaggtcaaggcatcttaggggtgacaccttctaagcccaaaggtgataaggggaagacaatagaaaaccaagcccctaaggctagtgtgcaagagaagactagctctataaagtgctttaaatgtcttggaagaagacacattacttctcaatgccccaccacaaaaaccatgattatgaggagccaagacatttatagtagccaagatgaggctactacgtcaccttcctctagtgaaactgaagaagcaaaaggggaagaatctagtgaagaaatctacccccaagaagaaggacaacctttaatgttaaggaggagtgtaaggagacaacctccacattttctcctttgtaaaaagacacttgttagcattgccacatctcttaggcttgagtttattcctcaagtaaaggagttgttggatgagggtttggttcgcaagagattaaatccttgtgctttgttggtgcccaaaataggtattattaggcaccaaatcccaaaaataggtggtgtgatgaatgctttgggtggtgcaacactctttcgtaaaatcactcgtgcacccaacatcttcatgatttgtgtacatagggactcgttaggtaggaataatcaacatgaaaatacacaaaaaggggttcccatgaaccctaagagaataaaggtcattcctgagtggcccgctccaccaagt

SEQ ID NO: 39737 - DNA, 340 bp, Glycine max
  Peptide Sequence Number=SeqID_131422
gccaggtatgggtggagtgacaaaagtttcacctcactacttgaggttgtgcacaatctacttccagaggacaacatgttgcctaaaagttactataaggcatgaattccaagaaatgtcaaaatgccctatctatgggacttcatggtacaaagtgaaggatgaagaggaaagcagttctgatgaaaactccaacaagggccccccagtgaagaccttacatggcatgcaaaatggaaagatttctgatggaatggtccgtcatccggctgattgctcccagtggaagaagattgatggtttgtatccggaatttcgggaaagagccaagaaatcttag

SEQ ID NO: 39738 - DNA, 312 bp, Glycine max
  Peptide Sequence Number=SeqID_131423
atggtcccgaggaagcttgcctcaaagaggtccaggaaggataaggcggccgaaggaactagttccactcctgagtatgacagtcaccgctttaggagcgctgaggaggtagggcgccagcggtggacatcactggttactcccatggccaagtttgatccagaaatagtccttgagttttatgccaatgcttggccaacagaggagggcgtgcgtgacatgaggtcctgggtaaggggtcagtggatcccgttcgatgcagatgctatcggccagctcctgggatatccgttagtgctggaagagggctag

SEQ ID NO: 39739 - DNA, 348 bp, Glycine max
  Peptide Sequence Number=SeqID_131424
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgcctattcaggctgcgcaactgttgggaagggcgatcgctgcgggcctcttcgctattacgccagctggcgaaagggggatgtgctgcaaggcgattaagttgggtaacgccagtgttttcccagtcacgacgttgtaa

SEQ ID NO: 39740 - DNA, 336 bp, Glycine max
  Peptide Sequence Number=SeqID_131425
ggtgctccagtggcttctgtttctatcagctgtccctcctgttcagctactgacggggtgttgcgtaacggcaaaagcaccgccggacatcaggcgctggcaagtgtaacggtcacgctgcgcgtaaccaccacacccaccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagtgttttcccagtcacgacgttgtaaaacgacggccagtgaattgtaa

SEQ ID NO: 39741 - DNA, 489 bp, Glycine max
  Peptide Sequence Number=SeqID_131426
atgtgggatacattgcaagtaacctatgaaggcacaactggcaatggcaaccaaaaagtaacagcaattgcagaatcaagagatctcactaatatgtctcttgccactctctttggaaaacttcaagaacatgaaatggaacttatgagactccatcaacatgaagagaatgatataaagagaaaaggaatagcactcagagcctcatcatcttttattcaagaagaaagtgacaaagaggacttgactgaaacagaagaagatgatgatgatttcagactctttgtgaaaaggttcaataaatttctgagaaacaaaagaaataaaagggaatcaaacatcaatacaaagaagaaagaagaagactcctccttagccccaacatggtatgatagtaatcaacctgggcacgtgagattcgattatcttgtctttgaaagaaaaattgaaaaatccgacaagaggaatctcaaagaaaagaaagcatag

SEQ ID NO: 39742 - DNA, 920 bp, Glycine max
  Peptide Sequence Number=SeqID_131427
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcgcccgactcagcaatcacctgctcgccagcaagcttgctcttgccatagacggaccgtggattgaccgcgtcggtttcgacatagggttcgtccttggtgccatcaaagacgtagtccgtgctgtagtgcaccagaaggctgccaagctcgcacgcttcttcagcgagtgcaccgacagcagtgccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 39743 - DNA, 450 bp, Glycine max
  Peptide Sequence Number=SeqID_131428
atggcagctgactttgtagaggagattcattctggtcacatacatcttatttgcaactgtacaatgacaaggagactttggtgggagcctttgagatgggttaatagagtgggtcctttttccacagacccaaagaaccactttttgcaattcactcaatggaacaacaaagctagtataaacaacatatggaaatttctgtggttagctctatccttcttcgtctggcatcatagaaatgctatgattttcaagaaccagccgtttgatcctgaaaagagaaggactacaccagggactacaccatccatatgtagcagttgcatgtggaggtcaacaccaggttgtctcatgaacgacaactccattagccatcttccagcggtcaatgacatggtgtgcatgcaacgggactcgagaaatttgaacaccttgcaatacatgttctag

SEQ ID NO: 39744 - DNA, 402 bp, Glycine max
  Peptide Sequence Number=SeqID_131429
aggatcccacccagtggacctgaagaaatccaacagggccctggggtttccagctctggttacgagcctctatcagtcctacagggtgcccgtacccccccggcaaggtcacgtcatcatagggatcgcgcctgcaagacacccagtggacccgaagaagtccaacagggtcttggagttgccagctctaaatatgggtctctcaaagtcatcagacccccctaccaatcgagctttcatccagaagtactgcgcccccaggcaagcgcagggcgaagcaccacagcagcattgggatggccggtagcaggcaatagacacaccgccaccacctctaaagttcacctcagctcatccataaaaaggttagagcgttgcctgcgacacatggccgaccaatag

SEQ ID NO: 39745 - DNA, 677 bp, Glycine max
  Peptide Sequence Number=SeqID_131430
aggactacacgtcctcgccaacagagggctgcacgccctcaccttaagaggactgtgtgtcctcactttcagaggactgcatgtcctcaccttcagagggctacacgccctcgccatcagaggactgcgtgtcctcaccttcagagggctacgtgtcctcaccttcagagggctacacgccctcaccatcagaggactgcatgtcctcaccttcagagggttacacgccctcgccatcagaggactgcatgtcctcaccttcgtagggctacacgccctcacctttagaggactacaggtcctcgccaacagagggctgcacgccctcaccttgagaggactacacgtcctcgccaacgtagggctacacgccctcacctttagaggactacacgtcctcgccaacagagggctgcacgccctcacctttagaggaatacacctccacgtcctcaccttgagaggactacacgtcctcgccttgagaggactacacgtcctcgccttgagaggactacatgtcctcaccatcagagggttgcacgccctcacctccagaggactacacgtcctcgccttgagaggactacatgtcctcaccatcagagggttgcacgccctcacctccagaggactacacgtcctcgccttgagagggctacccgccctcgccttgg

SEQ ID NO: 39746 - DNA, 231 bp, Glycine max
  Peptide Sequence Number=SeqID_131431
atgcatctacgtgatcaaggaagcctcctttacaacaaagagaagaacaagatgaaagattgcaaaaatacaagtggtgaagatgtctccttcacctctaggatcccacaaccactcacaaactcatctcaagctctcagaacagcttcctcttcaagctctggtctctgcagatcttcacacaacaaaatctctcaaaactctctggaacttggacctttctctctctag

SEQ ID NO: 39747 - DNA, 411 bp, Glycine max
  Peptide Sequence Number=SeqID_131432
ggctttccaatcattggaaatggctttccaatcctttgaggtggtgagctgcgcctctatggaaccaagtccgtcgctaccttctctctccaaagtggccataatggtggcgcgtgttatgctcaggaacagatttgagcccggaatgggtctaggcaaggactgcctcgggaatgccgacgtggtcgatatcaagggaaatccatgcaaatatggattagggtacgaacccgggatgccggggaggaggaacgtgccgtcaagatttcgggcggatagggtatggcccggccgtattagccagtgtttcaccagcgctggaatggtgtccgaggaggaggtggccacgatagaagaggagttccctcaagacccaccaattttgtgcaaccatgccaccccgattcccaa

SEQ ID NO: 39748 - DNA, 219 bp, Glycine max
  Peptide Sequence Number=SeqID_131433
atgtcctcgcctttagaggactacatatccttgccttcagagggctgcacgccctcgccttcagaggactacacgtcctcaccttcagagggctacacgtcttcgctttcagagggctccacatctgcgccttcagaggacttaagtcccttggtcagccccctgatcttagaggagggccaactgtgcgagcacaaccagagggaggctatcgtgtag

SEQ ID NO: 39749 - DNA, 475 bp, Glycine max
  Peptide Sequence Number=SeqID_131434
atgccggtgtatatggaaggcgaaactctggatcaaacaaggaagtgttcgaaatgggagaacgacgattacatttgtcgtggacacattctgaacggtatgtctgactctctctttgatatttatcaaatgttgagtctgctaaggaattatgggactctcttgaatccaagtatatggcagaagatgcctcaatttactcaacatgatttgaaaatggatgaatccattgcagtttcatctataattgataaactgccttcttcttggaaagacttcaagcataccttgaaacatatgaaggaagagttgactctggttcaactcggcagtcatttcatgattgaggagtcgctgagggctcaggaaattgacaaatgtgggaaacctggtcatttaaagagggattgccgggtgttcaaaggaaagaacaaggctggtccaagtgggtctaatgatcctgaaaagcaacaag

SEQ ID NO: 39750 - DNA, 309 bp, Glycine max
  Peptide Sequence Number=SeqID_131435
atggaagaggaatatgagactgctgcaagtttaggtgcaggtgctgcttctggtggaggcacttcaaatttcttgctagacctcaagccatctgccccatctgatttgtcagactctgaatggaggctcttgtctcttgttgaaattgcatattctggatggttatttgcctcactaactcttctaaggaaggttgaggaggggcctcagtcgcttgttgtctttgttgtgattgttgctgctgctgttgcattggaggaggaacatatggcttgcttggaccagcagcattctggaaaggagggatag

SEQ ID NO: 39751 - DNA, 672 bp, Glycine max
  Peptide Sequence Number=SeqID_131436
atgaccggtagattattggccgggtcattaacatttgataatcgcatcatgcactatatcattgttagaattttgcttccccggtcttcaaatttggcacaagcctctgaggaggatttgattctgatgtgggctttccttaccggtcgtcagattgactgggctcacttggttcggtaccgaatgcataaggcattacgggccaatgcacctctcccttaccctcaattgataactttgtttctgcgtcattttcaaattccgcttgatgatgaaccatttgttcaagtcaagcgttcctttgcaattggtgctggtgcagtgacttcctttggataccgtaaggatcggaatggtcaatggctaaagaaagatgcactccctcctcaagatgagcgtactccttcacctcctcctcaacgagatgactcaacactcatgaatgcagttctttccgaattacggggtcttcgttcttatgttggtgaacatttcgactcattggatacacgctttgccggcatggtgtcgcaacctacccttcggcgggagggcgacgcgagactcgcgggatgcgtgttccacgaaaggaatacgcgcggagtcaccaccaacatttatttgaggaaaacgtcgggaaaaccggaaaagacgcgatctacgaacttttaa

SEQ ID NO: 39752 - DNA, 192 bp, Glycine max
  Peptide Sequence Number=SeqID_131437
atgaggaagtgtggaagggtgagacttcctacttttattcgttggccacagagtggtacctggagatatgtcgcgggggtcaggagaccttggggacgtcaggcgagctcctggaagtcaatcgataaaagaacaaagaccacaaagcaaggaggcttgtgtggtggctggccagctgtgaatcttgagtga

SEQ ID NO: 39753 - DNA, 144 bp, Glycine max
  Peptide Sequence Number=SeqID_131438
atgggtgccaagcacctcacaaggaccaaagaaaagtcgcatgtcatcaagcaaaggtccccggacgaaattagggttaagtggtggctggacagaaatatagaaatggcaataacggaagctacagagctccaaatgaggtga

SEQ ID NO: 39754 - DNA, 267 bp, Glycine max
  Peptide Sequence Number=SeqID_131439
atgaaaagtgataaagcctcacaagatataaactctatctctcaagcttgtagtgagcttcaaaacaaggaaagggaaacaaggctcaaaagggctatcaaaggaattaattcaaggacgcatcaacaagaatcaagccaaggctattgtgcaaacaatcaatggggcaaaacacaccaaatgattataatgatggatggctcaaattctcacaaaggtaaaatcatcactttcaaattgagctttcaaaactatcatgacatgtag

SEQ ID NO: 39755 - DNA, 305 bp, Glycine max
  Peptide Sequence Number=SeqID_131440
tggtgtctcctctctctcttccttctccattatgttgccattcatcttccaagaagcaaaggaatccattgatgaagaagatcctaggcctacaagctccaacggagcttacatcagtttcctactcttatcacagctttatgcaggaccagaagagttgcctccgacagtcttaagaccaagggcaaggccagctgaggctccttctacatcaacagctcctcatctagcttttacatcaatagctcctcctccagctcgtattgcagtagctccttctaccctacctcctgcagattttcaac

SEQ ID NO: 39756 - DNA, 249 bp, Glycine max
  Peptide Sequence Number=SeqID_131441
atgcgaacatgctttagtaaagagacaaaacttccaactaatcagagcaatatatgcttttcggatgaaaaacaatctaccggggaaggagacatttcgcttctaaatgaccatttagaggaaacactgagttcaacaaaaatagaagaaaatcactcaaagtgtattaaactcacacagtgcggggcgaaaaactcgttgacacacatgattttgggttgggcaatcaaagggagaggaccactttag

SEQ ID NO: 39757 - DNA, 384 bp, Glycine max
  Peptide Sequence Number=SeqID_131442
atggtgatatgcgaggaaaagcatcaatggcatctaagtccaccaaaccgtcacgttcggaaagaggacaaccccaaaaaatcaacaaaagctaatatatccgcaaacgggccccacttctcttggctcgccatatcccttgccttgccttccaaatatttccgaggcaggcccactatgccgttgcgagtttgcttcatgcaatccaactctcttgccgaatccccgaccacagcagcaatcttgctcaaggagggaagaaacccggagaaaagatacggttttctccccccaagagggcatcctagtatctcctcaaactcttcaatagtcggtaccatttggaagtccccaaacgtgaagcacctcaacggctggtcatag

SEQ ID NO: 39758 - DNA, 655 bp, Glycine max
  Peptide Sequence Number=SeqID_131443
atgggggatcccatcagcagactctccttccctgaaaacaccgagactttgtcaagtctcacaagttatccagaactacgtaggtctgagttcctcattggaggatacgtaggagcaagagcctcgcttttgtcgaccacagcgccttttgttgccatgactcaagagctggtagcccgcggagacaccttacggttatccgcacctcgtcatttagtgaccccaagtgtgattcacgagcagagaccaatatggtcatctgcgccctttccggagatgtcagcattttccgatggagacttttcaagtctcacaagttatccagaactacagaccaagtctggtcattctgcacccttgtatcatccagaggcggcgggcccgatgatacgcggagataccttacggttatccgcacccttttgtcatccagaggcggcgggcccgatgacaagcagagaccaagtctggtcattctgcacccttgtatcatccagaggcggcgggcccgatgatacgcggagataccttacggttatccgcacctttttgtcatccagaggcggcgagcccgatgatacgcggagataccttacggttatccgcacccttttgtcatccagaggcggcgggcccgatgacaagcagagaccaa

SEQ ID NO: 39759 - DNA, 789 bp, Glycine max
  Peptide Sequence Number=SeqID_131444
atgaggcgcttggaggagagggcagaagctttggcatatcaagaagagtggacctcattcattgacatattagcattattggtgtttgggactatactctttccaaatgtagacgggctagtggacttagcagccatcgacacctttcttgcttatcatcacagcaaggaaagcccggtcatcgttgttttggccgatgcatatgacacattcgacctgagatgcaaaaagagtggcgcgaggattgtctgttgcacacccgctctatatgtgtggatggtctcccatgtgcttcgtcatgaaggtagacctgtctgtcctctacaaggtcatcacatgtgcgccaaaaagggaaaagaaaattgggaggaactcttggcaggattcccaaacgtctccttgatggaagcaaggggttgcattaattataatcccatgctggccataagacaactaggataccctatgagagctgcaccgtcggaggagactatcacacctttcgtcgcacggggtttcagtgaaggcaatgcaaaaatacttcagagaatccgtaaggcgtggaatatagtggaaagaaaagataaggagcttaggggactcaatgtcttcgatgacttcgatgtcttttgtcaagacttcaacgtcttctttacatttcaagacttcaatgtcttttgtcaagacttcaatgtcttctttacatttcaagacttcaaagtcttttgtttggtttcactgctttggttttcaccagttgccagtcagatagcaagatcacttggatga

SEQ ID NO: 39760 - DNA, 357 bp, Glycine max
  Peptide Sequence Number=SeqID_131445
atgacggagaggtacgcctggggagtggctgctttggtgcttatgtacgaccagctgaacgatgcatccatgagccacaaccgacagcttggcggttacatcacactgctgcagtactggatttacgagtactttccgtcagttggggactccattgctgatcaggactacgacgaggattctctacgtgcgtgtaggtggattgtgacgaagaagaccgttaagagcatttgtggggtgttcgttgtgccaggtcagtgttccagtgactacatggactggttcttccgcatctcgcatcctttcatgacaccaggccacgcattagatcctctgcctgatggtcacgccccgtag

SEQ ID NO: 39761 - DNA, 189 bp, Glycine max
  Peptide Sequence Number=SeqID_131446
atggggctattgctcaagcaaaggaaccaagatcacaccagaaagataatagaacatggtgacgttaagattgaaaaggtagatggaaaggagaatgcaacaaatcccttcaccaaggtgcttggcataaaagagtttgacaagcacaaatgggaattaggaatgaagttcatgaatgattggctctag

SEQ ID NO: 39762 - DNA, 648 bp, Glycine max
  Peptide Sequence Number=SeqID_131447
gttgcaggatgtaccatctgtgggggagctcatgaatctggatgttgtattcctattgaagaacacccggctggggaagttaattacatgggaaatcagcccagaaaaaattttaatgtaggaggattttctggattccaacatggccagcaatataatcaacagcagggacaatggaggaaccaccctggaaatcagttcaatagagatcaaggtggaccatccacaaggccacaacaacaagggcctaatagatcatcaagcagttttacagctaatacagagaaaaatcccaaggaggaatgtaaagttgtgatgaccagaagtagaatggcaatccaaggagatgataagattaatgaggagactgaagatgacaaggaagaagagacaccaataaaagagaaagaaaaagaaagaataaaagaagaagaaaaagaaaacaagttgaaaattgaaaaacaaaaagagaaagttgttgatgatgagatgaggaaaggcaagagtgaggcaaacattgacaaaaagaaggataatgatgcaatcctccctacgaagggactagtcactagagccatgaacaagaggctccaagaggattgggctagagctgctgaagaaggccctagggttctcatgaaccttagg

SEQ ID NO: 39763 - DNA, 327 bp, Glycine max
  Peptide Sequence Number=SeqID_131448
atgtcgcgggggttaggagaccttggggatgtcaggtggggtgctattgcccaaaaccaagcttggccaatcccgacccaacccgggcatagtcagccaggtgtttgggagaccctcgaaggcaatgagaggtgccgattccgtggcatagttcgactcactgctacttcgctagtacatcccgagcaacccgcatgcacacttcagcagcctgtggagtggatactacctacgcctaccccatatcgactagttgagcctgctcaattgatagagtgtcatcctctgatgaggatcttgaagaggacccaaggagttatctcctga

SEQ ID NO: 39764 - DNA, 141 bp, Glycine max
  Peptide Sequence Number=SeqID_131449
ggaaaactgccaggaaaccacattacaagcgaaacctcaaagagagttgggcttcgtcctcaaaaggaagcaacaccagaaaatgtagccttccatggattcaaacagaaaacgcaaatgaaacatgaagcagtaatgtaa

SEQ ID NO: 39765 - DNA, 438 bp, Glycine max
  Peptide Sequence Number=SeqID_131450
atgtcagatccacttgtgttgcatgttcatacagcaactatgccacaaccacctgcacctgcaactgttgatgcaggcatgccacaacatgcaatggggattgaagcaacgcctgatgaagcttatatcatcttcgagtcgagtgatccctgtatccatggcatcaaaacgctcacccacaaaagctcgaaggtcgcggagctctatgagtactttagtcagaagagaaaaggaatcatcccgttgtggtggaggagatggggtacgttcgtcaggaataggtggtggtggaggaagatccctttcgcttctttgatgattctgccatttgaaggtgtttcggctaattttgatcgtgatttggttaagaaatgtgagagatacgcggatttgaagattggggaaggttttgcaccgtcacacgaaagggaagaatga

SEQ ID NO: 39766 - DNA, 249 bp, Glycine max
  Peptide Sequence Number=SeqID_131451
atggctaaggaacttagcatctctatcaaacataatagtcttaggcaaaccatgaagcctcacaaattctctaaagaagagtctcgagatgtgactaacatcatctaccttatggcatggtatgaaatgtgtcatcttgctaaacctatctaccaccacaaagatagagtctatacccctctgggtcctaggaagtccatggacaaagtccatgctaatatctacccagggtgcagatggaatgggtga

SEQ ID NO: 39767 - DNA, 699 bp, Glycine max
  Peptide Sequence Number=SeqID_131452
atggccgtcgcgctgaatgcaccgctggcaatggcagcagaaaccactgcggcaccggctgacgcagcgcaggctgcgccacaggcgccgaaaaatgctgccttcaaaaacgaagaccagcagtcagcctatgcgctgggcgcctccctgggtcgctacatggacaactctctgaaggagcaggagaaactgggtatcaaactggacaaagaccagctgattgccggtgttcaggatgcgtttggcggcaagagcaagctgtctgacgaagagattgagcagacgctgcaggcgtttgaaggccgcgtgaaaggggccgctcaggcgaagatggaaaaagacgcgaaagagaatgccgacaaaggcaccgcttacgcggacaagttcgccaaagagaagggcgtgaagaaaaccgaatctggcctgctgtatcaggtagagaaagagggcagcggtgaaaccccgaaagacagcgataccgtggtggttaactacaaaggtacgctgattgacggcactgagttcgacaactcttacacgcgcggcgagccgctgtcgttccgtctggacggcgtaatcccgggctggaccgaaggtctgaagcacgtgaagaaaggcggtaagatcaagctggtgatcccaccgaacctggcttacggcaaaaacggcgtgccgggtattccggccaactccacgctg

SEQ ID NO: 39768 - DNA, 1056 bp, Glycine max
  Peptide Sequence Number=SeqID_131453
cccacgacgacagcgtgcaggtttcacgcgtgcgtgaggcgcgacgcgagctggaggacattttccagcgtgaaatgcagcatgaaaaacggcagtttgacggctgggatgatgagtaaggctacacttaacgagaaagacacgctggcgatgtggcgtgaaaacaatgtcgatgtggtggaatgcgtgaagtgcggccaccagatgcgtgaggcggacaagcaggcgcgcgatcaggttcgcagcactgagcaacttagccttacagcggtattgaattccgctacaatcggcgccattaacgctgagcagtatggtccaacagcactgttggcatcctcagtactgaacctttctggagatatcatgaaagtagcaaaagacctggtggtgagcctggcgtatcaggttcgtaccgaagacggtgtgttggttgacgagtcaccggtgagtgcgccgttggattatctgcacggtcatggttccctgatttctggtctggaaaaagcgctggaaaatcacgcggtcggcgacaagtttgacgtgcatatcccggcaaacgacgcgtacggccagtacgatgacaacctggtgcagcgtgtaccgaaagacgtgttcatgggcgttgacgagctgcaggttggcatgcgcttcctggcagaaaccgaccagggcccggtgccggtcgagatcaccgaagtggaagatgagcacgtggtggttgacggtaaccacatgctggcgggtcagaacctgaacttcaatgtggaagtggttgctatccgtgaagccacggaagaagagatcgctcacggccacgttcatggcgctgacggccatcatcatgaccacgaccacgaccatggtcacgatcatgagcacggtcatggcggctgcggcggccacgcgcgcgatattaatagtgcggcggcggggtctcttccgcttgcgaagcgaccatggacggggcggcggcctttactttatccaccagcagacgcacctgctcacgcagtttactcatttccagctcgtgctgaaccaccgtctgattga

SEQ ID NO: 39769 - DNA, 196 bp, Glycine max
  Peptide Sequence Number=SeqID_131454
atgactgtagctgagtatgcagccaagtttgaagagttggtgagacaaaaagggcattttcagagagactctccacatcccaagagggagcaaaatggtgggggcttgaatgaccaaattggacatccaaaggccactggaagagtctttacccttaacggtgctgaagcttcgaaatccaaagatctaatccaag

SEQ ID NO: 39770 - DNA, 492 bp, Glycine max
  Peptide Sequence Number=SeqID_131455
atgaccggaaggctgcttgccagttcattggctcttgaaagccgcatcctccattatctaattgtctgtatcttactccctagatcttcaaaccttgcacaggtttctgaagaagatctaatagtcatgtgggcctttcataccggccgacaaattgattgggcacatctagtccgatctttcttgatcggtgctgctgtggttgcctcctttggttaccgcaaaaagcgtgatggctcttgggtaaaaaagggtgctcaactaaatgatgatgaaggacacttatcggttgaaaaggactcttctctccttcagagtattttggacaggtttgatggacttcaaacctatgttggtgagaggtttaactccttggaacgtcaagtggacacacgattcgaggagatgaacttagggattgcaaaggttgaagaagatgtcaccatcattcgcgactgctttgatttacctccaccgctaccatcagtttag

SEQ ID NO: 39771 - DNA, 186 bp, Glycine max
  Peptide Sequence Number=SeqID_131456
atggtgtcgcaacctacccttcggcaggagggcaacgcggggctcacgggtgcgtctttcaagaaaggaaaatgcgcggaatcgccaccaaggttgattcgaggaaaacgtcagaaaaaccggaaagggtgtttccctcgctcttacgtattcctcaattgtgatgaggaaatcagaccaacgtag

SEQ ID NO: 39772 - DNA, 393 bp, Glycine max
  Peptide Sequence Number=SeqID_131457
atgaggagaatgataagaaaaagaaaggaattgctcttaaagattaatcatcaacccaagaagaaacctggacatctgagggttgattgcccaatattcaagaaaagaatagagaaatctaaaaagaaagtctttaatgaaaagaagactaagaaggcctacattacatgggatgacaatgatatggacttatctgaagattcagaaaacgaagttgtaaacctgagtctgatggccaagaattatgaaagcgatgaagaggattccttgaagaagagttggtacatagatagcggatgctctaaacatatgacgggagatgcatcgaaattcactcatatttctcccaagaaaagcggacatatgacttatggcaacaataataaaggttga

SEQ ID NO: 39773 - DNA, 863 bp, Glycine max
  Peptide Sequence Number=SeqID_131458
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 39774 - DNA, 420 bp, Glycine max
  Peptide Sequence Number=SeqID_131459
atggggtggttggagtaccaaggaaatgtttggaagcaaaagcaagagtcttggcaggcagcgattgtcacttttctcgcctttcatgaccgcaaggaaagcccggttgtcgctatcttagccgatctatatgacaccttcgaccgaagatgtgaaaagaacagtacaaggattgttttttgtactctgaccctctacgtatggttaccttttccgccaagaggtgagacatgcttgcacgctagaaggccaccgctcatgcacagagaaaaaagaggcaagttgggaccaactcttagcaaggaaagaaggagtgtctgtcaactggttccctcaatggaaagaaggaagaaccgggtttcttatttcgtgcggaggatttccaaatgttcccttgatggggacaaggggttgcattaa

SEQ ID NO: 39775 - DNA, 240 bp, Glycine max
  Peptide Sequence Number=SeqID_131460
atggataactgtggtaattctagagctaatacatgccatctcgctgacgctgtgccattcaagtttctgacctatcagctatcgacggtagggtattggcctaccgtggcattgacgggtaacggagaattagggttcgattccggagagggagcccgagaaacggctaccacatctaaggaaggcagcaggcgcgcaaattacccaatcctgacacagggaggtagtgacaagaaataa

SEQ ID NO: 39776 - DNA, 243 bp, Glycine max
  Peptide Sequence Number=SeqID_131461
atggtggtggtttccctccacgagctctacgttctcctgcacctcttcctaggtggtgtcattgcgacagatgaagacagagtcatcattgccgctgaaggcaacatcattgtcagggaggatcttgttgacatcccaggtttcacactcccagaggacctttcagaaaactgcattgtgcaccccgatggtggatttgtgatgaagggtttggaatggtgttggggtggttggggatgttga

SEQ ID NO: 39777 - DNA, 435 bp, Glycine max
  Peptide Sequence Number=SeqID_131462
atggggacgaggggttgcatcagctacaatcccattcttgctataagacaacttggctaccctatgagaggggcgccattagaggatgagcttgcgcctgtcatttcacgaggcttcaataagaccaacgtggagacacttcagaaggtccacaaggcatgggaggtgttgcaaaagaaggaaaaggaactcggaggcagtaacaatgggaccatcggtggctaccaggaagacgaagaggtgcaggcccttagggcagaactcgagcaagcccaaacaatcaatgaaaggttcaaatcagcagctcttaagatccgaaaggagaatgccgaactaagagatataaatatagctaccaccaaggctttggaacaagagaccaagagggctcgtagggaagagcacggccggaacaagttccgaggggctctgtga

SEQ ID NO: 39778 - DNA, 321 bp, Glycine max
  Peptide Sequence Number=SeqID_131463
atgtatcctctcttgttctcagttacaacaacccaagtagatgtaccctctacttgtaccacaaaggatgtaccctccaatgtgttaagacaacgttctcaggcgggaaagggaagaatcaaaagaattctcagactgtgtcgctttgaattctttgaaaagagagaacggacacacaaaagaattcaggcgaacaaggtttggaaaccagaaaacttagaaaacttttggcaaaggaagaagaagaagaagttcaagaagacgttcaaaaatacacttgtaatcgattaccaatacattgtaatcgattatgccatttaa

SEQ ID NO: 39779 - DNA, 276 bp, Glycine max
  Peptide Sequence Number=SeqID_131464
atggctaagtgtccagcttccggcaagtgcattggatcgcccaaagagtgtcgcaacgtgcacttcgcgggcgagcgagggcgaggctcacgggtgcgctttccaaaggaggaaagatgcgcggagtcgccaccaacgtttatttgtggaaaacgtcggaaaaaccgaaggaaaccggtcaagatgaaaattctaagttcgggagttgtatttacgcttgaggaaggtattagcacctcttacgtttgtctcgaaggacaacagcctatgttttag

SEQ ID NO: 39780 - DNA, 213 bp, Glycine max
  Peptide Sequence Number=SeqID_131465
atgtacaaagataattggaccaaaccttggcctatgggctcagtaatctaccctgaggttcacgagaatcctagggccttcttcaatagctctagcccaatcctcttggagcctcttgctcagggctctaatgactggtcccttcctagggaggattgcatcacaagtgaactaagaacacaacagattcaatgcaaaaagaacattttttaa

SEQ ID NO: 39781 - DNA, 364 bp, Glycine max
  Peptide Sequence Number=SeqID_131466
agtctggagccccacgaatttcttgcctagcactgttcgtctatcctccaccatcaaatcttatctagagccccatgaattgattgtcattcatgcatccaccaccatcgagaatggagtcccacgaattgattgcctagcgctattggtctatcctccaccctcaaatcttatcccaagccccacgaattgcttgcctagtgctattcatctatcctccaccctcaaatcttatccggatccccatgaattgattgtcattcatgcatcctccaccatcgagtctggagccccacgaattgcttggctagcgctgttcggctatcctccaccctcaaatcttatccggagccccatgaattga

SEQ ID NO: 39782 - DNA, 906 bp, Glycine max
  Peptide Sequence Number=SeqID_131467
atgggaacgaaacaaaccggaaaaagattttatcaagtcaagattaagggcctagatgtcaccagccttaaggagttggggcgattgatgggacctctccaaatgcaagccttcagcaaggcgtacggaaagattttagatttgaccatagcagagatattcacggaagctgttgtatcagtcacccaatactatgaccagtctttgagatgcttcacgtttggagacttccaattagtatcgactgttgaagaatttgaggagattctaggatgtcctcttgggggaagaaaaccgtatcttttcttcgggtttcttccctccttgagcaagattgcagttgtggtcagggattcggcaagagagttggatcgtgtaaagcaaactcgggaatggcgtagtggggctaccacgaaagtacttagaaggaaaggcaagggatatggtgaatcaagaggagtgggtcccgtttatggacgtattagcattgctaatctttggggttgtcctctttccaaacaggatggtttggtggacctagccgcaattgatgctttccttgcatatcaccatagcaaagaaagcccggtggtagctatctcgacggacttatttgacacatttgaccaaagccatcactcgtttgtccaaaagagaagagtagattgggaccaacacttggctgggataggagacagaacaatcaactggtttcctcgatggaaggaaggaaatgagggagttctcttctcatgtggggactacccaaacatcccgttgataggaacgaggggttgcattaactacaatcccgcacttgctataagacagttagggtaccccatgaggggagcaccgatggaagaaagcctctctcctttccttgtgagagatttcggtgagtga

SEQ ID NO: 39783 - DNA, 330 bp, Glycine max
  Peptide Sequence Number=SeqID_131468
atgaagcgccagattatcgagatcattggttacgtgatgtgtcgctccactgtcaaacagaaaatcatgttacgatgggccggcagttgcagtattgacctgaacctgtccagtgtgagccagagagttacgaggtggcggtgggacactaggatgctgctgctggaaggttttgcactgagagagaacatgacctttgatgttgcaccactgacagcagccgagaaaagggttttgtccatgccgagatttgtcattggaattgggtcgagcctgagcattcaaggctgtcagcggggcaggagtttgtctttgggcagcaccaattga

SEQ ID NO: 39784 - DNA, 747 bp, Glycine max
  Peptide Sequence Number=SeqID_131469
atgctgaaaagttttaaacaacaagaacaaatgtcagttctagaattgtacgtagaaaaggatgtggctgatggttcaatgtttcattctacaaattcgcttacatcatgtgaaaattatttatctaatgatgagacacaaccgccaacaaatatgagcaatttacatgttgacgaagatgatgatgatgattatcttgtgtctaactcatacgttgaagagtctttagacgaagatgacagtgttgacagtatatctgatacagacgatgaagtcaccgacatgattcaaccagtaaaaattgttcacccagcaaaaggtgtacaaggaattcaaaatccattttggaatgatgctttgcattataataatatcaactggagtcatcctgatgaggagaacatttgtggtttggagatgccatccagttttaatgttggccaagaattatatgttggcatggattttgatagtaaagatgcggtcaagaatgcagtcaaacaatatgttatgaaggtgcatcaaagtttcaaagtggttgaaagcaaatggaacaagtatgtcgtttgttgcttgaataaaaatgcagattgtccttgccctttctatatgagagcaattctatctaaaaaaacttattcatggaaagtcactcaatggggtggaccacacatattatatgtattaagattaccccaagatcacgagaagcttgattcagatttaattgccacttgtgtagcatga

SEQ ID NO: 39785 - DNA, 420 bp, Glycine max
  Peptide Sequence Number=SeqID_131470
atgtctgaggtttatgggattaagatggtcattgaccagtccctattttatgatttaacccaattgccaagcgaaggtgtaccatttgaaggtgcactgattgacgattggaagtttgatttctctgtacatgatgcccgccggttggtttgcaccaaccaagcggatatgaccggaaggcttcttgccggttcattggattttgaaagccgcatcctccattaccttattgttcgcatcttgcttccaagatctttaaaccttgctcaggtttctaaagaagatctcattgtcatgtgggcctttcataaaggtttaaaaattgattgggcacatcttgttagatattgcatgcataaggcattgcgattgaatgctccattgccttaccctcatctttgtagatgcaattgcctttga

SEQ ID NO: 39786 - DNA, 411 bp, Glycine max
  Peptide Sequence Number=SeqID_131471
agtcctcttattgcgtgttcggtagacaccaacgatcggggacttttgtccgcgtttgtggagcggtggcaccgagagacgtctaatttccatctccaggtgggagagctcaccatcacattggacgatgtctcctcgcttctccatcttcccgtgattggcgacttacacacttttgagcccttgcacgtggacgatgcggttcaaatgctggtggacttgttgatggtctctccagagtttgttagggctgagacagcccagtgtcacggaccgtacgtacgcttgcaatggggtctcattttgagcgttttgatatatatattgcctacctttgaaaacgggtcccgatgggtgcagagaaacgcgaagaactggaaccagagaggtggcacgcaaaccgaggcatga

SEQ ID NO: 39787 - DNA, 698 bp, Glycine max
  Peptide Sequence Number=SeqID_131472
atggcgggttccagcacgtcgcgcacgcgcatggtgccgtggtcgcgcagcaattgcatccaggcgtcgaaggcgccgggaatcacggtggccagcaggcccgctcgagcgtggcggcggcgggcgtggtgccctggccgcacagcacttgacgcggccggtgcgggcgttgaggaaccaccgaaaccggggcacttcccgggccgcaggtcgctgcgaggccctgcagcacgaatgagggcgggcgcgacgtcgttgtactcgtcgaacagcagttgcgccgcggcacgtcgagcagcggacccgagtaggcctcggtcggcgagcaggccagctcaatggcttcgtgaggtgcacgacactccgaaggtcgggccgacggttccgggcagagtcgtaaacatggtagatcgatgggacgctgctcctgcatcacgaagccgtcgtagaaggcgcggcgcatctggccgtgtccggtcggcgccgggcctcgttgagcagcttgtcggccgtgcgggtcgcagaacttgccgtcgttcaggttgcggaacagcttgcgggcctcgggacgttgccgccgggcaggtcgacctgcgcggtggtgggccagtgggcctggaagaagtccttcaggccggcgatggtgttggagatacgcggcatcagcgcgtggccgtgttcggcgtaatagatggcgg

SEQ ID NO: 39788 - DNA, 165 bp, Glycine max
  Peptide Sequence Number=SeqID_131473
atgcgcacatgcccaacatgtggtgtatcctgctacaaggtcaacaaccatgaaataagtgatgctgtaaccgcagaaaacagtcatccagcaaagttgatgtggcatgctgaaggtcaaaaaatagatggattgctacgacatcccgctgatagtccgcagtga

SEQ ID NO: 39789 - DNA, 522 bp, Glycine max
  Peptide Sequence Number=SeqID_131474
atggccccgaggaaacttgcctcaaagagatccagcaacgataaagcggccgaaggaactagttccgctcccgagtatgacagtcaccgctttaggagcgttgaacaccagcagcgctttgaggccatcaagggatggtcatttctccgggagcgacgtgtccagctcagggacgatgagtataccgatttccaggagaagatagttcgccggcggtgggcatcactggttacccccatggccaagttcgatccagacatagttctcgaattttatgccaatgcttggcctacagaggagggcgtgcgagatatgaggtcttgggtgagggctcagtggatcccgtttgatgcagatgctatcagccagttcctgggatatcctttagtgttggaagagggtcaggagtgcgagtatggccagaggaggaaccggtctgatgggttcgatgaggaggccatcgcccagttgctatatctggatgactttgctgctcagcaacatccagcccagcaaccataa

SEQ ID NO: 39790 - DNA, 1146 bp, Glycine max
  Peptide Sequence Number=SeqID_131475
atggcttcggcagcttatggaaccgaaggactgctgaagcgtctagtactggtgcattgccctaagtgtcagagttgcaaccaccaagaagttggggtcaagctacagctggagtcaaaggagctactgacattttgcttaaagaaattgcagaagaatttgaattcgaataaagtgaggttggtgcatgctgagtttatttggactgagccccattccaggagagtaaaagttaaggtcaaggttcagaaggaagttcttaatggagcaatacttgaacaatcttatcctatggagtatgttcaacaagagcatatgtgtgaatcttgttctagggtccaggctaatcctgaccatcatggagtcaaatttgttgagtttatagggaaaattgctctggttacgaacaacattgctttgcttgatccatttaccttgaggcactgtttcatagatgttgatcagtactggagagcatccttcaagtcattacttactagtagacaattggtggattatattgtgttggatgtggagactgtttcatctgaggttactattggtggcacgaaatatcgtttagcagatgctcaagtggctcagatatgggatgatatcaagtcttgggtggaagaatatgtctcattctactacaagtcagctgaggaacttcaaaaagaccccgagctccaagcttggtggaaagaacttgtagagtatccatatggaggtttaatcctgaatagaccaactattagcaggagattcatgcttgagaaagggtctcttgaatatgatgcattggctaagaaccctgggaaggagtttttgaagcctattactggcaagaaagagaccctcattgaccttacaattatagaaattttatcaaggcacgcatctgatgagttctaccctgggcagagagatggtggtgagtactggacttctgatgccgggccattagaggcctttaagaggtttggaaagaatcttgaagagattgaaaagaagcttatagagaagaacaatgatgagacattgagaaaccgctatgggccagctaaaatgccttacactttgctctatccttctagtgaggagggattgactttcagaggaattcccaacagtatctctatctaa

SEQ ID NO: 39791 - DNA, 397 bp, Glycine max
  Peptide Sequence Number=SeqID_131476
atgcctttcattggaagtaagtcgggagcctccaataggtcaccctacttccattttagtcataactcttacaagagcctaagtgaagaacttcgtcactattatgaaggaaggcataggtcaaatcttagacctcactcccataggagagaaaaggaaagaaagcctcaagagactaacattaacctcccatacttccatgggaaggacaatgtagaggctaacttagattggaaaataagggtagagaaacaacttaaaaggaagtctacttcaaaatcttatggctctaactcttatccaaagaaataccaaggtcaaggcatcttaggggtgacaccttctaagcccaaagatgataaggggaagacaatagaaaagcaaccccttaaggcta

SEQ ID NO: 39792 - DNA, 222 bp, Glycine max
  Peptide Sequence Number=SeqID_131477
atggaagcgaaatggagaaggaagagagagaggagacaccacttcaaggagaagatgagtctagaagaagctcaccaccataggaggccatggataagagcttggaggaagaaggagatgaatgaagggagagggagagaagagcacgaaattttgtgctcaaaaagagctctgaaatctgaaaccactaatcccaggatcaattccaagattctccactaa

SEQ ID NO: 39793 - DNA, 201 bp, Glycine max
  Peptide Sequence Number=SeqID_131478
atggtggggtacgtgccttcaagctttgcggatttggtcttcgctgatgaaaggattgaagtgggtctaaaaagaggcaaatttaatcatcctgcttggacaaatgagaaaactggggcaaatgaagagggtgagaataaaggagaaacccatgttgcgactgccattcctacatgcccaaacttcccaccagcccaataa

SEQ ID NO: 39794 - DNA, 294 bp, Glycine max
  Peptide Sequence Number=SeqID_131479
atgtaccctctcttgttcttagtcaacaccccaagtagatgtaccctctacttgtaccacaaaggatgtaccctccaatgtgttaagacaaaggaaagggaagaatcaaaagaattctcagactgtgtcattttgaattctttgacaagggagaagggagacacaaaagaattcagacagttagtccttcattcttttggaaaagggagaagagagacacaaaaagaattcaggcggttagtccttggcaaattctttttggcaaaaggagaagggaatgaaaaagatgaataa

SEQ ID NO: 39795 - DNA, 559 bp, Glycine max
  Peptide Sequence Number=SeqID_131480
gaattgctcttaaagcatcatcctcaattcaagaagaaagtgatcaggataatgatccagatgatgatgatgatctaagtctctttgtaaaaagattcaacaagtttcttaaagtaagaggaaatcagaggcgacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 39796 - DNA, 773 bp, Glycine max
  Peptide Sequence Number=SeqID_131481
atggctagagatgtacgtattgatgaggtattccgtacagtcagttcgcttccgccgggcgaactggcggcttttctggctgtcgccgagcatggtggcttcagggccgccgcccgtacgcttgatcagagcgcttccgcactgagccacgcagtggcaggcctcgagaagcgtctcaaggtgaagcttttccaccgatccacccgaaatgtgtctttgactgagtccgggagcaggttcgcctcgagactcgtgcctgcgatcagcgagatcgggctggcggtcgaagaaatcgaagacatgaatgccgcgcccgccgggcttctgcggatcaataccgatgcaaacgcggccgagcaggtgctcatgccgctcctgacgaagttcatggctatccagccagccatgcggttcgagatcgtgtccgataaaagattggtcgacatcgccgaaggcggattcgactgcggtatcaggctcgccgaacttgtgcccgaggagatggtcgcgatcccgatcggccccgatcagcagcacatcgtggttgcgtctcccggctatctcgacaatgcacccgagttagcgcagccgtccgatatcgcgcttcacaagtgtgtccaactgcgtatgtcgggcggttctatctatcgatgggaattccagagacggggcgagacactcgccgtcgagacatccggcaatctggtcgtcgatcattcgcggcttctccttgcggcggcgcgtgaaggatatggcttggcctacgtcacgcg

SEQ ID NO: 39797 - DNA, 536 bp, Glycine max
  Peptide Sequence Number=SeqID_131482
atgactatgagcgcagacatcccgttcgggttcgcttcgaccgcaaacgaagtgctggagggtatagacctctccggaaagaacatcatcgtcaccggaggttcgggcgggatcggtctcgagaccaccagggcccttgcggccgccggcgcttccgtgacgatcgccgcccgtcgtcccgacgatgcccgcgccgttgccgagaggatcgcgtcggaaatcacaaaggggagcgtgagcgttcgtcagctcgatgtcgcagatctgtcgtcggtgcgtgctttcgttgagggctgggaccaaaagctcgacgttctggtcaacaacgctggcgtcatggcaatccccgatctgcagcgcacgcccgaaggccgcgagatgcagtttgcgaccaactacttggggcattttgccctcgccctcggcctgcgcactcatctggcgaaggcgaacggagcgcgcgtggtctctgtcgcatcggttggcagcctgttcgcgcccgttttctgggacgatccggacttccgctttatccc

SEQ ID NO: 39798 - DNA, 171 bp, Glycine max
  Peptide Sequence Number=SeqID_131483
gcttgaaaacgaggccaggaagctaaggaagcctctggtaatcgattacccagggaggaatgggtcactggtaatcgattaccagatcgtgatggcggcgcagctaatccatgatcgagtagagatggagtgcctagggggagcctgggagaccctcgaaggcaacacaag

SEQ ID NO: 39799 - DNA, 196 bp, Glycine max
  Peptide Sequence Number=SeqID_131484
gcgaggctcacaggtgcgctttccaaaggaggaaagatgcgcggagtcgccaccgacgtttatttgtggaaaacgtcggaaaaaccgaaggaaaccggtcataaagaatattccaagttcgggagttgtatttacgtcgacaaaagcggggctcttgctcctacgtaccctccatcgaagaggaaatcagacctac

SEQ ID NO: 39800 - DNA, 411 bp, Glycine max
  Peptide Sequence Number=SeqID_131485
atggacagaagcatgacactaactaatgctcctagatctagcatggcattctcaaatttattgttcccaataatgcaaggtgggaatggaagagggataagaggttgtggttcaggtgcaggtgctgctactggtggaggcacttcaatttggttgccagacctcaagtttgtgaaggcaatttgtcagaattttgggattgtgcttggttcaactgagcagccatctgccccatctgatttgtcagactctaaatggaggcttttgtctcttgctaaaattgcatattctggatggtcatttgccgcactaactcttctaaggaaggttgaggaggagcctcagttgctttttgtctttgttgtgactgctgctgtattggaggaggaacatatggcttgcttggactag

SEQ ID NO: 39801 - DNA, 279 bp, Glycine max
  Peptide Sequence Number=SeqID_131486
atggtgaaagttggaacctcttacgtgccgatcaacgtctcattttcgccaaaagttggcccagggcttcccggtatcaacagggacaccaggatttatttattctgcgaagtgatcttccgtcacaggtgctcccaagtggcttctgtttctatccaagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 39802 - DNA, 684 bp, Glycine max
  Peptide Sequence Number=SeqID_131487
atggtaagcatttgggacctagctatggtagaagtctccatggaaccaattgcctccctcgcccagtattatgatcagccgttgaggtgcttcatctttggggacttccagctatcaccaatggtggaagaatttgaagagatcctaggatgtcctctagggggaaggaaaccatacttcttctcagggttttacccctcattggccagaatttctaaaaaaagtccaaatctcggcgcaggaattaaaccgccaaaggcaagtcgaaaatggggtggtcggaataccaagaaaatatttggagtcctctttccgaatatggaagggttagtggacctagcagcgattgatgctttcctcgcctttcatcatggcaaggaaagcccgatcgtcgccattttggccatgtatgacacgttcgtccggggatgtgaaaagagcggtgcaaggattgtttgctgtactccagctctctatgtggggctggtttcacacctttttctccaagaaggtaggcccgcctatccgctacaaggttaccgctcgtgcgtcgaaaaaggaaaggcgaattgggaccaactcttggctagcatggaggggcgtctgttaattggtttcctcgctagaaggaaggaagaatcaggattctatcttcatgcgaaggatgtccaaatgttctcttga

SEQ ID NO: 39803 - DNA, 231 bp, Glycine max
  Peptide Sequence Number=SeqID_131488
atgacaagtaaacttcaaatgctcataacttttgctacggttgtccgtttgaggcccactatatatcgaaacgctcagaattcagaggagaatccagataaggggatttggatagaacctgtatcaagagctgaagctctgataccagatgatgtgatcctgactaggaacagatcgcttgatacaggctacggagacttggatgatgccacttccagtaaaggaagataa

SEQ ID NO: 39804 - DNA, 138 bp, Glycine max
  Peptide Sequence Number=SeqID_131489
atgatgggcctaggatcttcttcatcaatggattcctttgcttattggaagatgaatggcagcagaatagagaaggaagagagagaggagacgccacttcaaggagaagatgagtctagaagaagctcaataccataa

SEQ ID NO: 39805 - DNA, 664 bp, Glycine max
  Peptide Sequence Number=SeqID_131490
agggacggagaggagatgctcgactgacaagttacttagtgcttgtgctaaggaatcgttttttcagtatgatcaggaatcgaatttcaaggttaccccatttcttaggtctccgaccgctgctgcttctgctacggcagaggatggtggaaaaaagactaagactaggggccctttcttcgagctgtcactcatagattctgacttgatctttaggcgaaatcaaactcctttcgtccatgagcccatactatcttccgtcactccactcgatcaacataggggagggggacctcgtcctctttctctttcgatagacttcctaaaggatgatctagctgtggatgatgtcccagctcgagagcctctggctactctcgatacctcttactccagaatagtcacgcttcccagtctctcagcgagttcgaaggcgattgaggagttttttaatcaatatccgctattctgcatctggtctttccgtaagcctgcccatcgagcggaaagaagagctggctttgttgttccttcccgcgattggaatgccaaccctagtagaaagatttctaatggaagggagcaggcaaagtctagctgcctattctcttccttaagtcccagacttgctaagactagcagcgctcactcggggatcctctag

SEQ ID NO: 39806 - DNA, 429 bp, Glycine max
  Peptide Sequence Number=SeqID_131491
atggaatttctcttcgacccctcaatctgggcgggtttactgacgctgatcgtgctggagattgtgctcggcatcgacaacctggtgtttatcgccattcttgccgacaagctgccaccgaaacagcgcgataaagcgcgcctgattggccaccatggaactgcacgagcggctggaaaaccgcggcatggagcatcagggcaacaaagcctatgccagcttctgggcggtcgtgacgcagattgtggtgctggacgcggtgttctccctggatgcggtgattaccgccgtcggtatggtgaaccatctgccggtgatgatgacggcggtggtgattgccatgggcgtgatgctgctggcctcaaaaccgctgacccgcttcgtcaacgcgcacccaacggtggtggtgctgtgtctgagctctgctga

SEQ ID NO: 39807 - DNA, 1264 bp, Glycine max
  Peptide Sequence Number=SeqID_131492
atggcgcaggcagtgagcgaagcggtgcagcaggcgggcgagctggtggtcgaggcaggcaccggcaccggtaaaacgtatgcttatctggcaccggcgttgcgggcgaagaaaaaagtcattgtatcgaccggttccaaagcgttgcaggatcagctctacaaccgcgatctgccgaccattgcccgcgccctggcgttcagcggcaaaaccgcgctgctgaaagggcgctccaactatctgtgcctggaacggctggagcagcaaaatcagaccggcggcgatctcagcgtgcaggcgctcggtgatttgattaacgtgcgcagctggtcatcggagaccgttgatggcgacgtcagcagctgcgccggcgtcgcggaagacagcccgatctggccttacgtcaccagcaccaacgataactgcctcggcagcgattgcccgctgtataaagattgcttcgtggtgaaggcgcgcaaaaaagcgatggatgcggatgtggtggtggtgaaccatcacctgtttctcgctgatctggtggtcaaagaggggggatttggcgagctgattccggaagccgacgtgatgatcttcgatgaagcgcaccagctgccggatattgccagccagtattttggccagcagctgtcgagccggcaactgcaggatctcgccaaagatattatccttgcctaccgcaccgaggtgcgcgatgtgcagcagttgcagaaatccgccgaccggctggcacagtgcgcacaggattttcgcctgacgctgggcgagcccggttttcgcggcaatctgcgtgacctgctgagcgacaacaacatcatgcgcatgtttacgctgctggatgatgcgctcgagctgtgttacgacgtgattaagctgtcgctgggccgttccgcgctgctggacgctgcctttgagcgtgccgcgctgtatcgcacccggctcaagcgtttacgtgcgattgatgaaccgggcttcagctactggtacgaatgcagcagccggcactttacgctggcgctgacgccgctgtcggtcgcggagcgcttccgcgaagtgatggacggacgcaaagcggcgtgggtgtttacctcggcgacgctggcggtcaacgaacagatgagccacttcgccagccggctcggcgtggataatgcccgcaccctgatcctcgaaagtccgtttgattatgcgcagcaggccttgctgtgcgtgccgcgcaacatgccggaacccaactatcctggcg

SEQ ID NO: 39808 - DNA, 1682 bp, Glycine max
  Peptide Sequence Number=SeqID_131493
gcatcaacaagctcgccgccggcctgtcagccgaagcgctgaccgaaaaagataagctggatatcattaccgcggcgaaaattggcgtcgactatctggcggtctccttcccgcgtaacggcgaagacatgaactacgcgcgccgtctggcacgcgatgccggctgcgacgccaaactggtggcgaaagtggagcgcgctgaagcggtggcaacgcaggaagcgatggacgacatcatcctcgcctccgacgtggtgatggtggcgcgtggcgatctcggcgtggaaattggcgatccggagctggtgggcattcagaaagcattgattcgtcgcgcgcgtcagctgaaccgcaccatcattactgctacccagatgatggagtcgatgatcaccaatccgatgccgacccgcgcggaagtgatggatgtggcaaacgccgtgctggacggcaccgatgcggtgatgctgtcggcggaaacggcggccggtcagtatccggcggaaaccgtgtcggcgatggcgaaagtgtgtctcggcgcggaaaaaattccaagcgtgaacgtatccaaacaccgcctggacgtgcagttcgacaacatcgaagaagcgattgccatgtcggcaatgtacgccgctaaccatttgcagggcgtgtcggccatcattaccatgaccgaatctggccgtaccgcactgatgacgtcgcgcatcacttccggtctgccgatcttcgcaatgtcacgtcatgaacgtaccctgaacctgaccgcgctgtaccgtggcgtgacgccggtgttctttgacagcaacaacgatggtgtcgccgccgcgcacgatgcagttaatctgctgcgcgacaaagggttcctcgtctccggcgacctggtgattgtcacccagggcgacgtgatggcgaccaccggcaccaccaacaccagccgaggccagatggcccgctatcaacccatcagtcaactcaccgggcgcgtgctgctgtttccgctcgcgctggtgctgtttgagttcgcgacctacatcgcccatgacatgattcagcccggcatgctgctggtcaccgccgagtttaacgtcggtccggaatgggtatccacctcactcactgcctatctgatgggcggcgtggtgctgcagtggctgctcggtccgctgtcggataaatatggccggcgtccggtgttgctgttcggcattctgttctttgccgccgcctgtgttctcaccacctgggtgagcaacatcgagcagttcgttacgctgcgttttatccagggcatcagcctgtgcttcattggcgcagtaagctatgccgcagtgcaggaggcgtttgacgaggcgttagctgtgcgcatgatggcgctgatggctaacgtggcgctgctggcaccgctggcgggtccgctggccggtgccgcctggctaacggtgggcgaatggcgcagcatgttctggctgtttgcggtttgcagcctgctggcgtttgtggtgctgtggcgcatcatgccggaaaccgccggcgatcgcagccactccattgcgttaccgaacctggcgcgcggctacggacggctggcgcgcgataagcaggtgatgtacggctccttcgctatcggcctggtgttcatcccgattcttacctgggtggcgcattgtcgccggtga

SEQ ID NO: 39809 - DNA, 1476 bp, Glycine max
  Peptide Sequence Number=SeqID_131494
atggcggtaacacaaacagcccaggcatgcgatctggtgattttcggtgccaaaggcgatcttgcacgccggaaactgttgccttcactgtatcagctggagaaagccggtcagattcacgataccacgcgcattattggcgtgggtcgcgcggagtgggacaaagaggcctacaccaaagtggtgcgtgaagcgctggaaaccttcatgaaggagaagattgacgaagcgctgtgggacaaactcagcggccgtctcgacttctgcaacctcgacgttaacgacacctcgcacttctcgaaactgggcaagatgctggatcagaaaaaccgcgtcaccatcaactactttgccatgccgccgagcacctttggcgccatctgtgaaggcctgggcgccgctaaactcaacgccaaaccggcgcgcgtggtaatggagaagccgcttggcacctcactggagacctcgcaggagattaacgacagcgtcggtaaattcttcgatgaaagccaggtgttccgtatcgaccattatctcggtaaagagacggtgctcaacctgctggcgctgcgttttgccaactcgattttcgtcaataactgggacaaccgcaccatcgaccacgtgcagatcaccgtggcggaagaggtgggtatcgaaggccgctggggttacttcgacaaagccggccagatgcgtgacatgatccagaaccacctgctgcagatcctgaccatgatcgccatgtcgccgccgtccgatctcagcgctgacgcgattcgtgatgagaaggtgaaagtgctgcgctcgctgcgccgcatcgaccagaccaacgtgcgcgagaaaaccgtacgcggtcagtacactgccggttttgtgcagggcaaaaaagtgccgggctacctggaagaagagggggctaacaagcagagcagcaccgaaaccttcgttgccatccgcgtggatatcgataactggcgctgggcgggcgtgcctttctacctgcgcaccggtaagcgtctgccgaccaagtgctcagaagtggtggtgtacttcaaaaatccggagatgaacctgtttaaggactcttacgccgagctgccgcagaacaagctgacgattcgtctgcagccggacgaaggcgtggatattgagatcctcaacaaggtgccgggtctcgatcacaagcataagctgcagaccaccaaactggatctgagctactccgaaaccttcaatcagtcgcatctggcggatgcctacgagcgtctgctgctggaaaccatgcgtggcattcaggcgctgtttgtgcgccgcgatgaagttgaagcggcgtggacctatgtcgattcgattattgaagcgtggaatgcggatggcgacgcctccaaaccgtatcaggccggcacctggggcccggtggcgtcggtagcgatgatcacccgcgacggccgttcgtggaacgagtttgaataa

SEQ ID NO: 39810 - DNA, 465 bp, Glycine max
  Peptide Sequence Number=SeqID_131495
atgagcgaactggccctgcagcgcgcacaggacatcgccgctaacgtggtgaaagcgctcggcggttacggcctgtttggcgtggagctgtttgtgtgcggcgacgaggtggtgttcagcgaagtctctccgcgtccgcacgataccggtatggtgacgctgatttcgcaggatctctctgagttcgcgctgcacgtgcgcgccttcctcggcctgccgattggcggcattcgccagtatggaccggctgcttcggcggtgatcctgccacagctcgatagccacaacgtgcagtttgtgaatgtggaagccgcacttggcgccggtttgcagctgcgcctgtttggtaagccggaaattgcggggcagcgccgtctgggtgtcgcgctggcgaccggtgacagcaccgatgatgccgtggcccgcgccattgccagcgccgcagccgtgcaggttcagggctga

SEQ ID NO: 39811 - DNA, 642 bp, Glycine max
  Peptide Sequence Number=SeqID_131496
atgagtaactggctgcagcaaattcaatcggttctggcaaagaagggcggtgatggcaaaacaggcggcctgagcgatatgctggcacccggcgcgctgggtggcctggcgggtttactggttgccagcaaatcgtcgcgcaagctgttaaccaaatacggcggcaccgcgctgctggtcggcggcggggcggcggcaggcgcggtactgtggaataaatacaagcagcgcgtgcgggaaacccatcaggatgagcctgcgtttggccagctgcagacgccgctcgaccagcgcgcggagcgactggtaaccgcgctggtgtttgctgcgaaaagcgacgggcacattgacgatcgcgagcgctcggccatcgagcagaatatccatcaggccggttacggggcgcaggcggaagcgctgattcagcaggcaatgaaccgtccgctcgatccgcagtggctggccgccgacgtgaaaaacgaagaggaagcgctggagctctatttcctcagctgtgcggcgatcgatgtcgatcatttcatggagcgcagttacctctccgcgctcggtgatgcgctgaaaatcccgcaggacgtgcgcgacggtattcagcgcgacatcgcggcggaaaaagcggcctga

SEQ ID NO: 39812 - DNA, 1092 bp, Glycine max
  Peptide Sequence Number=SeqID_131497
atgatgaaaactgcatccaggcgcgttatcgcgctactgctggcgggcgcgacgctgggcttcagccagctggctctggcacatgcccacctgaaagccccggtgccggcggataacgccgtggtggagcacgcgccgcagcaactcaccctgacatttaccgaagatattgaaccggcattcagcggcgtggaaatgaccaacgcgcagcagcagccggtggcgctggataaagcccagctgaatccgcagcagcacgatcagctgattgtgccgatcgcccaggcgctggcgtcgggccagtatcagcgcgttctggatcggcctgcgggcgctgcattttctggcgctgtttctgctgaccggcagtgcattttataccgcgctgctggcgccggcgcgctaccgaccggtgctgacacagcgctggcggcggctgatgggatacagcgccgtgctgagtttactcagtgcgctgttgatgctggcggcgcagaccgggctgatgagcggcgactggcgcacacgctggcgctgcgcctgcgcggtaatctgcgccagcaggcgttactgacgactgcgctgttgcagttggtggcactggcgggcgtcggccatgcggcgatgcgcgatggcatgccgggactgctgcagcaggggaatcatgcgctgcacctgatcgcggccgccttctgggccggtggcctactgccgctgctgctattaatgcgcgaggcgcgtaacattgcctggcgcaccgatgccattcgcagcatgatgcgcttttcacgctatggtcatctggccgtggcgctggcgattgttaccggcacggtcaacagcctgctgattgccggcacgccgctcaactggaccgccacgctgtggagcgagctgctggtgagcaaagcgttgctggtggcactgatggtgctgattgcgctgcttaatcgctatctgctggtgccgcgttttcgcctggccgccagccgggcaccgaaactttttatccgtctgacgcagctcgagctgctgctggcgttaattgttatcgggctggtgagcgtgtttgccacgctttcgccggcctga

SEQ ID NO: 39813 - DNA, 1062 bp, Glycine max
  Peptide Sequence Number=SeqID_131498
atgctggcgcaggccgctgccatgaccgatcggcctggcatcacttaccagcgcgctgatctcgaaaccctgcagctcagcagcacctttgatgtggtgtacagttcgctggcgctgcactatctcagccatatcgacgccctgtttgccacgatctttcatgcgttacgtcccggcggcgcgctggtgttttcatgcgagcacccaatttataccgcttcgcgtcagcaggagtggttcattgatgatgccgggcagcgcagctggccagtcaatcagtatcagcaggaaggggaacgggtcagcaactggtttgccgctggcgtgaagaagcagcaccgcaagctggcaacgtggataaacgcgctgattgccgccggtctggtgattgaacggctggatgagtggggtccggatgtacagcaggtagcggaaaatccggcgctggaagaggagcgcgagcgtccgatgcttggctgcatcctgcagccctgtgaaaattccccccggcgcttatctccggcactcaatcaaggtgttagctctgtaagggacggagcccgcatgatcactgactacacctttaactatctggatggcctggatgtgcactatcgttataaaccggccagtctggataatcagcatctgttgattgtcatgtccgggtttaacctgcccgatcctaccgtgtatgattttactttgctggagcacacccgtgcagccgtgttatggatcaaagacgatttcaacggtttgccagcgtattacctgtgtaacaatcttcagttcaacatcgagcacggcgtcagccagctcatccgggcggtgattgagctaacccaaccttctgacgtgaccattctcggcgcgtcgaaaggcggcagtgccgcgctctacttcggtatccgccacaacatcagaaacattattactgcagtaccgcagttttttctcggtgactatgcaagccagatttggcccagcgtgggtaaagcgatgatgggagagataagcccggctgcggtcgccactggccgatcatcagcgcgagcatga

SEQ ID NO: 39814 - DNA, 1383 bp, Glycine max
  Peptide Sequence Number=SeqID_131499
atgcgcgccagcctggccgacgaggccgaactcgaacgctttctcgccatcagtcagcagccgctgcgccgcagtctgcgcgtcaatacgctgaaaatcagcgtggaggattttctcacgcgcgtggcgggctacggctggcagctgacgccgattccgtggtgtcgggaaggcttctggattgcgcgtgatgacgaatcgctgccgctcggcagcgtcgcggaacacctcagcggtctgttctatattcaggaagccagctcaatgctgccggtcagcgcgctgtttgacgccgcgccggatgcccgccaggtgatggacgtggccgctgcgccgggctctaaaaccacgcaaatggccgcgctgatgtgcaatcagggcgcgatcctcgccaatgaatactccgccagccgggtgaaagtgctgcatgccaatatcagccgctgcggcgtcagcaatgtggcgctgacccattttgacgggcgcgtctttggtgccgcgctgccggaacagttcgatgccgtactgctggatgcgccctgctccggcgaaggcgtggtgcgcaaagatgctgacgcgctgcgcaactggacgctggccagcaccgaggccatcgccgccacccagcgcgatttactcgacagcgcttttcacgcgctgcaaccgggcggcacgctgatttactcgacctgtacgcttaatactatcgaaaaccagcaggtgattgcctggctgcagcagcgctatccgcaggcgctggaaatcgtgccgctcaacgatttgttcgctggcgccgaacgcgcgctgacgccggaaggcttcctgcacgtgtttccgcatatcttcgacagcgaaggctttttcgtcgcgcggctgcgcaaaactgccagcgtgccgccattgccggcgccgacctacaaactcggcaagctgcccttctcgcccgccagccgcaagctggtggcggaggtggcgcaggccgcgcacaaggtgggactgcactgggatgagagcctgacgctgtggcagcgcgacaaagagctgtggctgttcccggcggcgctggagagctggctcagcaaagtgcgtttctcgcgtatcggtctcaaactggcggaaaccttcccgaaaggctttcgctggcagcatgaagcggtggtggcgctggcgcaaccggacagcgcgctggcgttcgaactggacgaagcgcaggcggaaagctggtatcgcggacaggatatccatcccgacacaccgcccgtgcgcgatgaggtgattgtcacttaccagcagcagccgctgggcctggcgaaacgcgtcggaagccgcatcaaaaacagctatccgcgtgaactggtgcgcgacggccggctgttccgttaa

SEQ ID NO: 39815 - DNA, 252 bp, Glycine max
  Peptide Sequence Number=SeqID_131500
atgcatattcatggaaaagatcataaaggaaaaggagaaagaaacaatgaaactctcaagttgatgaagtcaaaacaaatgatgatcttccaagagaatggagaacttctagatatcatcctcttgacaacatcattggtgattgtcgccaactgtcgtaacctaccctttggcgggagggcaacgcgtgactcgcgggatgcgtgttccacgaaaggaatacgcgtggagtcgccaccaacgtttatttga

SEQ ID NO: 39816 - DNA, 393 bp, Glycine max
  Peptide Sequence Number=SeqID_131501
atgggggattccatcagcggactctccttccctggtagacgcattgtttttcactcaaaaaaagcatgtgctgctctaatcggttggaatattggtctctttgctaaagcatgtttgcattttagtggaggaaacaccgagactttttcaagtctcacaagatacgtaagagcaaaagcctcacttttttcgaccacaccaccttttgttgccatgacccaagagttggtaacccgcggagacaccttacagttatccgcacctcgtcattcagtgacccagagtgtgattgatgagcagaggccaatgtggtcatctgtgccctttccggagatgtcaacatcttccggtggagactttttcaagtctcacaagttatctagaactacgtag

SEQ ID NO: 39817 - DNA, 294 bp, Glycine max
  Peptide Sequence Number=SeqID_131502
atgggaagaacaaaagaattctcagactgtgtcattgttgaattctttgacaagggagaagggagatccaaaagaattcaagcggttagtccttcgatcttttggaaaagggagaagagagacacaaaaagaattcaggcggttgagaagagaatgaaaaggatgaatagcacaagttttcataggtttagtcgaaaaccaggagaagacttcagaaagcttttggttgcgatcaaagcaagaagaagaagttcaaatgattcaaggcttcgtaaaggatgtaagttgaaatga

SEQ ID NO: 39818 - DNA, 285 bp, Glycine max
  Peptide Sequence Number=SeqID_131503
atgagaggaactcaaagaagaaaaagcttcaaacctaaaagaaggactgaagaatcatcccaaactccaagatgctatgagtgcaatcaacctggacatttgagggttgaatgtccaatctttaagaaaagaatggagaagttcaaaaagaagaacattggagaaaagaaggcaaagaaggcctacatcacatgggatgataatgacttagaatcatctgatgattctgaaaaagaagtgattaatctatgtctaatgggaaaaaactatgaaagcgacgaaaag

SEQ ID NO: 39819 - DNA, 513 bp, Glycine max
  Peptide Sequence Number=SeqID_131504
atgtcttcatttccgtctaactctatcattggcatgggtagtagtgattccaggggttcgattcaacaacccctggtggaccgagaggtcatttccattggtggttcctcctcaaaggacacttgccacggttcctttaacaatgaatcctcttccttggagaggttaagggttttgcgtcgtgctggtggagacatttctcgtctcggtgggagggcgcagcctttccctgcttgccctcctaggaagcctatcccagttactataattcttcccccttctgtttctaggggagcaaggcaaagtgaaagggacgttagggcatccccccgtgtgcgtcgcaaccatagtgctaggtcgttattgtccttccctgccattgctagctttaaatgggcgagggacgatgttctgaagtacaagtcctccatcacttctgcgacgagtgtcactacactgcaacgccaagtaaaattggcaaaccctgaggactcctacaagacaaccatctaa

SEQ ID NO: 39820 - DNA, 1142 bp, Glycine max
  Peptide Sequence Number=SeqID_131505
atggggacaaatcaaaacggcaaaaggttttatcaagtcaaggttaaaagtctagatgtcaccagcctcaaggaattgggacgattgatgggacctctccaaaggcaagccttccgcaaagtgtacggaaagattctagatttgaccgcagcggaggtatttacggaagttgtcgtatccctcgcacaatactacgaccagccattgaggtgtttcacgtttggggacttccaaatggtaccgactattgaagagtttgaggaagtattaggattccctcttggggggagaaaaccgtatcttttctctgggtttcttccctccttgagcaagattgccactgtggttggggattcggcaaaagagttggatcacatgaagcaaactcgcaacggcgtagtaggccagccacggaaatacttggaaggcaaggcaagggatatggcgagccaagagaagtggggcccgtttgcggatatactagctttgttgatttttggggttgtcctctttctggacgtggatggtttggtggacttagccgccattgacgctttcctcgcgtatcaccatagcaaggagagtccagtggtggctatcttggcagatttgtttgatacctttgaccggagatgtgagaaaaacagtgcacggattgtctgttgtttacccgctctctgtgtgtggttggtttcacacctattccaacaagacacaagacacccgtgtccgcttcaaagctatcgctcatgcgccgaaaaaggaagagtcgattgggaccaacatttggctggaataggaggcaacgcaatcaattggtttcctcgttggaaggaaggcaaggaagaagttctcttctcgtgtggggactaccctaatgttccattgatagggactaggggttgtattaattataatcccgcactcgccataagacagctagggtaccccatgaggggagcgccaaccgaagaaagtctctcgcctttccttgtgagggatctagacgcgcaaagtctcaaggtgatacaaagagtccacaaggcgtggagaagtccgttgaagaaagacaaggagcttagaggcatccgaaatggcgtcatcggtggttatcatggatggctaagagttgacacgcgagg

SEQ ID NO: 39821 - DNA, 191 bp, Glycine max
  Peptide Sequence Number=SeqID_131506
gggttgatggggacccggtgttgagaggaacgaggataagggctaggtgggggtacatgagctcagttgaagagttgatttgcaccatcgcccaatcgccacctagtaccacatatgacggagtggtacctggagatatgtcgcgggggtcaggagaccttggggacgttaggtggggtgctattgcctaa

SEQ ID NO: 39822 - DNA, 609 bp, Glycine max
  Peptide Sequence Number=SeqID_131507
atgacggcaaggagaagtacccatctcggtcccctgctccacctccggaaagatccgtccccccatgaactaccccaaccagaacatagtccgcctaccggcttcacccacactagaaattccgagagcagtgagggcctcggcaattacccaattctcggatctagcggtcctctaagagaggaaagagaccagtcatgggtgcatggcatgatcttaaaagaagagttagctgcgtgcgcaagatccaagaggagtttggctcaacacttggaagccacggagcaaagcatgctagctatcatagggcaatacaaggcagagttgaaccagtctgtggcccatgaacaaaagctagtggaggattttgcacaagtgtacgccgaaaaagaagcaagagggagggtgattgatgcattgcatcaagaagcgactatgtggattgataggttcgccttgaccttgaatggaagtcaaaacctcccgcgtctattagccaaagcaaaagccatggccgaagtgtgtacggcccccgaggagattcatgggttaatcaattactgtcaacacatgagagatttgatggcccacataattagaaaccgttag

SEQ ID NO: 39823 - DNA, 168 bp, Glycine max
  Peptide Sequence Number=SeqID_131508
atgcctataggttggacctcccaaaagagtggagccgatactgagttggaggaaccaacagatttgaggtcaaatccccttcaagggggaggggatgatacaatcctccctgtagaagggatcagtcaccagagccatgagcaaaagactccaagaggattgggctag

SEQ ID NO: 39824 - DNA, 375 bp, Glycine max
  Peptide Sequence Number=SeqID_131509
atgtccattttatccatatcatttaacattgtaactgtggtttatggcataaacttgaaaatcctgatgagtcataataacagcttccagaattgccccatgtatggtgttgcttgtcaatgttatgattcaacaagcgattctcctcaaatttcagccagcccgtatcaattagacttcacactttatgcttcggggtcatacaatgctcaatggattgagtggatatgggatcaagtttggcatatgacaacggaatttgggatgaaccctacaggctttttgctgcaaaattccttttcgttggtgtttttttggtttgtgctaaaggtggtcttcgtcataggaagtgcggtagacaggcttcgtggttga

SEQ ID NO: 39825 - DNA, 227 bp, Glycine max
  Peptide Sequence Number=SeqID_131510
cttgcagtagacatgaatgggcgaccaagaatgagaggaatatctgcatccccttctatgtctatcacaacaaaattagctgggaatataaggtgtttcaccttcaccaaaacatcttcaatcactccatatggtcttgtgatggagcgatctgccaactaaaggttcatgcgtgtaggcattatctcaagctctccaagtcgctggcacatggagagaggcattag

SEQ ID NO: 39826 - DNA, 842 bp, Glycine max
  Peptide Sequence Number=SeqID_131511
ggtacatcctttgtggcacaagaagagggtacatctacttgggttgttatactgagaacaagagagggtacatctcttgtggatcagttcaagtgaagggtacatccacttggttgttcaaagagatcaaaggagggtacatcccttgtggatctttggcttgtaaaggattttacaaggtgagaacgtgtagtcctctaaaggcgaggacgtgtagtcctctgatggcaagggcgtgtagccctctgaaggcgaggacatgtagtcctctgaaggcgatggcgtgcagctctctaaagacgaggacgtgtagtcctctgaaggtgagggcgtgtagccctatgaaggcgaggacgtgtagtcctctgaaggtgagggcgtgtaaccctctgaaggcgaggacgtgtagtcctctgaaggtaaaggcatgcagccccctgaaggcgaggacgtgtagtcctctgaaggtgaggacgtgtagtcctctgaaggcgagggcgtgtggccctctgaaggcgaggacgcgtagtcctctaaaggcgaggacatgtagtcctctgaaggtgagggtacgcaaccctctaaaggcgtgggcgtgcagtcctccgaaggctagggtactagtacctaaggatgatgacaaaggtgatgacaaaaagctcaaaggtcaatcaaagaatgagttcaagatgttcaagatagaatcaagaaaacttcaagactcaagaggaaagttgaagaacacttcaagaataaagaggaaagttaaattcaaggatcaagcttcaagaatcaagatcaagattcaagactcaagattcaagaatcaagagaagacttaa

SEQ ID NO: 39827 - DNA, 174 bp, Glycine max
  Peptide Sequence Number=SeqID_131512
atggatgggattaagagaccatgggtctcttgtagaggattcctgaacacaagggaagggttgtccctgtgtggttcagactttgtaaaaggagttttacaaagagagtgggaaatctcaagcgggttgcttgaggactggacatatgcacgggaagtggccgaaccagtataa

SEQ ID NO: 39828 - DNA, 375 bp, Glycine max
  Peptide Sequence Number=SeqID_131513
atgactattgaagaatccattcatgtttcctttgatgagtctgatgttatttctccaagaaaggatgtgttagacgatgtttcagatttcttagaagagatgcatactcatgaaagggattctaaaaggaaaagagatgaaagcaatgaggattctcaggactatgaaactaaagtaaacaatgatcttccaaaggagtggaaagcttccagaaatcatccttttgacaacataatcagtaatatctcaaaagaggtagcatttgaactacctcaagttggaagtgaaagttactggaagttgaaagttgaaaatgcaagttggaagtggaagttattggaagttgaagttggaagttggaagttggaattttaa

SEQ ID NO: 39829 - DNA, 53 bp, Glycine max
  Peptide Sequence Number=SeqID_131514
atgggtctgtacatgtgctcggtggtaggccgcctgctggcgaaccaaatgcc

SEQ ID NO: 39830 - DNA, 87 bp, Glycine max
  Peptide Sequence Number=SeqID_131515
atggaggaggagaagaagaaggagaaaatggtggaggatgacaaaaaacagcagaggaagaagaagaagaggaggatgaacagatga

SEQ ID NO: 39831 - DNA, 96 bp, Glycine max
  Peptide Sequence Number=SeqID_131516
atggtggagacagggatgataaaaatattggaatctggagatcaagcagtacaaatgacggtaacttataaaggacacattcctcctcctctctag

SEQ ID NO: 39832 - DNA, 435 bp, Glycine max
  Peptide Sequence Number=SeqID_131517
atggagacacatgagatgatgcaaggaacaaaagtttatgcaagtgctatcaaccgacatgttggattgatgggcttgtccactgggccactgcatgatgatcgtgaaaagtttacgaaagatagtgtgcgtgagcaagaggaatatgttagctatttaggtgtaacttattggaaacgtatgttttccggtgcatcatcttccaaatcagcacaaagcaccacgagtcctttcgcagtctccatccggaagccaatagcaccgttgaactgcaccgcatacaacctcaccggaacatgccccacaaacctacaagaccatcagagaagtccagccaccgccacgtgtccagattacttccgttggatccacgaggatttgaggccatgggcccgcacggaacatgccccacaaacctacaatttaaatatttaa

SEQ ID NO: 39833 - DNA, 282 bp, Glycine max
  Peptide Sequence Number=SeqID_131518
atgaattgcttgtcattcatgcatcctcctgatgaggacatgaccaagagcaagggcaaggatccacttgaaggacttggaggacctattgatgaggacatgaccaagagcaagggcaaggatccacttgaaggacttggaggacctatgacaagggctagagcaaggaaagccaaggaagctcttcaacaagtgctgtccatactatttgaatacaagcccaagtttcaaggagaaaagtccaaggttgtgagttgtatcatggcccaaatggaggactaa

SEQ ID NO: 39834 - DNA, 660 bp, Glycine max
  Peptide Sequence Number=SeqID_131519
atgcctcccgaggcatatgagaatgattcgagccgtatgaagggaaactatcactggtgggcctacccatcccaaccaggggtatgctgggattcgcgaagagcagcaccttacgatgttcatgaccaatcggatcctgacgtaccagtaggtaccagaggagatcgctatgatcgttactgtatccgtattgaagagatgcgacaaagtctgcggataattttgcaatgtcctaataaaatccctagtggcatgatcaaagccgatgatcgtaagttatgtcctccatcacgatgtcgaatgaaactatccatggaatcgtgcgccgtcatcccgaggttggcgcatctcgttgggcgtggagaagcattgggaacctccatttctttcttcggagccgtttcttttcccgtccccccgccccggcatagcgcttcgcttccggttcttcggaagaatccactgacttctcccttcttcattgatctgggggaaaaggaaccgtctaccagttggcaagctagacatcaaggtggtgccttaccgcaccgcaggcgaacgcgcggtagcgttcgtggtggtgcttcaggattccaatgtactgcgtccaagatcagaacgagcttgccggcggaccactgccgtcccattcttgagtga

SEQ ID NO: 39835 - DNA, 234 bp, Glycine max
  Peptide Sequence Number=SeqID_131520
atgaagtatggctccatactctttgggtggaggacgcatgaacgaaaacgcaattcatgggggctccacgaaaaaagggcgaggatggaggattgcactagcgggtcctcactagtcaatcatgaagcacagctccaaactctttgggtggagcgatacatgaacgaaaacgcaattcatggggctccggaaaaaaggcgagaatggaggattgcactagagggtcctcactag

SEQ ID NO: 39836 - DNA, 306 bp, Glycine max
  Peptide Sequence Number=SeqID_131521
atggagaaagagcttggaacattggaaatggttttggaagaaagaaaggagaagagatggcgttttttcctaagctacttggaccacaaggctcaaaacgcacaagtgagcaatgctctcgggaacggaaatgtcgcgcacactccaaacatcttctcagagatcccaacgatgcaaaccaaatttcgagaagatccaacggttaaggaaggctgggcagtgtttttaccaagacagcttcatgtagcttccttgagaagcttcattaagaggcttcctcgagaagttttctcgtggcttctttga

SEQ ID NO: 39837 - DNA, 162 bp, Glycine max
  Peptide Sequence Number=SeqID_131522
atggagaactcaaaacacttggctactcctatgagcactggttgctaccttgacaaagatgagttcggtcaacccattgatgaaaaacaatatagaggatactcaaattcagatttttccggatccaaaacagataggaagagcactagtggcacatgttag

SEQ ID NO: 39838 - DNA, 300 bp, Glycine max
  Peptide Sequence Number=SeqID_131523
atgtcggctggaaaatatcagtcgcggctttacaacgaccgatgtcgacttatcaaagtaatccttgtggcgtctaccctgacttatcttccttcaccggaaagtggcgtctaccctgacttatcttccttcattggaagtggcgtctacccggacttatcttccttcaccggaagtggcgtctaccctgacttatcttccttcacgggaagtggagtcatccaaatctctgtaacctgtatcaaacgatccgctcctacgcaggttcacatcatctggtatcagagcttcagctcttga

SEQ ID NO: 39839 - DNA, 627 bp, Glycine max
  Peptide Sequence Number=SeqID_131524
atggaaaaggctagcgtaaacgccatccaagaagatgggccatcgcgggcaaggagattaggagaggtggctacttccagacgttttatctaccaatcgctgcaagcggcatgtatggtctcccgtggtggaggcgaaagggatgaatgtttgtttcacctcggggagtcgcacgacatggaaacctgtcccgcggtagaaggattgcttcagcggctcatggattgcgggcagcttgaagtgtccataggagggagggaagaaccacaaatttgcatgcagtcggaagagaagaaggttcctctaacccccaaggccctagtgatatgttttactaggaaagggaccgactccacacccatatacccccggacagcgcccaagccaacgccatttgcatatcaaagtaataaggccgttccgtggaagtatacccctcccgcgttcagcgaaagagttgcaaccgaagttgactccctgtcagctaaggtgaccaacatcaccggcctcagtggcgtaacccgcagtggtcgggtgttcgcttcccctcacccggcggagttgccctccaaggggaaagcgcccatggtccaagagcctacaaacgtagccaccccctcgaaagaa

SEQ ID NO: 39840 - DNA, 102 bp, Glycine max
  Peptide Sequence Number=SeqID_131525
atggggattttcaactttcaccgaaattgggtgcaagccattagtctatttgctcaagcgacctgtgctcctgagtttggacttccaagaccattcaattag

SEQ ID NO: 39841 - DNA, 869 bp, Glycine max
  Peptide Sequence Number=SeqID_131526
gattgtatggtcctggaatatgggtgtccgatccttatggactaactggaaggatacaatccgtaaatcccgcgtggggcgtggaaggtcttttccatcttagtgtgcgtccaccccaacgtctatataaaggattacggatgggaaatattgaaactgtcctttccagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagtttatcagaagcttggtctaaaattcccgaaaaattagctttttatgattatatcggaaataatccagcaaaaggggggttatttagagcaggttcaatggacaatggagatggaatagccgtcgatggggatggaattgttagggccgatgttccttttcgaagggcagaatctaaatatagtgtggaacaagtaggtgtaattgttgagttctatggtggcgagcttaatggagtcagttatagcgatcccgctactgtgaaaaaatatgctagacgtgctcaattgggtgaaatttttgaattagatcgtgctactttgaaatcagatggtgtttttcgtagcagtccgaggggttggtttacttttggacatgcttcttttgctctgctattctttttcgggcacatttggcatggtgctagaactttattcagagatgtttttgctggtatcgacccagatttagacgctcaagtagaatttggagcattccaaaaacttggagatccaactacaaaaaaacag

SEQ ID NO: 39842 - DNA, 270 bp, Glycine max
  Peptide Sequence Number=SeqID_131527
atgtacaaagataattggacccaaccttggcccatgggctcacaaatctaccctaaggctcatgagaaccctagggccttctcttgcatctttggcccaatcttcttggagtcttctatccaatgcccttggggggggcaggatcatcttgagctaccttctggggtagagacaaagaatgaacagcagaaaccaatcaaggtacatagggacgaatgcgagtgggggtggggtcacgaccgaccgattgttgccccttctctgcgctaa

SEQ ID NO: 39843 - DNA, 475 bp, Glycine max
  Peptide Sequence Number=SeqID_131528
aggaactacacgtcgtcaccatcaagagggctgcaacgccctcaccttcagaggactacacgtcctcgcccttgagagggctacacgccctcaccttggggctgcacgccctcaccttcagaggactacacgtcctcgccttgagaggactacatgtcctcaccttcagagggctacatgtcctcgccatcagaggacttcatgtcctcgccatcagagggctgcacgctcctcacctccagaggacttacacgtcctcaccatcagagggctgcacgccctcaccatcagaggactacctgtcctcgccttgagagggctacacgccctcaccttgggtactagttaccctcaccagtcagaggactacacaggactacacgtcctcgccttcagagggctgcacgccctcaccttcagaggactacacgtcctcgccttgagagggctacacgcccctcaccttgggtactag

SEQ ID NO: 39844 - DNA, 840 bp, Glycine max
  Peptide Sequence Number=SeqID_131529
ggtggacccttcggtactagtaccctcaccttccgaggactacacgtcctcaccttcagagggctgcacgccctcagaggattgcacgtcctcgccatcagaggactgcacgccatcaccttcagaggactacacgttctcgccttcagaggactacgtgtcctcgccatcagaggactatatgtcctcgccatcagagggctacacgccctctccttcagagggctacgcgttctcaccttcaaagggctacatgccctcgccttcagagggctgcacgccctcaccttcagaggactacacgtcctcacctttagagggctgcacatcctcgccttcatggggctgcacaccctctcctttagagggctgcacgccctcgctttcagaggactacatgtccttgccttcagagggccacacgccctcaccttcagaggactacacgtcctcacctttagagggttgcacgtcctcgccttcagagggctgcacaccctctcctttagtgggctacacaccctcgcttttagagggctggacgccctcgtcttcaaaggttctgttcctgggccaccccctgatcttggaggagggccaactgtgcgagcacaactagaggaggaggctatcgtacaaccactatgcatactggggcaagatttcacccatgccgttacaaagagacgagtgcggatcatttggggtcgcgcccacaagacacccaatggacccggagaagtccaacagggccctggggtttccagcttgggttacgggcctctgtcagtcctacagggtgcccgttccccccagcaaggtcataccatcatgacatag

SEQ ID NO: 39845 - DNA, 382 bp, Glycine max
  Peptide Sequence Number=SeqID_131530
atgactagaggcaatccatctgacttacaaccctttgatcctgagatagataggacatttcatagattagttaggcatcattttataccttttgatcattctaagcattccattactggtgaatctgtgcattctgttattggtgattttgaacatcctgatcttgagcattctgattctgagcattctgattctgagcattttgattttgcacattctgagaacatggcacaacctccaccccgtgagaggactctaagggaaatggttgcacttgatttcacctacgaaagcttgtgcatccaatacccttatgaggatgtcccatatgttcgtaaaactggactgattcatttgcttccaaagtttcatggccttgcag

SEQ ID NO: 39846 - DNA, 162 bp, Glycine max
  Peptide Sequence Number=SeqID_131531
atggtgattttccaccatgaagatgcagcggaagacaaaggagaagagcttgcagaggatgcttcaattgaggaaaagaaagagggagggaaagagggagggaaagagagaggggatagcatgaacttgaaggaagaaacagggagagaagttgaactttga

SEQ ID NO: 39847 - DNA, 171 bp, Glycine max
  Peptide Sequence Number=SeqID_131532
atgtgcttgcccagcgcgtcgcaagctcaccaagcgagtaggttgtctcttctcgcgctcagcgcgcccagctcgcttagccaaatttcacttagcgaaccaatctcgctaagcgagccttcagaagctgaaacgtccaagctaaacctcttggttgggaagttctgctga

SEQ ID NO: 39848 - DNA, 813 bp, Glycine max
  Peptide Sequence Number=SeqID_131533
atggcgtgtagccctctgaaggcgatgacatgtagtcctctgaaagcgagggcgtgtagccctctgagggtgaggatgtgtattcctctaaaggcgagggcgtggagccctctcaaggtgaggacatgtagccctcggaaggcgaggacgtgtagtcctctgaaggcgagggcgtgtagcccttcgaaagtgagggcatgcagccctctaaaggcgggggcgtgtagccctctaaaggcgagggcgaacaggcctctaaagatgagggcatgcaggcctctaaaggcgagggcgtgcagccttctgaaggcgaggatgtgtagtcctctgaatgcgaggacgtgtagtcctctaaaggcgaggacgtgtagtcctcaaaaggcgagggcgcgtagccctcagatggcgaggacgtgtagtcctctgaataggaggacgtgtagtcctatgaaggcgacggcttgcagccctctgaaggcggagacgtgtattcctctgaaggagagggcatatagtcctctagaggcgagggcgtgtagccctcttaaggagaggacgtgcattcctctaaatatgaggacgtgtagtcctttgaaggcgagggcgtgcagccctctaaaggtaaggacatgtagtcctctgatgacgaggacgtgtagtcctttgatggtgaggacgtgtaatcctcggaaggtgagggcatgtatccctctgaaggcgaggacgaatagtcctcaaaagttgagggcgtgtagccctctgaaggcgatgacgtgtagtcctttgagagcgaagacgtgtagccctctgaag

SEQ ID NO: 39849 - DNA, 858 bp, Glycine max
  Peptide Sequence Number=SeqID_131534
atgtcttggaagaggacacattacttctcaatgcccaccacaaaaaccatgattatgaggggccaagataaggctactacttcacctttctctagtgaaaatgaagaagcaaaaggggaagaatctagtgaagaaatctacccccaagaagaaggacaaccattagtggttaaagagaagtgtaaggaggtaagtgtctcctccaagaggttagctaagaaggaaactaattttacaataaagacaaacattaaagaaactttccctcttagacaacctccacattttctcttttgtaaaaagacacttgctagcattgccacacctcttgggcttgagtttattcctcaagtaaagaagttgttggaggagggtttggttcgcaagagcttaaatccttgtgctttgttggtgcccaaaataggtattattaggcaccaagtccctaaaataggtggtatgataaatgttttaagtggtgcaaccctcttttgtaaaatcactcgtacacctaacatcttcatggtgtgtgtacatagggacccattaggtagtgatcaaggggttcccatgaatcctaagagaataaaggtcattcctgagtggcccactccaccaacaccactcattgagttggtgaggaaccatgttccttcatgggaagatgcccaagaaatgggttttcagaccttaccttacttcaacttcccaaacaccactaatatatatgttttagtttttttttttacacttgttgaggaaaaaagcccaaagtttcaagaacctcaagatttgaggtcaaattcttttcaagggggagggaatgatgcaatcctaccccacaagggcattggatag

SEQ ID NO: 39850 - DNA, 300 bp, Glycine max
  Peptide Sequence Number=SeqID_131535
atggagttctacgcaacgccctggcccactaaagaaggagttatggataagcactcctcgatgcggggccaatggatcccctatgatgaggatgctatcaaccaattcctgggacatctgttgatcttggaagagggacaacattatgaatacgccgaaaaaagaggccaggtctcaagttttgatgaagaggccataggccagctactgtgctccccgaggcaggattttgcacagagcgtgacagggaggcgagtgcggatcatgcacactagcatgaccattttgacccagatttag

SEQ ID NO: 39851 - DNA, 555 bp, Glycine max
  Peptide Sequence Number=SeqID_131536
atgagtgtccatgtggcccaggtgattgctgacaccatctatttgtttgtaggtatgctacccaccaggcaccctctagacccggataagtctaacagggccttggtatttctggcattgatcacgggcctctgccagttgttcggggttcccgtcacccccactaaggtgatccgaccgccgatcacccgggccttcatcgagaagtattgcacgcctaggcaggcgcagggtgatgcacctcaggccgtagacgcaccaccaccacctcatcaggttgatcctgctggatcactaggcatggagcgttatctacagcacttgatacatgagtgtctctaccggttcagcctcagtcaacaggggcagggtttcgctccttttgcatgccctactccagagcagtttggggctaaggtcgcatggcccaaagattggcccgaggcccaggcaggggaggagcccgcaagatcccccggtgaggctgaggaggcccgtatggatgaagaaatgacggacttgcttggtttcttgggaagaagcggagccacgtga

SEQ ID NO: 39852 - DNA, 237 bp, Glycine max
  Peptide Sequence Number=SeqID_131537
atggttgtgaatgagtgtgtgattgatatttgtagagatattacttgtcatgtgagttatgagttatacagtaaacccgaccagaaggtgaggcccaaacggattcttcagagtctaggccttgggggtaaagatactcggtttgagtgctcctttaagcccatgttgatcccatgtggttggggcattctcgcaaaacagagtaaccctgactggtcaccttatgatgttacttag

SEQ ID NO: 39853 - DNA, 407 bp, Glycine max
  misc_feature (50)..(50): n is a, c, g, or t
  Peptide Sequence Number=SeqID_131538
gactctgccagtcattcggagtccccgttgcacctaccaaggtaattcgnccgcccatcacccgggcttttattgagaagtactgtacccagagacaggctcagggtgatgctccacaggccgcaggcgcgccaccaccacctcatcaggctggccaggctggggcatttgacatggagcagtatttacggcatttgatgagcctcagcatgcagagccagggcttcgcttctttttcatgccctactccagaccagttcagggcagaggtcgcatggcccggagattggcccgaggcccaagcaggagaggcacccccagaagctcccgacggtggagaagaggcccacgaggacgaggagatggccgatttgcttgacttcttgggagggagtggagatacgtga

SEQ ID NO: 39854 - DNA, 315 bp, Glycine max
  Peptide Sequence Number=SeqID_131539
atggaatccgtgcgcatcgactgtccaaagcaacggccgcagatctgctttctctgtctggggaaccctgagctccccctgaaagatcgccctttgaagcattcgacgcccggctcactcacgagacactttctgcggaaacatgtcaaccctccctggccggccaaaggggtgacttgtacggtctgtgatgggaagccattgcaacagaagtctgagcttctgaatcacgcggagggttcccatgggactgtcgtgggaggcactactcggcttatgctggcgcaagaagtcgacgctcgcttgaaatggtga

SEQ ID NO: 39855 - DNA, 459 bp, Glycine max
  Peptide Sequence Number=SeqID_131540
atgtccgggcgctcctccacttgccaatttcctagtcgaaaaccaggagggcatggtcgtaccaaatccgacccactcggagaatcatcttcgcatatcacaacgacttggccttcatggcgggcccccttcgacttctcgtcccaatcgcgagccttgacctccgctcttccttcccgcaacacttttccttatgtccaacgcttttccttgggtgacctttcaccggaatatcctcgtttgaagttgtgtcggcaggtcggggggtgcaaacaagcgaccgctactggtcacgccgctcagccccgtgacattggtcaccttggctcacaacgagctgatgtcggtggcctcttctttcctttcacttggaggtgcatacctccacgggactgcgtggttgtttcggtatgggaaaggaacaggtttaactaccgagaggtatcggggctttggtga

SEQ ID NO: 39856 - DNA, 432 bp, Glycine max
  Peptide Sequence Number=SeqID_131541
atggcagcgcaattaatccatgatcgcgtggtgatggagtgcctagagggagtttgggagaccctcgaaggcaatgagaggtgccgatttcgtggcatgattcgactcactgctacttcattagtacatccggaggaacccgcacgcacgcttcagcggactgtggagtggatactacctacacctactccatatcgactagtggagccagttcaagtgatagaggtgtcatcctctgaagaagaccctaaggaggacccagaggagttacctcctgagcctactgtggatgctcttgactttccagaggatgatgaggacccactccctgatgtggattctccagaggatatcatgtcagcatctgaggcaaactctacggaggagagcggccctggagggacagcgaatagtggagactcttcatcatag

SEQ ID NO: 39857 - DNA, 213 bp, Glycine max
  Peptide Sequence Number=SeqID_131542
aagtcgcaactggcagcattcttggcatgctcaaaatctaaagagagtcttgctcagaatctcaaagaagttctccaactacttcgacaggaagtggaagaagtaccccctaagaaggaagccgaatcatccgagactaatgatgaccaagaagatgatccattctaccagaatgaagatgactgttctggtatatcgttagacgacgattaa

SEQ ID NO: 39858 - DNA, 180 bp, Glycine max
  Peptide Sequence Number=SeqID_131543
atgcatagggtgtcaagcatgatccagaatgtattggcattgggaaatgtattcagtgttcatggagaagcatttcagtgtgtctcgcggttgcgatgccaacaactacgcggcggcgatgacgagggaagtgccgccggcaaccgcgagacgacgggaaaggtaacggaatcggagtga

SEQ ID NO: 39859 - DNA, 207 bp, Glycine max
  Peptide Sequence Number=SeqID_131544
atgtgcacgtatgcactttttggtagccaaagtgctttgagtatgcatgaaatggccccgaggaagctcgcctcaaagaggtctaggaaggataaggcggccgaaggaactagttccgctcctgagtatgacagtcaccgctttaggagcgctgtacaccagcagcaattcgaggccatcaagggatggtcatttctccgggagtga

SEQ ID NO: 39860 - DNA, 210 bp, Glycine max
  Peptide Sequence Number=SeqID_131545
gggcaggatcatcttgagctaccttctggggtgaggaccaaatgtggacagcagaaaccaatcaaggtacttaggaacggatgcaagtggggatggggtcacgaactgatcgttccctttctctgcgcttacggacaacttagtagaacgtcgaactgcggcagccccgttcctttgtatatgggatggagttgtcttactattgtttga

SEQ ID NO: 39861 - DNA, 273 bp, Glycine max
  Peptide Sequence Number=SeqID_131546
atgtacaaagataattggaccaaaccttggcccatgggctcagaaatataccctaaggttcatgagaatcctagggccttctttagtagctctagcccaatcctcttggagcctcttgctcatggctctagtgactggtcccttcctagggaggattacatcacccgagatgtccttaaagatcaaggaagaggtgaaaaagcaattcgacgctggctttttttatgtagctcgatacctagaatgggtagccaatattgtgccagtccctaa

SEQ ID NO: 39862 - DNA, 405 bp, Glycine max
  Peptide Sequence Number=SeqID_131547
atgacattgctacttagcaacattctgcccagcgaccacaaggtcaatctccccctgcaaaagtatcagttggtctgtgtcgtcccgacatggggatcgcactcacaaagacacccagtggacttgaagaagtccaatagggccttggtgtttccagctctagttacgggcctctgtcattcctacagggtgtccgtcccccagcaagggatcgcgcctgcaagccacctagtggacccagagaagtccaacagggtcttggggtttctagctcggattatgggcctctgtcagttctacagagtgcctgtcgaccccagcaaggtcatcaggccccctactaatcgagctttcatcaagaagtactgcgctcctaggcaagcgcagggcaagacatcacagtag

SEQ ID NO: 39863 - DNA, 461 bp, Glycine max
  Peptide Sequence Number=SeqID_131548
gcaattcacaccttccttgcttggccgacacatctggtaaaatcattatcacaacagcctgttctgtctccggcaaaaccacctcaaaagctggatccgatgaggtcaatgatccgctttatctgatgacattgaccatcctagagcttttcttgaggccttatcaggttagatgggatgccaccgtgttgggggtctttaatccagacttccccctctacataaagcacgaagacctctccgaaatcgcacacggtggtcaatgtctcagcatatcagtgttacggttgtggattctgtctgggcaatcgcagtttgagtctgaaagttacataaagagttggatgcagtgttcacaacgcgatgtctatcttggagcctacctaaatggtgctatcaagggtcttgatgatgctccacagcctaaatcaaaggcttctgctaggtggattgtcgtcaag

SEQ ID NO: 39864 - DNA, 906 bp, Glycine max
  Peptide Sequence Number=SeqID_131549
gggctacacatcctcgccatcagagggctgcacgccctaacctttagagggttgcacaccctcgccttcagagggttacatccccaaacttcagaggactacacgtcctcaccttcagagggctacacgtcctcaaacttcagaggactacacatcctcaccttcagagtgctacacgtcctcaccttcagagtgcttcacgtcctcaccttcagagtgcttcacgtcctcaccttcaggggactgcacgccatcgcctttagagggctacgtgtccttactttcattcctgggccaccccctaatattggagggcgaccaactgtgcaagcacaactagagagggaggctatcacgcagctactatgcataccggggcaagatttcacccgtgccgctgcaaagagacaagtgtggatcatgcgcaccaacatgaccacttttacacagatatggatgacgttgctacttagcaacgttctgcccaacgaccgtaatgtcgatctccccctgcggaaggatcgcggctacaagacacccagtggacctggagaaatccaacagggccctggggtttccagctctggttacgggcctctatcagtcctacagggtgcccgtacccccccgacaaagtcatgccatcgtgacataggtaaggatcgtgcccgcaagacacccaatggacccgaagaaggccaactgggtattggagttgccagctctaattacgggcctctgttagttctacggagtgccccgttgcccccagcaagttcatcaggccccctattaaccgggttttcatcaagaagtactgcgcccccaggcaggcgcaaggcgaaacaccacagcagcctggggagggccggcagcgggcaacaggcgcaccgccaccacctttag

SEQ ID NO: 39865 - DNA, 268 bp, Glycine max
  Peptide Sequence Number=SeqID_131550
ggctcacggagtcgccaccaacgtttattcgagaaaaacgccggaaaaaccagaatgtgtggtctacgaactttaagtgtgaaaggttcaggagttgtttttacgcacggggaaggtgttttccttgctcctacgtattcctcaattgcgatgaggaaatcagacctacgtagttctttgagggtggtcgacaaaagcggggcttttgctcctatgtatcctcgatttgtggtgaggaactcagacctacgtagttcttgcaaaagcg

SEQ ID NO: 39866 - DNA, 252 bp, Glycine max
  Peptide Sequence Number=SeqID_131551
atgggacaccttaggcttgtcgtactttttggtaggaataatcaacatgaaaatacagaaaaagatcaaggggttctcatggaccttaggagaataaaggtcattcctgaatggcccactccaccaagtataaggaaaatttggggcttccatgacttaacaaacttttacaaaaggtgttgtgggaagaagcctagagcttcaagaacctctagatttgaggtcaaatccttttcaaaggggagagaatga

SEQ ID NO: 39867 - DNA, 303 bp, Glycine max
  Peptide Sequence Number=SeqID_131552
agacaaaatttggtcattctgcaccctttgtcatccagaggcggcgggcctgatgacacgcggagacaaaatttggtcattctgcacccctttgccattcagacacagtcgtgtccgatgagacaaaatttggtcattctgcaccctttgtcatccagaggcggcggcccgatgacacgcggagacaaaatttggtcattccgcacccctttgccattcagacacagtcgtgtccgatggtacgcagagacaaaacttggtcattctgcaccctttgtcatccagaggcggcgggcccgatga

SEQ ID NO: 39868 - DNA, 178 bp, Glycine max
  Peptide Sequence Number=SeqID_131553
ggatcaagacagaacccatatgcaatgcctatgcaaaagacacaatgcgggaatgtgcacagtatgacaatatttaccgaacataagcaaaagggtatcatcccctttgaagaacatattgtagcagtagggactactagcaacaataggttttcaaagagaaaagctctagatgagg

SEQ ID NO: 39869 - DNA, 495 bp, Glycine max
  Peptide Sequence Number=SeqID_131554
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgacaatcgatttcgatcaagctataagccaaacgataaacgaggaagaggaagaggacatcctgtcaccagagttggagagattgatttctcaggaagaacgtgaaatgaagcctcaccaagaggaaaccgaactgataaactag

SEQ ID NO: 39870 - DNA, 300 bp, Glycine max
  Peptide Sequence Number=SeqID_131555
atggaatctctaccattgcttgtttttggcagccccaaaacaaaatccatggataaatcaatccaaggatactccggaattggcaatggatgttgccatgtttttgatgaggacatgaccaagagcaagggcaaggatccacttgaaggacttggaggacttatgacaagggctagagcaaggaaagccaaggaagcttttcaacaagtgctgtccatactatttgaatacaagcccaagtttcaaggagaaaagtccaaggttgtgagttgtatcatggcccaaatggaggaggactaa

SEQ ID NO: 39871 - DNA, 273 bp, Glycine max
  Peptide Sequence Number=SeqID_131556
atgtccaacttagcggaagttgcataccattcagagctgcataactcgctaagcgttcacctatgcgctaagcccaaaaccttctcggatgaactcgctaagatggcctctagaaaaaggaaagcaaccgcctccagacctgaagaaccctacgacacgactagatttatttcagaggtgacatgggaacgttatgaacaaaacgttcactccaggaacatcctcccagagaggaacattactttatatgtgacagagtatgacgagttctga

SEQ ID NO: 39872 - DNA, 957 bp, Glycine max
  Peptide Sequence Number=SeqID_131557
gcacttgcagtcgacaaggacggtgtggatgacactgatgtgcggaaaaaggcacaggccatccagaagcaaaacactgccccccacgtgttgtctcgtgggggttatgaatatttagaacaaaagctaatggctgagaagataaagaaaagactggaggaagttgcccagtccggaagcactgagggcgtcattgaccctccatctcccatcagacgccatgcgaagtggaagatggcccgcaccaagaaaactggacctacagtagctgacccaacaaatcagagaccatctggaggagtcgatcacagaaaaagtgacttggcaggtgatggcatccttcagccagatgcaatcccagtttcagtctcagatgcaatcacaaggacttgcattgcctccggagccatagggaacgatccagagacgggtgactcagacaaatgcgggctgtacattaaagaaaatccttcccacctggttgtcctaggaaaactttatgagggatacacagcggttcacaacatccctttgttgcatggccaagtgaaggttggtgttgaggaggttaaagatgcagaggcttctgttcctgtacccactgacgaggttgccttagtggggcaggcacttaaaaccttccttgcttggctgacacatctcgtgaagcgtttatcagaacaagcagctgtgtctccagcaaaacctccagaaagcccggatcatgaggtcgatgatcccctgtacctgatgacattgaccatcccacaactgtttttgaagcctctccaggttatgtgggatgctaccattgctttgaaaggacttgatgatactccacaacctaaatccaaggttgttgctaggtggattgttattaagtattttaatgatgttagaccattagaagcagagagattcaaggtgttcgcatccagtgggcacaatattgtctaa

SEQ ID NO: 39873 - DNA, 405 bp, Glycine max
  Peptide Sequence Number=SeqID_131558
atgaggaaattcagctccattagatttggagatagaagccacttgcaggagaaacaacgcaaaaagaaggaagaaaggacagcacagccaagtttagagggaactcaatcatctgaatcatcttcagcatttccaaacttaagagaatccgaagtaggtgcgtctgaagcacatatcatggctgaagatcaaccacggagggtgactcttgaagattattctagctcgatcgtgccgcaatttttcacaagcattgtgcggccgaaagttgaagctcacaacatcatatatcatcattccttgatccagttgattcaaggaaatttgtttcatggtttgccgaatgaagacccttacgtatgccttgctacttatatagaaatctgcaatacagtgaaattatag

SEQ ID NO: 39874 - DNA, 177 bp, Glycine max
  Peptide Sequence Number=SeqID_131559
atgggtttaatgaaagaacgtggaatggagaaggaagagagagaggagagccacttcaaggagaagatgagtctagaagaagctcaccaccataggaggtcatggataagagcttggaggaagaaggagatgaatggaagggagaggaagagaaaagcacgaaattttgtgctctaa

SEQ ID NO: 39875 - DNA, 150 bp, Glycine max
  Peptide Sequence Number=SeqID_131560
atggaggttgaggaaccttggctggggttatggctaccattgcattatcgagtagataggggagcgagctttgtggctgatttaggggtggcctttgtgaatgattgggtgttcttgactggtagggtggtaggtaatgagaaggactga

SEQ ID NO: 39876 - DNA, 153 bp, Glycine max
  Peptide Sequence Number=SeqID_131561
atggctatgttttactgtagccccatggtgggcgccaaatgtacttaccaagattccgagctggcacacgtcagggtagacgtggctaaggtgaatgtgttccatgtgggtgttgctgttgtgagcatgtcgagagagtacgagggaacctag

SEQ ID NO: 39877 - DNA, 279 bp, Glycine max
  Peptide Sequence Number=SeqID_131562
atgacgtttattactatgattaactttgagcaaaagagggttctacatcggtggaattggcatttctacgacggtagacacgtctttaaagctaatgtcgtagtagagggtggatgtttctacatcggtcgtaaaaggaccgtcttagaaacacgtgacaaacgaagtcgtgcctacagcagcatcgatgtagaaagcactgctttctacatcgttcttggctcaagaacgactttgtttctcacgttttctacgatggtcattttacaaacgatgtag

SEQ ID NO: 39878 - DNA, 534 bp, Glycine max
  Peptide Sequence Number=SeqID_131563
atggcttccagaaaaagaaagagtattggttcaaggcccacaactcagtatgatacaaggaggttccactcctttgaggcttggacctggtacacagataatgttctaggaagacatatactacctgagaggaaggtagaaatataccatactgagctggacgagtttaaggctaaattggagaggcataacttccataaacgcctcaccaatttagttgacaacaacatagatctagctttggtgaaggagttttatgccaccctttacagctccgaagggccttcattaaagcaagtcagggtcagaggccacttggtgaggattgatgcagacaacctcaacacctttctggagacacctgtgttactagctaagggtgaaaccttacccgcatattccagatactgcaggttacccactaatattagagaaattgaggctaccttatgtatcccaggtcgggggtttgttttgaatgctgaaggccaccctgggaatattctcaggaaagatttaacaactctttcttag

SEQ ID NO: 39879 - DNA, 571 bp, Glycine max
  Peptide Sequence Number=SeqID_131564
tgaaaccttacccgcatatttcagatactgcaggttgcccactgatattaaagaaattgaggctgctttatgtatcccaggtcggggtgttctctcatactccaacctagctcctacttcccacacctcgaacctgacagtagatcgagctaggctgatctttggcctagtctctcagatggacatgaatgtgggagctctcatctctggtcaaattacatctatggcccagtctaactcttctagacttgggttccctgctcttatcaccgctttatgtaagtctagaggggttgcttctgacagcttggtcttcgaacgcttgagcccggtcattaacttggcctatatcaggaaaaactattggaaccctgatgatctgacagttactatcagaggggccaggagagcgaggacaaggctagctgaggccccttccacatctacagctcctcctccagcacgtaccctagcaactccttctgccccagcttctgcagattttcagcgtcttgaagccattcttcaaagcatccatcaggggcagattatcttattacagagtttatag

SEQ ID NO: 39880 - DNA, 489 bp, Glycine max
  Peptide Sequence Number=SeqID_131565
atgacaaaagctagggttttgccaaaaccggtggcagcattgacgttgacatccttaaagctgcagagcagaggaatggtggcgactttgacgggggtgcagaacttgaagccagagtgcgggagaggaagaggaggccaaggagaaggatggtgcagaggaagaagaagcgaaggagaaagagataggggatggaaatcgaagaggatgtggtgggatgtagggtttatggagaagagggcaggcacggacaatgtccaagttgagcagcatctaggtgaaagtgatagtagaagcaatattaacttggttagagaaagtttaagtgatccaactttgaatgcatttgatattgacaacttggttttgaatgacaatgttaaatatcacttctcaaccaaagaagagcttctagatgatggaaataaagatgatggtggtggtggtgatattgaagatgatttaattagaggattgatgaacatttga

SEQ ID NO: 39881 - DNA, 309 bp, Glycine max
  Peptide Sequence Number=SeqID_131566
atgtgtttcttgatttcagaagttgtcatcatcaaaaagggggagattgtagaagcaaagcttcttggtgaatcaaaggtgattcaaaggtgttttgatgataacgatgacaaaaagctcaaagatcaatcaaagaacaactcaagtaaatcaagaagaattcaagactctagaagaaagtttagagtcaagaatcaagattcaaggttcaagatctcaagaatcaagattcaaggttcaagatctcaagaatcaagatcaagattcaagattcaagactcaagattcaagaatcaagaaaaggcttaa

SEQ ID NO: 39882 - DNA, 508 bp, Glycine max
  Peptide Sequence Number=SeqID_131567
atggctgctgcacgagggttggtactgtcacgtcctgttacttttgtgacgggcaatgccaaaaagcttgaagaagttcgtgccatcttgggcaattctattccttttcagtccctcaaacttgacttgccagagttacaaggagagcctgaagatatatccaaagagaaggctcggatggctgctgttcaggtgaatggacctgtgttggttgaagacacttgcctctgtttcaatgccttgaagggtcttccaggtttcatgctaagagcaagaatatttggggtttgtgcattgcatgcctctagtgctcttgatttagcaatgtttagacaatggctgctcaagttggaaaatcttcaagggttgcttctaaaatttggtattagaaactatgaggtggctactgatatgttaatgcaacacccaaggccatttaatgcaggaaaactgatttggacagctagcgcaagggttgaaatttcgagcaataggcaggataatgcat

SEQ ID NO: 39883 - DNA, 816 bp, Glycine max
  Peptide Sequence Number=SeqID_131568
atgagccacaaccgacagcttggcggttacatcacactgctgcagcacttttcgtcagtcgcagactccactactgatcaggagtatgacgaggattctccgcgtgcgtgtaggtggattgcgatgaagaagaccgtgaagagcattcgtacgccgacgtacagggagcgcctggaccgactccggattccggatgtctgttggtatggggagcaccgatcggtccgggacttccacatcagatcatgctattccgatctcttgcgctggaggcctgttgctgtttattaccgaccagagagggtcgtgcggcaatttggatacacgcagaccattcctgctcctcctgtcgattcatgggtgtcgtatgatgatatacacgataggtggatgcactactcggatcatatcgttccagcaggtgaggtgtgcgttgtgccaggtcagtgttccagtgactacatggattggttcttccgcatctcgcatcccttcatgacaccaggccacgcattagatcctctgcctcatggtcacgccctgcagccccgagtcgtccctcaggccccacagacgaatatccctcacgtgccggagctaggagcatcgttgacatctttggaggagcctagacatgcagaagtttgtgatgacattgctgagaggttgaagcgctatctgagtcaaagggtggtcactccaagctcatcgacacatgaggtgatcgaagaatgcctcaggttggccaggagtgtgacaaaggaccatctagtatatgttaggtctagacgcaggcgacgcacgaatcagacgtag

SEQ ID NO: 39884 - DNA, 405 bp, Glycine max
  Peptide Sequence Number=SeqID_131569
atgtatgtctacgaaaaagggatattagtgatccgtaaacagcccagcaacttcccgatagcggttttcgccatcgccggcaacaatggtggaaaaaacaaaacgcgaagaagaaacttacctcgaagaagaagcagaaacgcaaagaagaagcaaaaacgcaaagaagaagcaaacccacaccttcctcctaatcatggcaacaatggcgactggggaggttcacttgggaggcgaagaagaatgaagaagatggaatcgcgacgcagaagaagaagactgaagaagcagaagactccgaggaagaagaagcagaactccgaggaagaagaagctgaatcgcggcgcaggagagagagagaggcgagagggttgttttttaaaaaaaaatactcaggggcttaa

SEQ ID NO: 39885 - DNA, 315 bp, Glycine max
  Peptide Sequence Number=SeqID_131570
atgggaagggtgttacaaacagaaacttatacaagaagggtctttgatcagcagaagaagatgaaaaacttcttaggcatattactaagtacggtcatggacattggagctgagttcctaagcaagaaggcatgtatgaatgaaacctcacaatgcttaacaaaaagggatttctacttacaagcagctggttgtcgagaccgaatcaaacagacaatgacaatggcaaacgacgatggagcttgcgccacaattcaaacctcacggcagagtgaagaaggtgacgaccaagcttgcggcaacattctaggctaa

SEQ ID NO: 39886 - DNA, 180 bp, Glycine max
  Peptide Sequence Number=SeqID_131571
atgaggggttgttgcaaagtgcccttttgcgggcgacgcgtgactcgcgggatgcgtgttccacgaaaggaatacgcgcggagtcgccaccaacatttatttgaggaaaacgtcggaaaaatcgaaggaaaaccggtcaaaaatgaaaattctcagttcgggagttcaatttacgcttga

SEQ ID NO: 39887 - DNA, 138 bp, Glycine max
  Peptide Sequence Number=SeqID_131572
atgggctcaaaaatctatcctgaggttcatgagaaccctcaggccttcttcaacagctctagcccaatcctcttggagcctcttgctcatggctctgtgctagctctacaaacaaagcttttcatcaagcttcaataa

SEQ ID NO: 39888 - DNA, 843 bp, Glycine max
  Peptide Sequence Number=SeqID_131573
atgttgtgttgctcacaagactctttaaaagaacaaacgattcagggcaacattgttccgcatagtcgtgatgacatattgaacactactattggccgaccagagcatctaggtcgtgtatgtgtcgcggggacaggtgtcataattagccagtactttggtcaggcctcacatggctccaacacttcctctgcatcaatctcccaacaacaattggttgaaataatcggtaacctcaaggaagaagggaggaaagaagtagaagaggaaaacaagaaccttcaggaagcatggaggaggaagctagtggcgttaggaagagtgtatggcagctcgtccaccatacacaatgtcccttatgcagatgatgtgattaggattaagtttgtgaggcaggccattggcacattcgtgggatggttgacatatcttgtaaaacctatatctgatgagccaattgagttgtcgtgggatgggacgaaatttgggatacctaatggaagtagcttgaattccaacttcttaaaatgggcttcttgtttcattggcagcaacaaatcatctataaaggctgaaaaaagtccacaagtcatttttgtggatgtcgatcatgttgttagggtatacatgggagtactctatgacatggatataagaggaaaacccttggcatataccccattttgtgataataataaggagatgggtggatataggttttggagacaaaagttccgagaaactacagctggagataatcttagagttatatatgaaacactagccaaggatccaaatagtctagccaacttggatcagatgttaaatggatcatgggtatga

SEQ ID NO: 39889 - DNA, 1005 bp, Glycine max
  Peptide Sequence Number=SeqID_131574
atggaggaaccatcgaagaagcgaaagggcacttcgagtcggagtcaacggcattccgggtcacaggaaacgccaatttcttcctccattccctctggatcattgttttcatcagaggaacaacgtatacggtacacaaacctatttttctcttgttccattatagacccaaaattcatagatatggatttcttctcaaatgagagttttgaatgctttcaagcatttgaaaactccaatcttattccattcatgtctctgaaattacctgtttattctgatctagtcaaagccttttattctaatatagaaatccatgaaggcaccctaatgtctgaagtttatgggattaaaatggtcattgaccagtccctattctatgatttaacccaattgccaagcgaaggtgtaccatttgaaggtgcactgattgacgattggaagtttgatttctctgtacatgatgcccgtcggttggtttgcaccaaccaagcggatatgaccggaaggctacttggcggttctttggcttttgaaagccgcatccttcattacataattgttcgcatcttgcttccgagatcttttaaccttgctcaggtttctgaagaagatctcattgttatgtgggcctttcataaaggtttacaaattgattgggcacatcttgttagatattgcatgcataaggcattgcgattgaatgctccattgccttatcctcatcttgttacccttttccttcaacacttcaacatccctcttgattctgaaccctatgttggtgaagaaggacgtgatggagaagattcatctctcctttcaaagattttggacaggtttgatggtcttcaaacctttgttggtgaaaagtttgacactttggaattacaagtgaatatgagcttcaatgaaatggagtcaagaatcacaaaggttgaagaagatgtgtcttacattcgttcaagctttgatcttccaccaccgccgccaccatcatcttag

SEQ ID NO: 39890 - DNA, 237 bp, Glycine max
  Peptide Sequence Number=SeqID_131575
atgtgtttccatgaagaaaattcaagccgaggtgcttccgtaacgcatccgagatgtttccgtgagcaaatccacaaagattttccgccgttcttcaccggtcttcatccgttcttcgttctttcttcagtcttcaaccggagcaaaagctccgcttttgtcgaccaccccaagagatcgttaatggtccaacaccttaacgtttctctccttttcaaaaatcaaaagatcgcttaa

SEQ ID NO: 39891 - DNA, 516 bp, Glycine max
  Peptide Sequence Number=SeqID_131576
atgtcctgcccagtgatcataactccgaccttcctctgccgaaatgtcagctggtgtatgccacccaccaggcaccctctagacccagataagtctaacagggccctggggtttccagcattgatcacgggcctctgctattcattcggggttcccgtcacacctagtaaggtgacccggccaccgatcacccgagccttcattgagaagtattgcacgcctaggcaggcgcagggtgatgcaccgcaggctgcacatgcaccgccaccacctcatcaggctgatcctgttgggtcattaggcatggagcgcctcagtcagcagggcctgggtttcgttccttttgcgtgccctactccagatcagtttaggactgaggtcgcatggcccggagattggcccaaggcccaggcggagaaaacgcctgcaggagctcccgacgatgcagaggaggctcgcatggatgaagagatgacggacttgctcgatttcttgggaggaagcggagccgcgtga

SEQ ID NO: 39892 - DNA, 384 bp, Glycine max
  Peptide Sequence Number=SeqID_131577
atggcatctatctctcctgtgcagagacttgatatattggaagctttagaggattcagtaggggatttcagtgatatgggaattactgatggcatctttaatgcacgtcgtgatttcactgacgctgattatgaaatgctattggcccttgatgagggaaatcaccaacatactggtgcatcttccaatctgatcaatagcttgccgcagtccaccatccagactgacaacttcacagatgcatgtgccatatgtcttgagactccagtccaaggagaaattattcgccaccttccttgtttgcacaaatttcacaaagattgtatcgatccttggctccagaggaaaacatcatgcccggtgtgcaagtcatctatcacctaa

SEQ ID NO: 39893 - DNA, 111 bp, Glycine max
  Peptide Sequence Number=SeqID_131578
atgaggaagcccaaatgtgcgcttagcgcgaaagctctcactaagcacaaggaagcagaaggaaaagacatcaagtctcaaagctatccaaagcttgggcttatcgcttag

SEQ ID NO: 39894 - DNA, 114 bp, Glycine max
  Peptide Sequence Number=SeqID_131579
atggctgtgcagaagacgaaaacggagaagacgaaaggggagaagctgcagaagaagaggaacgagcaagaagatgcggaagaagtaaatttgttcttctttggtgaattttga

SEQ ID NO: 39895 - DNA, 725 bp, Glycine max
  Peptide Sequence Number=SeqID_131580
tgcatttggacgcttttcgagacttggctcattgtgggagctatgcttggggagctgtcgcgctagtgcctatgtatgaccagttaaatgaagcttctcagagcactacacgacaaattgctggtgtgcatgactgtgtcactgatgatggctacaatgagacgtccccacgtgcctgccagtggcttactacgaaggcttatatgaagggattaccagcatcaccgtaccagacacgtatagatgctttgaggatcactgacgtgtgctggatgccttatggtgatcaccaaggagttagggcgtttgacttcatttcatgcttccaggagagggtggtgcgacagttcggctacgttcaaaccatccttccactgcctattagtgtgaccttgtcatatgaggatattgacgacaggtggatgcacttctcggaccatctagcactcattggtcagatttgtcttgtgcctaggcaggtttcaagagactacatggagtggttcttcctgatatcttatccgttcatcacacccacacaggcagtcggaccaatggtagcaaaaggtggaccgtcacaggcatctgatccccctagacatgcaatggatgcttgtgaagcaatcgcagaaagattggagcgtgtgctcaacctaaggatggtcacctcagatggaaatgtgtatgttagggcgcgacgaagacgatgcacaaatcattcatag

SEQ ID NO: 39896 - DNA, 726 bp, Glycine max
  Peptide Sequence Number=SeqID_131581
atgactgttacaggattaagttcttttattgcatgtttgttggtgacaggtgacaggggacttttatatgcttttgcggaaaggtggcacgaggaaactagcaatttctatctacccattaaagagctggctataatccttgatgatgtggcatccttattacatctacccattataggttgcacactatttgctaacaagagtgctacacatatcagtgtggtattcttggatgcatttcatgaccttaatcaatttggagggttttcatgggaagtggctgcactagtccatatgtataagaatctaaatgcagcgtccaagcatttgactaaacatcttgtaggatatatcactctcttgcaggattaccatgagaggaaatcacatgcttgtcgttggaagtgtaggaaggcattactagtgacgacctatcgtaagtacttggataggctgacaccaaatgttgtttactgcgtaccttatggtgatcactatgccttcaaagaatttgagctcatttcactattttctagacatatcaaatgggatttatctattattaaacaccaaccggagagggtattacgacaatttggttatgttcagtccattcctccactccctactactccatctctatccacaaaggaaattgactatagatggcttcagttttctcaataccttgcaccggttggagagttttgtagtttttctggttga

SEQ ID NO: 39897 - DNA, 636 bp, Glycine max
  Peptide Sequence Number=SeqID_131582
atgaaggcttcagaggggacccttactcaagcacaacctatcactttgcaccttaatacgcttggacaacatgctgaccttgctcaatctcacctgtatggtctcctacatgatcatatgcccctcgttgcagacacaatagaacccactcagccaatggttgaggagaggttcaaagttgttgagggtagtaattatggcaggacggaagcggcagatctttgtttggttctcgatgtaatcattcctctgaagcagtacaactacaacatcgacttgactcctgacagatttgagttgcagaacatgtcaaagaaggaatgtgaaacattcaaggaatctgcagagacgcgagttctaagcgaaagcagttctgagagcttgagatgtgttcgtgagagattgaggttttcggactatggaaagctaaatcctctgttggatcttccctggtcattcaacagtgggaactggtctgattctaaagtccttgatagtgtgggactaagttgttgtgctatcacgaggaatcggggaatctgcggacaaggcttgatcaggactaggctaggctatcatgaggaatcagggtctagcagtccaggagacaacataggaacacatgagcattgttaa

SEQ ID NO: 39898 - DNA, 264 bp, Glycine max
  Peptide Sequence Number=SeqID_131583
atgaagctggaagagactctagctaaatttatgcagttggcagagaggccgtcaagtagctttagtgctaacattgagaaaaatccaaaggaagaatgcaaagttgtaatgacaaggagcagaatggcaattcaagctgatgaaagtagagttgaacagaaggtggagggatataaacaacagctggcaactaagccggcactggaaccagtttctaatcttattaaacttgaggaggttgtggaagacgaagatgaccaatag

SEQ ID NO: 39899 - DNA, 333 bp, Glycine max
  Peptide Sequence Number=SeqID_131584
atgatggaggccatgatgagtatcagaaggatgatggaggttaataggactatagttgttgccgtaagggggcgaagtgttgggaagtgcaggcagcccccattttgtgcaggttcagaacaagcattccttttcaatcaagtaaatcgtctagcctcggatatggtaggtcagggaagcgaagtgttgggtagtgtaggcagcccccattttgtgcaggttcagaacaagcattcctttccaccatatggattgccacccaactatacaccacccaatgttgtatatgctcccgatgagaatgttgttaaacaagtggcctcaataacttaa

SEQ ID NO: 39900 - DNA, 771 bp, Glycine max
  Peptide Sequence Number=SeqID_131585
atgaggggtaacatccaaaaagttgaggagttaaggggtcatgaggggtgtgaaagacgaggaacttccaaaattgaccctggcagtgtcttggacaaccgtggggagaataatgatgacaatgcggataagcatgtagaaggcagtgacagtgacacgaatgggtctatggtagttgctaaggacaatgtggaagcgttagaggagaaggatgatgacaccgatgttgaatatcatggcttcgatgatctcgattatgctacaaatgctctgaagttgttcaaatttgaggttaggtttggatttttggaccagtgtataattgtgaatgaagggaatttgggtattgcaaattgggtggtggcttttagttttgagaggagggaaaaagggtcgggaacatcagttagggtttgtaaggctctcagtctttctataagggtttgtatggtgttttccatggtgttgggatttgatggaaatgataagcatgcaatggagggaatcactactacaaatgttattttttatgacactgtttctaaggcgattctctatggaactgtcttagaaagtatcgcggtgacaattttttgttcttcgttctcattctccctcgacctctctccaagttcctcaccactctaccctccctcgcgcacttattcactctgctccggcgtgcgatatcgtaagtctctccctcaagcttatgagtatgaagcttgttggacatgcacgttgtcttcaaaacatttttcagttctataa

SEQ ID NO: 39901 - DNA, 1035 bp, Glycine max
  Peptide Sequence Number=SeqID_131586
atgagggagctggcgcctcaacttctagaagggcagggttactttgacctcaacatcccttaccccgaaccttcccctgccaacaaggccattgagcaaggtaaccgtacggggctggcagtgaaggccatggagttaggctacatcggaatcgcttacaaccgcatgatcaagggcatcatgtccgatcaccaccgttgctccatctctcccctcatcctctcctctttcctcaacgtccttccctctctctccctctccgccaacctccaccaccacctactccatgtcccactctccacccccttccgtcagtacacacgtctcaccgtctgcgtcgatagtgcttcccaggctcaagccctcaatttgggtaaccctattttgaaaacctatgatttggtcattgttaagcctttgaatcagatcgcgtttgatcttgcatgtgagagaatggaggatgatattgtctctattgatttctcagttaagttgccctttagattgaagcaacctgtggctgtataccacatgccaacaacagagaatgacatgccctctagaagcatccctttggctttgcaaattttattctacaagctccagtatagtgacaccagtgttgcaacaaaggagttcactaaatcttttggatgggatacatatgattctttcatgcagcatgatgttcaagaactgaacagagtcctctatgaaaaacttgaagacaagatgaagggaactgttgttgagggaactatacataaattatttgaagggaatcatatgaattatatcgaatgcatcaatgtggactataaaacaactagaaagaagtcattttatgaccttcagcttgatgtgaatggctgtcctgatgtttatgcttcctttgacaagtatgttgaagttgaacgtcttgaaggggataacaaatatcatgtggaacaatatgatttgcagattcaactgaaaagatttgaatatgactttatgtgggatactatggtcaaggttagcagcccaatagactga

SEQ ID NO: 39902 - DNA, 651 bp, Glycine max
  Peptide Sequence Number=SeqID_131587
atgaagaagaagaccaagactaagacaacatttctaccgacgaatacgacgacgtttcgggtgaagcttccaacgaggctgacgtattccctcaaattcaacgtcgatgagctcgcctccgtctacgacttccgcattgacaagtttcagcggcaagcgatactggcttttttgagaggcttctcggtggtggtttccgctccgacgagcagcaggaagacgctgattggggaggccacggcagaatgtgagtacttattgacgactgcttttcatgcagtgttgtatttctgcagtctaggatgtagctttactatagatgtaaacgaccttctatctgtttctgtggaagaaacaaccactggttataggaatgagattaccataaccaatgaccaaaaaaggctttcagctgaggagattataagaatgattcatgaagctgagaattatcaggttgatgataggaagttcatgaagaaggctaatacaatgaatgctttggatgactatgtttacaagatgaggaatgcattgaataataagaatatcagttcaaagctttgtttacaagaaagggagaaaatcaaatctgtaatttcgaaggtgacagatttgctagagggtgataatcagccgtatgaaatagag

SEQ ID NO: 39903 - DNA, 807 bp, Glycine max
  Peptide Sequence Number=SeqID_131588
atggttagaacccaaggattgcgtcgagctttagaagaagcccctcagtgtcgaaggctgacagcatctggacgtacacaatgggcagctgcagcgattgctgaggatggtgaccatgtggatcatgttgctaatgaggttcataagcagcctcaggagccaattatggatcatgtcggtgctaatacagagggttttgcaggcggaccctatgatacatcagtgttgacgtcttatgttgatcatgtggcaaccaaagtttgggcagaagaggaacgtattgagttgaagttggcctctcatgggaggaaagtagagaaatttggaaggcctgtacctgagattgaaggcatagtggctactacaagattaagttctctgattacatgttcgttggagataggtgacacgtgcttgtcgttagaagtctgggaaggcattaccagtgatgatatatcatggggttcatctattgtcaaacaccaaccagagagggtagtgcaacagtttggttatgttcagaccattcctccactccattgtgcaccaaactacatggagtggttctataggataactcaccccttcatgagtccaacacagcttgaggaccctcctagacatccaccggacgcttgccaaaagatagcaaaaagtttggaacacatgatcaacatgaggatggtcactgttggaattgatgcatacgctctgactgagcactatctaagattagccaaggatgtcactgagcaacgaaatgtttatgtgcagtccagacaaaggagggatacacatgacacatga

SEQ ID NO: 39904 - DNA, 360 bp, Glycine max
  Peptide Sequence Number=SeqID_131589
atggataagagcttgaaagtaagagaagatgagtggagggagaaaaagagaatgagcatgaaattttatgcctcaaatgagctacggttcatcccactaatcctagatcaagtccaagattctccgctaagtgtgcttaggtgtcatgagataagtgaacccaaccttggcccatgggctcataaatctaccctgaggttcatgagaaccctaggaccttcttcaacagttctagcccaatcctcttggagccttttggtcatggctcaggtgacaggtcccttcctatggaggattgcatcaacttactcttttttccttaaccttcattttcttgaccaaaactcagcatcgcactga

SEQ ID NO: 39905 - DNA, 171 bp, Glycine max
  Peptide Sequence Number=SeqID_131590
atggataccccggggctcctccatgataagcacacgttgcgttcgagtcgtatccttagagaaatggaggttgaggaaccttggctggggttatggctaccattgaattatcgagtagatatgggagtggtgttcgccattggaagtgtggtagacagactttgtggttga

SEQ ID NO: 39906 - DNA, 1449 bp, Glycine max
  Peptide Sequence Number=SeqID_131591
atgaagacattgttgccttttgaagataacccttgggtatctccgcatgccacttgtcttctcataggtcaaggtagcagaactgtgtttgtacggataaccgcttggggtatttccgcctgccacctgacgcatgggtcaggattaacagatgttgtgtttgtatggataaccacttggggtatttctgcctgccacctgacgcatgggttaggattaacagatgttgtcttcgtacggataatcacttgggtatatccgcctgccacctggatcaagagatgttgtctttgtacggataatcacttgggtatattcgcttgccacctgacgcatgggtcaggatcagcagatggtctgagaccaaaagagtctcggccagaagatgctgacatctttggaaagggcgaggatggaaagtctcatctcgggtcaaggtttatggtaagttgggattttggctcaaagcttgtagaacggctggacatgatatatgtcaggggctcaggactcaagcatcaatttatgcattcgtccgagtccattttgggtgttcggaaaattccacagcattcacccttcaaagattatgagcaactaggcgtgttcaaccgtggcttaagaaacatagtacctgctcgtacctgtcccggtggtttggtgcctgctggtcagccatgtatcgtaggcaatcctttagcctttgaagatgagctgaggtggattctggaggtggtggcggtgcgtctaccgccagctgttggccgtccccaggctaccgtggtgcctcgccctgtaattgcctggggacgcatggtcatgttggtgcgcatgatccgcactcgtctctttgcagcggcccgggcgaaatcttgccccggtagtagctgcatgatagcctcctcctctggttgtgctcgcacagttggccctcctccagaatcaacggggcagaggaccttgaattctcttaaggtgcggatgtggagcccactaaaagtgaggacgcgtagccctctaaaggcgagggcgtgtagccctctgaagtcgaggacgtgtagccctctgaagtcgagggcatgccgctttttgaagtcgagggcgtgccaccctctgaaggcgagaacgtgcggtcctttgaaggtgagggcatggtgccctccgaagttgaggacgtgtggccctctgaagttgaggaagtgtagtcctctgatggtgagggcgtgtagccctccgaagttgacggcgtgtggccctctgaagcctatccctcttaagattattgaggccacaaggtccaacagggcgtgcagccctctgatggcgagggcgtgtagccttatgaaggtgaggacgtgtagctctctaaaagtgaggatgtacagccctgtggaggcgaggacgtgtagccctgaaggggtccaaccttatgagaaagcaagagattga

SEQ ID NO: 39907 - DNA, 510 bp, Glycine max
  Peptide Sequence Number=SeqID_131592
atgggcttgttcatagttgttgggcaaaatattgtgcttgcgggcttgggaaaagtgttcgagaattcatccatcatacacaatgttcattatgcaaatgacgttgttaaggtgaatgttgtcagaacatacatgcctcatactgaggtccctattcctacatcagaggttcggattcttgagcaggtcgttggcacattcatcgcatggccaacacatcttgttcggaaagtaactaatgaggtggtcgtgggacccgataagtcaccatcgaagtctgttggagagccgaacaggttcacttctgtggccacagatgacccactaggagaattggttaagaagtcatatgtggtttacacaaagccaatggagttggcatgggacggggcgaaatttgggttacctaattccacaaatggttttttcatcacacatgcagatgtgactaaaatcattttagggcacattggcaacttcttgtgttgtgtccacaagagaacattgtag

SEQ ID NO: 39908 - DNA, 190 bp, Glycine max
  Peptide Sequence Number=SeqID_131593
atggggcaacaatctttgatctatagctttgtggcccgtggcaccatgattcttgctgagtatagcgaattttctggaaacttcaaaaccattgcctctcaatgcctccaaaagcttccttcttccaacaacagattcacctacaattgtgatggccacactttcaattatctcgttgaaaatggagtca

SEQ ID NO: 39909 - DNA, 168 bp, Glycine max
  Peptide Sequence Number=SeqID_131594
atgccaccctttaactctactgctctgcaagtctgccaaacctccatatttggagatgtcagcccacttgacccaaggaattctgttatggtgttgagttcccccccccccccacagaaactgcctttggagggtcaccaacttatccacttatcctccccttcttga

SEQ ID NO: 39910 - DNA, 546 bp, Glycine max
  Peptide Sequence Number=SeqID_131595
atggttcatgttagcactacccaccagcacttccatcttgttgctttagttccagcagcagacccacttacatgttgcagaaaatggtccttgggattttgtgggaatacaccccttgtgtttatccattgcaaagactcccaccataaagggagagttttgttgcagttgaaaaacagatgtgctgcagtctcctcggaggtgttgcatagagggcaccttaggtcatttaactccacttgtctacttctcagagctctttatggcctcaagcaggctcccaggcaatggtttgaaaggcttcagactaccttacttcagtttgggtttgtggcaacatcttacctctcagttgaactcaaaattctctctctaacagcttggtttgttagattactttcttggaatagaggtgaagacactctggctgacaaatcaattctgcttactcaaagcaaatatatcagagatttattgctgaaaaccagtacggcagaagctcaatccattgcttcccctatggcttctagttgcaggctgacataa

SEQ ID NO: 39911 - DNA, 388 bp, Glycine max
  Peptide Sequence Number=SeqID_131596
atggcttccgcatctcaatgtttcagttcacattcatttccggcaacgatagctgagaaattggatgattccaactatctacactggcgacaacacgttgaaccaatcattaaatcgcataagctgcagagcttgggaagtgcaggactaaacgttgcttgtttgacttcaatcgacactctcgatgtctgccctttctcgcgtgctaggctcaaatcactcctatcagggaaaacaatggatgagtaccttcacaaaatcaaaggctacgtcgacgagcttgctggcgttggatttctagtacgacatgaggagcatgtcggtgctattcttgaaggtctaccttcggattatgcaccagtagtttctgtgattgaaagcaagaaac

SEQ ID NO: 39912 - DNA, 321 bp, Glycine max
  Peptide Sequence Number=SeqID_131597
atgccattgtggtgggagttcaactcttgggtcaaggaagacagagtcttgcattgtaggcctggggacaacttcactccacacttctccttggctgcttcgagggcttctaatagaaagtggaagatttggtggatagcagcaacagtatctatctggaactctagaaatgatatgatctttaaaaatcaaccgtttgttatctctaagttggtggataatgcaatctttctcacctggtcttggttgagggggtgggagaaggactttgctgttccttttcagcaatggtcctcatccatgtctcttgcctttatctag

SEQ ID NO: 39913 - DNA, 243 bp, Glycine max
  Peptide Sequence Number=SeqID_131598
atgggaaagagtggtgttgtagatctagagtgcacaacactggatttggccaaattgacccctgggatagtcagaggagacactgacgagctgttctgtgctagtgccaaagagtggcctacacatgctagtggaggaaaggcactcctcctggtacaaccacggctcccgaaggcagcaatgacaaggggagtgaacagaggcatgctgatatcaagcagtggaaatagctcccaagattag

SEQ ID NO: 39914 - DNA, 444 bp, Glycine max
  Peptide Sequence Number=SeqID_131599
atgtgggtgtcccttaaagctttgtgggaaaccaacggttggaggccaaggttggatggtgaagttaatgtgtggagtcacaatcttgaattagccaagtcattagttgggcacccatacgctagtcaattgactaaggacgagaagacaattattgttgatatgacaaagtcaatggtgaaaccaagaaacattctactaactttaacattgtgtttggatggagcaattaaagaattaaaattccccatccctctcttccactgtcagccactcactcacgcagcaaacgctctctttcgcttttcccctctcagtcactctctcttcccctctcagtcactctctcacgctcttcccctctcagccactgtctcacgctctcagtcactctctcacgctcttatcctctcagccactctctcacactgcagacgcaactaa

SEQ ID NO: 39915 - DNA, 1203 bp, Glycine max
  Peptide Sequence Number=SeqID_131600
atggttagaactagaggtttaggtcgtgccatagacagagatataggaagagccctagggagagaggataatcgtgattcagatgatgttccccaacgacgacggcccacaacatccgtacgtaggcaacaagaagttgtcgttgttgttaaggatgctcctcacgtggatgacacagttgaagaggtattccaacatgtcgaagaagctgttgatgacgtcgagggttttttaggcggaccgcgtgacccatcagtgttgactgcctatattgattatgttggagtcattgtttggaatggagaggagaggtcaccatcacccctcgatgatgtggcctctttgcttcatcttcccatcataggtgcattccacaactctgacactcttcatgtcgacgaagcggtgttgatgttagtcaagttacttgaagtcactagagatgaaactagagctgagacaatacaatgtcctgaggcatacgcatgcctatcgtggctacgagagatttatcatagtaaatgtgaggccggacattggactgtagcagctcgagcttatttgctgcatttgttaggttgcactctttttgctaacaagagtgcaacacatgtgcatgtggtgttcttggacaccttccgagacctcaatcagagtggaagctatgcctctacgaaggcattaccaacatcgacttattggaaacgtctagatcgactgacgactgatgataccattcctccacactctctgggatcaaggttatcgttcaaagatattgacgacaaatggatgcatttctttgagtaccttgcaccggtggaccaaatttgtgttgtgtctggacaatgtgcactagactacattcacaggttctacatgatttcgcatccattcatgacaccgacacagcccagggatccacccagaaatccacctatcatgcaagatgagacatatgtggaaccagatatgcatgagttctcagtggcggcaacaactatggaggaagcacctgcacatgcagtggcttgcaaagcaattgcaaaaaggttagagcggttgctcaacctaaggataatgactgaaggcatagaagcacacgatgtcatgcaagattgcctaaggatcgctaggggtgtcactgtagagcgcaatgtttttgtcaggttgcgacgaaggcgacacacaaatcacgcttga

SEQ ID NO: 39916 - DNA, 799 bp, Glycine max
  Peptide Sequence Number=SeqID_131601
gcttagtggctgccacaggattaagtcatctaattgcatgttccttagaactggagacaggggacttatatttgcttttgtggagaggtggcataaggaaactaatagtttccatctttcggctcttcatgtagaccaagtcgtggacttgttagttgacttgcttgaagtcagtttagaagaagaaagagttgagacattgcaatgccatgggacatatgttgcacggtctttactaacaagagtatcacacgtgtacatgtggtattcttggatgcatttcgtgacctcagccaaacaggaagctacgcatggggagctactgcactcgttcatatgtatgaggaatttgaatgatgcgttaaagagaagcgctcgacaacttgcaggatatatcacacttttacagtgttggatctacgaacattttcctactgttgcttcttctattgttgctgaagattatcatgaaaggaaatcaccatactacatcgagtggttccacttcatatctcatcccttcatgagtccgacacaacctagggatcctcctagacatccacctgtggtgcacgatgatacgtttattgaaccaaatcctcctcagcagtcagtcgtcgcagcggctatggtagaaccacctgcagctgcacctgttgatgaggcttaccaagcaatagcagaaaggttggaacgcttgatcaacttgaaggtagtcactaaaggaacaaaagtatacactgtgattgaggagtgcataaggattgccaaaagtgtgactgcgcaaggaaatgtttat

SEQ ID NO: 39917 - DNA, 258 bp, Glycine max
  Peptide Sequence Number=SeqID_131602
atgtctgaagaagttgatatgaatgaacaaaatgaagacgaagctagtgtgaatgaagaacatgttgattgttctgatgcgttcaatacttctctgatgatgttctgcattgagctcgatctgttgcttatgaaattggattttggtcagtataggtataggaagaaagattttgtaagaagagatactgacaataggaaatgtgggtatccctttaagcttcgtgggaaactagtggttgaagaccaaggatgcatg

SEQ ID NO: 39918 - DNA, 657 bp, Glycine max
  Peptide Sequence Number=SeqID_131603
atggagtgtcatttcatactccaacctcgcccccacctctcacacgtccgatctgaatatggacagggcgagacagatttcacagatggccctgtccaactcctctcggctaggattccctgcacttattacaacactatgcatcgccagagaagtggaagaattgatggaacccggatgatcccacgatcacatttccggacccgcaaggcttgggctcaaggacctatggacgcttccacttttgctccttcctcctctactcccacacctgctccagcaccaccagctcctccactcagagcacaccatggcttatgtctgcatggaggatttcatggctcaggtggcctggccaggagtccatccttctcctttgggggaggtgaggctcctatagcccaagagccgcagccagagtcggaggcgacactcgaggccacacctgaagagacgcctgaagacacccctgctgccacaccatctgaggcacctgaggagggagatggcgctgcagacacggattatgttgtagacatggcagcaacgcagagctcctgggatccctggcctattccagcaccggatacatcactaccagcccccgatgccccctccacacctcaagataatcctacaccggcacaggatggctga

SEQ ID NO: 39919 - DNA, 426 bp, Glycine max
  Peptide Sequence Number=SeqID_131604
tccaagcagttattggacgcttctgctggaggaaaaattaagttgaagactcctgaagaagcaatggaacttattgaaaatatggttgttagtgatcatgcccttttgcatgatcggactcatgtacccacaaagagaagcctgctagagctttcttcacaagatgcattattggcacagaacaaactgctagctaagcatctagaatcactaacagagacacttagtaagctaccaacccaattgcaagcgactcaaccttcacattcaacagttatgcaggttaccagcaaggtgccaattttaatcagaatcaagggtagtgtaggtctcatcctgggaatcaattcaacaaagaccaaggaggaccatccaacaggcctcaaaatcaagggcctagcctttatgagaggaccaccaagctag

SEQ ID NO: 39920 - DNA, 534 bp, Glycine max
  Peptide Sequence Number=SeqID_131605
atggcgttgctacttagcaacattctgcccaacaaccacaatgcgatctccccctgtagaagtattagttgggatcgtgcccacaagacacccagtggacccggaaagtccaacagggccctggggtttccagctctagttacaggcctctgtcagtcctacagggtgcccgttccccctagcaaggaatcgctcccacaaagacacccagtggacccggagaagtccaacagggccatggggtttccagctctgggatcgcgcccgcaagacacccaatggacccgaagaagtcccacagggtcttggagttgccaagctctaattacgggcctttgtcaattctacggagtgcctgtcgcccccagcaaggtcatcaggccccctactaatcgagctttcatcaagaagtactgcgtccccaggcaggcacagggcgaaacaccacaacaacctgaggatggccggcagcgggcaacagacgcaccgccatcacctctagagttcacctcagctcatccacaaaaaggttag

SEQ ID NO: 39921 - DNA, 140 bp, Glycine max
  Peptide Sequence Number=SeqID_131606
gagatcgtgatgaggacacaactaaggacaaggaccatgaagcacttgaagggcccatgaccagaggcaaacttaaacaggcccaacacgtcatagagacatggttggtcatttgtatagcagccattgatgatgattga

SEQ ID NO: 39922 - DNA, 638 bp, Glycine max
  Peptide Sequence Number=SeqID_131607
ggctacacgccctcacctttagaggaccacacgtcctcacctttagaggaccacacgtcctcaccttcagagggctacatgccctcgccatcagaggactgcatgtcctcaccttcagagggctacacgccctcgccatcagaggactgcatgtcctcaccttcgtagggctacacgccctcacctttagaggaccacacgtcctcaccttcagagggctacacgccctcgccatcagaggactgcatgtcctcaccttcagagggctacacgccctcacctttagaggactacacgtcctcgccaacagagggttgcacgccctcaccttgagaggacatgccctcacctttagaggattacgcatcctcgccatcatagaactacactccctcgccttcaaaaggcgacgcgtcctgaacttcagagggctacacgccctcgcctttagagggctacgcgtcctcactttcatttctgggccaccccctgatattggaggagggccaactgtgcgagcacaaccagagagggaggctatcacacagctactatgcatattggggcaagatttcacctgtgccgctgcaaagagacgagtgcggatcatgcgcaccaacatgaccactcttacatag

SEQ ID NO: 39923 - DNA, 483 bp, Glycine max
  Peptide Sequence Number=SeqID_131608
atggctattctttttacacaaggtcacaggatgcaaaaagtatcgtgcagaacagtggggttagtgttgagactcatgacaacacccccaaggttcactccacattcagatattcctttggatgctatgtctaggaggcctagacaatccactcggctgagaaggttgactgttcgaaccttggatcagccacagcctatagttaatgtcaatcctaccattgggagaggatcaggccctcataaagaaaagtttcataaaactttaaagaatctaatatgggatgacattttgggcaaatttgacatccccgagggtgacaatgcgaaaaagaaggtgatgccaacggtcgctactcgctggaggcaatttaagtcctccctgacaacaaaatacatttatgctaatagtgagggtcaagcaaaagattatccttctgttaagtatggtattgatgcaacgacttgggccgaattttgctaa

SEQ ID NO: 39924 - DNA, 240 bp, Glycine max
  Peptide Sequence Number=SeqID_131609
gtgctgacgattggttcctgtgttgcctaccctacccaaacggtattcgtgtggctagtcagaccccattccatcccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttagttag

SEQ ID NO: 39925 - DNA, 144 bp, Glycine max
  Peptide Sequence Number=SeqID_131610
atggccgaccagcaggttaccaagtccaaagccaaaggacgcaccctagttgctcatgatcctgggaattttaaaataaaacaagcgcaagctcggaaggtagtggaaaataccttagatatgcatgtagaaaagataccttag

SEQ ID NO: 39926 - DNA, 240 bp, Glycine max
  Peptide Sequence Number=SeqID_131611
ctttaccaagtaacacaagttccccaagagtttgatactcggttcttactgttttatactacttgtgcgatccggtgcacttgccaggttcaaacaagtttttggcaccgttgccagggaacttctttctatttggaaaacttcatgacatatcaagctggctctaaaggtgatggctattcaatgcaacagcaggaaactcagtttgaaaaagactattcttttgcagattatcaatga

SEQ ID NO: 39927 - DNA, 213 bp, Glycine max
  Peptide Sequence Number=SeqID_131612
atggttacttctatgcttcaacttgactcgatgaaccttttcgtaaaaacacgagcttggttcaaccccataacccagggaatggcaattttgatcgccaatacttcaacaacatttcatagggatgaaagactcgagaatacgcatgctacgcatggaaaatatgcgcaaaagcgcaacagggggatgcacagagtacgacaatatccataa

SEQ ID NO: 39928 - DNA, 345 bp, Glycine max
  Peptide Sequence Number=SeqID_131613
atgtggaccaccacggcaaaaataggggagaagattgcccgcccagctcgcccaggcgagcaaggttgcttcctccagaagcaacaaccttctggaggaatcttctggagggcccaagtgggcctgaagttacggaaacccacggattgcgcaaaaacacctttcttcgacttctgccacattacggaatttcacggatcgtgcaagcctgcttcctttttgatttttgagacgtcttgggacttcatttattggatgtcatcaagtaataatccccggacgaaattagggtatgacacatgcaattatccaaagagaagaataaaatgtaacctgaacaattag

SEQ ID NO: 39929 - DNA, 210 bp, Glycine max
  Peptide Sequence Number=SeqID_131614
atggaactttacgaattacgtaacgatacttgttttctttccgtaatgtcacgaaaccttacggattacgcaatcgtcccttctttggcttctgaaatgttacggaactttacggattacgcattaacgcttcctttcgactcccgacatgtcgcagaacttcacggatttcctaacaatggtgtcaagtacctcgaggtggtcaagtga

SEQ ID NO: 39930 - DNA, 378 bp, Glycine max
  Peptide Sequence Number=SeqID_131615
atgtccatttgcagctttgggttctatggccccaatcacgtctattccctacatggaaaacggccacggtgcggccaagacattcagaggaaggggcgaagcgttgacattgtctgcgaatgtttggcatttgtaacatctcctcacatggagacagcaatcgctctccatggtgagccaatatatgcttccgctcatgaaaaagccggccgccaatctcctcaatgtccttttgtcattgtcggaagcctccgatgggtactctttgctttcaacgtatcacttgatatcgaaataccatggcttaccgtcccgttcctcttccacctgacaacaatgtgcggatctgccacgacaccagaactcaatgtacggtag

SEQ ID NO: 39931 - DNA, 510 bp, Glycine max
  Peptide Sequence Number=SeqID_131616
atggttatgggagatttcatcagcagactctccttccccggtagacgcattgtttttcactcaagaaaaaaagagagcatatgctgctctaaatcagttggaatatttgtctctttgctgaagcatgtttgcatttttagcgaagaaaacactgagactctttcaagtctcacaagttatcaagaactacgtaggtctgagttcctcattggaggatacgtaggagcaagagcctcgcttttgtcgaccacaccgccttttgttgccatgactcaagagctggtagcccgcggagacaccttacggttatccgcacctcgtcattcagtgaccccaagtgtgattcacgagcagagaccaatatggtcatctgcgccctttccggagatgtcagcattttccgatggagacttttcaagtctcacaagttatcaagaactacgtaggtctgaattcctcattggaggatacgtaggagcaagagccttgcttttgtcggccgccccataa

SEQ ID NO: 39932 - DNA, 797 bp, Glycine max
  Peptide Sequence Number=SeqID_131617
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatctagctcaaccagccgatcgaatccttgtgctcgtcttgtcagttgcggttgctaatcatcagacaatcatcagctgcaaacaccatttaaaatccactgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 39933 - DNA, 441 bp, Glycine max
  Peptide Sequence Number=SeqID_131618
atgacaaccaacttctcagaatgtgtaaataagtatgaaaaggattgtcgcaacataccgataacagcgttggtgaaatcaacatatagtaggtgtcgaaagtactttgttgatcgtggtcggttgttaaagaacttcgaaaaaatcaagaacaagcttgttcgcacatcgtccgtgtctatgatatctactcgacaagatgttgtttacacaaatgagcacatcttaaaagcttactccgcacaatggtggcctcttgggaatgaagcgacaattcctccttctgaggactcatggacacttattcctgatccaactacaattcgtgcaaaaggtcggccaaaatcaacaaggataaggaatgagatggattggctcgaaccatctgagcaccgacaaaaatgtagtagatgtggaacagaaggacacaacaggcgttga

SEQ ID NO: 39934 - DNA, 474 bp, Glycine max
  Peptide Sequence Number=SeqID_131619
atggggatcgcccacaagacacccagtggacccggaaaagtccaacagggccctggggtttccaactctagttacgggcctctatcagtcctacagggtgcccgtaccccccccggcaagggatcgcgcctgcaagacacccagtggacccgaagaagtccaacagggtcttggagttgtcaagctttaattatgggtctctgtcagttctacggagtacctgtcacctccagcaagggcatcagaccccctactaatcgagctttcatcaagaagtactgcgtctccaggcaggcgcagggcgaaacaccacagcagcctggggatggctggcagcgggcaacagacgcaccgccatcacctctagagttcacctctgctcatccacaaaaaggtttgagtattgcctacaccacatggccgaccaataggcgaccaagtccaaagccaaaggacgcacctagttgctcatga

SEQ ID NO: 39935 - DNA, 396 bp, Glycine max
  Peptide Sequence Number=SeqID_131620
gtgctccagtggcttctgttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccatcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaagctgcaccg

SEQ ID NO: 39936 - DNA, 576 bp, Glycine max
  Peptide Sequence Number=SeqID_131621
ggctacacgtcctcgcctccagaggatagactacacgccttaagagggctgcatgtcctcgccttcagagggctacacgtcctcaccttcaaagggactgacatgtcctcagccttcagagggctgcacagccctcgccttcatagggcaactacaccctcacctttagagactacacgtcctcgccttcatagggctagcacgccctcgccttcagagggaacacgccctcgccttcagaagggacgacacgtcctcgccttcagaggactgacacgtcatcaccttcgagaggactacatgcctcgccttgagagggctacacgtcctcgccttcaaggactacacgtcctcgccttgagaggagctacacgcctcgcattacgactacacgtcctcgccttcagagggctacatgtcctcaccttcaaattgggctacacgctctccctcagaggactacacatccttgcctttagagggctacacgtccctcgcttcagaggactatgtcctcaccttcagagggttgcacgtcctccccttcagagggctacatgtcctcgtcttcagagg

SEQ ID NO: 39937 - DNA, 420 bp, Glycine max
  Peptide Sequence Number=SeqID_131622
atgggtatactacgtcggttgaagaccgtcgttgtctgcgacgacgtaataaattcaatggctttcaaagacgacgggcagccggtcagccccgtcttagaacttacgagagactacgacggccatggggacagcaccgtcatagacataatcttgttctacgacggttgtctcctaaggaccatcgtagaatggtccacaattctaacacggctgccggacaaccccgtcgtagaagtaacaaaagactacgacgaccatggggacatcaccgtcgtagacataatcttgatctacgacggttgtctcctaagagccgtcgtagaatggtcctattactacaacggtgttttgttgcggacgaccgtcgtaagagacggtgttaatactactacggtcacgatacaacaccatcgttga

SEQ ID NO: 39938 - DNA, 117 bp, Glycine max
  Peptide Sequence Number=SeqID_131623
gaaaatacaaggatcatgtatgagcaaacatgtagaacaaaaagtatgttgaacgtatatgatgatgcaatgacccatgcaaaatgggaatgtgataacggacaaatgcaggaatga

SEQ ID NO: 39939 - DNA, 570 bp, Glycine max
  Peptide Sequence Number=SeqID_131624
atggccaaagtactcatcgacaacggctcaagcctgaacgtgatgcccaagaacacgttggagaaatttccatttaacgcctcccatctaaggccgagttccatggtggtccatgcctttcgatggcagccaccgagaggtaaagggaaagatcgacctcccagtacagatagggcctcatacctgccaagttacattccaagtgatggatatcaattcggcctacagctgtcttttggggcatccatggatccactcagtgggagtcgtcccctccacactccaccaaaagttgaagtttgtagtggaaagacatttggtcatagtatcaggcagccccgcctatccgatgcggcaatgatggtggcctgggtgatgttggggcacgactatgagcccagaatgggtttgggcaagaacaacggcggcaggaccggcctagtaagtgtcagaggaaaccacgggaaatctgggttaggctataagcccacgcaggctgacgtaaggaaaaacatctcaggaaggaagaacaaaggccgaggcccgcagtcgggacaacaagcccaagag

SEQ ID NO: 39940 - DNA, 78 bp, Glycine max
  Peptide Sequence Number=SeqID_131625
atggtagaaatcaaccaaggtaaagacgatgaccgctcacgattggttgcatatcattttggctcttacttgcagtaa

SEQ ID NO: 39941 - DNA, 384 bp, Glycine max
  Peptide Sequence Number=SeqID_131626
atgggaacaaatcaaaccggcaagaggttttaccaagtcaaggttaaaggcctagatactaccagaatcaaggaattagggcagttgatggaacctctccaaatgcaagcctttcgcaagacttacggaaagatcttagagttgaccatagcagaggtatccatagaagccattgcgtcactcacccaatactacgaccagcctttgagatgcttcacgttcggagacttccaattggggaagaaaaccatacctttcctccgggtgtctcccctctttgagcagaattgcaactgtggtcaaggattcagcgagaggtttggaccgcataaaacagactcgaaacggcatagcgggcctaccatggaagtacctaaaagataa

SEQ ID NO: 39942 - DNA, 1314 bp, Glycine max
  Peptide Sequence Number=SeqID_131627
ttggaagatccgctggggatggaagtaggctatcggctgattccgatggtcgattttcaacagaacggcgagctgctgggccgtatccgcgggatccgcaagaaattcgcgcaggacatgggttatctgccgccggtggtacacattcgcgacaacctggaactgccgcctgccagctaccgcatcctgatgaaaggcgtcgaaatcggcagcggtgaagcgcagccgggccgctggctggcgatcaaccccggcaatgccgtgggcgagctggcgggagacaaaaccgtcgatccggcctttgggctcgaggcggtgtggatcgacagtgccttgcgcgagcaggcgcagatccagggctttaccgtggtggaagccagcaccgtggtggcgacgcacctcaatcacctgatcggccagttcgccagcgagctgtttggccgccaggaaacccaacagttgctggatcgcgtgtcgcaggagatgccgaagctgaccgaagacttcgtgccgggcgtggtatcactgaccacgctgcacaaggtgctgcaaaacctgctggccgagcgcgtctccatccgcgatatgcgcaccatcgtcgaaacgttggcggagcacgctccggcgcagagcgatccttatgaactgaccaccgtggtgcgggtggcgctgggccgggcgatcacgcagcagtggttcccgggcaacggcgagattcaggtcatcgggcggcggcggtctggagccggggctggccgatcgcctgctggagcaggcgcgccaggcgctgcagcggcaagagatgctcagcgcgccgccggtgctcctgccgcagctcgtggtactgtccaacctcgagatcaacgacgatcgccagattcgcatgacctcgaccatcggagccgcctgatgaaacgctgtctgttcgtgctgtgtctgctggccccgttgactgccggcgcggtgtccggctcttgggtggccgaaggggcgggcgtgacgttggaacagggcggcatgcgcgatgagtccgccggtttgcggccgccgaacgtgctgccggacgccaatgcgcgcatcacccgcgtcagctggcgctaccgtttgctggggccggagccggccgggctgcaggcccagctctgcacggtaaaccgctgcattgcgctcggcggcggcagcggcagcagcaacggtctgcagggcgaaccggccaatgcggaattgcgctttgtctattacgtgcagtcgcaaggcgggctgaacccgccgctgcgggtgattggcaatcaggtgatcgtcaattatcagtag

SEQ ID NO: 39943 - DNA, 216 bp, Glycine max
  Peptide Sequence Number=SeqID_131628
atggggaacaggaaaatatccgttctgcgcagcctggcgcatagcgttaagggaattcagaaagcggtaagaagaaattgcgagaggctgcgcataaccggggaaacccgcgcccggcgctgccggcgtgcgactggccgtccgggccatacagcgatttattgttcttgctcaggatcgccagcgcctgagcgttatggtcgatctgctgattga

SEQ ID NO: 39944 - DNA, 351 bp, Glycine max
  Peptide Sequence Number=SeqID_131629
atgttacgattcacaagcgattctcctcaaatttcagccaaccagcatcaattagactttgcaccttacgctttagggccctacaatgctcaatggaatgccccggggctcctccatgatatgtacatgttgtgttcgagtcgtatcctcggagaaatggaggttgaggaaccttggttggcgttatggctaccattgaattatcaagtagataatggagcaagtcagcataggacaccgaaatttggggtgaatcctacaagcttttttgctgcaaaattccttttgtttttcgctaagggtggtgttcgtcattggaagtgcggtagacaggctttatggttgatttag

SEQ ID NO: 39945 - DNA, 689 bp, Glycine max
  Peptide Sequence Number=SeqID_131630
cccaagaagatggacaaccattagtggttaaagagaagtgtaaggaggtaagtgtctcctacaagaggttagctaagaaggaaactcattttacaataaagacaaacattaaagaaactttccctcttagacaacctccacattttctcttttgtaaaaagacacttgctagcattgccacacctcttgggcttgagtttattcctcaagtaaagaagttgttggatgagggtttggttcgcaagagcttaaatccttgtgctttgttggtgcccaaaataggtattattaggcaccaagtccctaaaataggtggtatgatgaatgttttgagtggtgcaaccctcttttgtaaaatcactcgtacacctaacatcttcatggtgtgtgcacatagggacccattaggtagtgatcaagaggttcccatgaaccctaagagaataaaggtcattcttgagtggcccactccaccaacactactcattgagttggtgaggaaccatgttccttcatgtgaagatgcccaggaaatgggttttcagaccttaccttacttcaacataccaaacactactaaatacatatgggcattggatagaagactccaagtagattgtggcagagatccaagggaagaccctagggttctcatgagccttagggtagattttgagcccatgggctaa

SEQ ID NO: 39946 - DNA, 447 bp, Glycine max
  Peptide Sequence Number=SeqID_131631
atgggtgaagcagaggaggtgcaagagaagatgaaggccgaaatggaggccatgaaagagcaaatggccacaatgatggaggccatgatgagcatgaagaagataatggaagccaatgcggttatagttgccgctactagcactgtcgctaaggtgaacccgatgctcccatctggcctcaagcaaatgaatcatccaacctcaaatatggtaggcaaagatttgggaagtacggacgaccccatgatgtgcaaattcaaaacgagcatgccttcccatcatatggcttgcctcccaactatacaccacccaatgtggcatacactctcaatgaaaatctcaataactccacacccatactcattaagagccaacaacctcaatctgatcatgcacatgtctctcgacccatggaggagacacatggaatgccccaccacaatctag

SEQ ID NO: 39947 - DNA, 333 bp, Glycine max
  Peptide Sequence Number=SeqID_131632
atgtgccaagttttgtcagacctgcagagacccctcctaggaggatgtgcaaaaaaaggcataggccatccagaagcaaaacactgccccccacgtgttgtctcatggggttatgaatatttagaacaaaagctaatggttgagaagacaaagaaaaaactggaggaagctactcagtccgaaagcattgagggcgtgattgaccctctatctcccatcaaacgacatgtgaagtggaagatggtccacaccaagaaaactaggcagatgacgtctgaggattctttggaggagcaggcgtcacagggttcatttgtccctcatggacgttag

SEQ ID NO: 39948 - DNA, 423 bp, Glycine max
  Peptide Sequence Number=SeqID_131633
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccgaccgctgcgccttatccggtaactatcgtcttgagtccaacccggaaagacatgcaaaagcaccactggcagcagccactggtaattgatttagaaggagttagtcttgaagtcatgcgcggttaa

SEQ ID NO: 39949 - DNA, 1104 bp, Glycine max
  Peptide Sequence Number=SeqID_131634
gtcggacacggccgtcagcagcttgggatcccagttgaccaggcgcttgccgcggtagatcaggccctgtttatgcaggcgcacgaaggtctccaccacgccgcgcgacatgcggtcgtccatggtgaagtactcgcgcggccagtcggccgaggcgcccagccggcgcacctggccggtgatggcgttgcccgacttttccttccactcccacactttttcgacgaatttctcgcggccgaggtcgtggcgggaaaccttctgcgcgtcgagctgtctttcaaccacgatctgcgtggcgatgccggcgtgatccgtccccggaatgaaaacggtgtcgtcgcccagcatgcggtggtagcggatcaggccatccatgatggtctggttgaacgcatggcccatgtgcagggtgcccgtcacgttgggcggcgggaactggatgacgtaaggctgaccttcggtccccgtttttacgtgcgaccccgcggcgaagtagccgcgcttttcccactcggcgtaccagcgggattcgagttcggcgggttcgaagctcttggagagttccggggagtcggtcgcggcggacgcggcgttcgggggagcggcttgagtcattacagggttccggcagacagggcgcccgcccgggggcaaccccgggatcactccgaagggttggcagtgtcgaatccccgccttggcacaggcggccgggacggcccggaacgcgctgtcaacgcagttgttccgattctcatgtccgtccaacgcaccctctcgatcatcaagcccgacgccgtcgccaagaacgtcatcggccagatcgtcgcccgcttcgagcaagccggcctgaaggtcatcgccgcccgcctggcccagctgtcgcgcgccgacgccgagcgtttctacgccgtgcacaaagagcgccccttcttcaaggacctggtcgacttcatggtctcgggccccgtgttcgtgcaagtgctggaaggcgaagacgccatccagaagaaccgcgacctgatgggcgccaccgaccccaagaaggccgccccgggcaccatccgcgccgacttcgccgacagcatcgacgccaacgcc

SEQ ID NO: 39950 - DNA, 225 bp, Glycine max
  Peptide Sequence Number=SeqID_131635
atgtcaaatgaagaattgaagttgcaggatccacgatgtcggatacaatgtcctgacatcctgcccgaaaatactggagttgttattttttcagaagaagatagatctcctccagcacaagccgttgcagcccagaaacgcaaattgctatataatcatggaggctgcacgagttctgtaccaagtccgggattgaagagttattttgtgagttttgggacttga

SEQ ID NO: 39951 - DNA, 132 bp, Glycine max
  Peptide Sequence Number=SeqID_131636
atggcttcatatggtgaagcaaaggactccattgatgaagaagatccaaggcctacaagctcttcatggagctacatcaaggaagaagaagaagaaaaggaaaaatggagccgaggcgctgcagagttgtga

SEQ ID NO: 39952 - DNA, 351 bp, Glycine max
  Peptide Sequence Number=SeqID_131637
atggaagggttagtggacctagcagcgattgacgctttcctcgcctttcatcatggcaaggaaagcctggtcgtcgccattttggccatgtatgacacattcgaccggggatgtgaaaagagcagcgcaagaattgtttgttgtgcactggctctctatgtaggcccgtctatccgctacaaggtcaccgctcgtgcgtcgaaagggaaagggagtcaagaacttcccccattgctagccaaggccaaagcagtggcggacacctactccgcccccgaggagatccacggacttctcagctattgtcagcatatgatagacttaatggaccatataattggaaaccactag

SEQ ID NO: 39953 - DNA, 168 bp, Glycine max
  Peptide Sequence Number=SeqID_131638
atggcattttcatctctcaatcacattatattgagaagatattggagaaatttaattttaaagattgttctctggtgcaagtccaagaaaagacctattaagcagaagttccgttcaacgaagtgggatctgcaatttgatatgcttaaggatagggacacaggctag

SEQ ID NO: 39954 - DNA, 498 bp, Glycine max
  Peptide Sequence Number=SeqID_131639
atgattatgaggggccaagacatttatagtagccaagatgaggctactacttcaccttcctctagtaaaagtgaagaagcaaaaggggaagaatctagtgaagagatctacctccaagaagaaggacaacctttaatggttaaggaggagtgtaaggaggtaagtgtctcttccaagaggttagctaagaaggaaagacattttgaaataaagacaaatattaaagaaatttcccttcttagacaacctccacattttctcctttgtaaaaagacacttgttagcattgccacatctcttaggcttgagtttattcctcaagtaaaggagttgttggatgagggtttggttcgcaagagattaaatccttgtgctttgttggtgcccaaaataggggttcccatgaaccctaagagaataaaggtcattcctgagtggcctgctccaccaagtgtgttaagggaaggagcccagagtatcaagaacctcaggatttga

SEQ ID NO: 39955 - DNA, 927 bp, Glycine max
  Peptide Sequence Number=SeqID_131640
atggggctggtgaatccagtacggcacagcaaactcgccagttccactgcgattacagttagaattagaagtttaggtcgtgctttaagtagagttataggaagagtcctagggagagaagataatcgtgattcagatgaagttctcaaaaggcgaaggcccacaacatccacacgtaggcaacgagaagttgtcgttgttgctgaggatgctcattacatggataatgcagctgaagaggtcttccaacagcctgaagaagcagtttttgatgcccagggttttctaggtgagccgcgtgacacattagttctgactgcctatgctgatcatgttgcagtcattaaatgtcctgaattgaaactatcctcccatgaaaggaaggttcaaaaattcgggaggtctactgctgagattgaagggttagtcgctcccacaggattaagtcttttgatcgcatgttcatttgacattggcgattggagacttatatcgccttttgtggaaggctggcataaggaaactagcagtttccatcttccagtaggagaggccatcatcacccttgatgattcaatggagatgaagccagagctgaggcagtacaatgttatgggacatatgtacgactatcatggctacgaaagatttatcataacaaatcattttccatctattgccgagacttttaccgatgaagactatgatgaaaggtcaccatgtgcctgccactggacctctacaaaggcattaccaatgttgacatatcgtaagcgtctagatcaattgacgacggctgatgtatgttggatgccttatagtgaccaccgcacatttggacttgttcagatgattcctccacattctctgggttcaagattatgcttggaagatattgacgacagatggatgcatttctttgactaa

SEQ ID NO: 39956 - DNA, 405 bp, Glycine max
  Peptide Sequence Number=SeqID_131641
atgcaatctacggaggggagcggtgttgcgaagcccaaacccttggtgatatacttcactaaaagtgcagcctcgcaaaagcccgggcaccccttaatggccaaacctgttcctttcccgtaccaaaatagtcacgcggtcccgtggagatatacacctccggagaagaaggaagaagaagtcactgacgtcagctcgctgtcagctaaagtaacaaatatcacgggactgagcggtgtgacccgtagtggtcgtgtgttcgcacctccggacctaccagtccaacccgccgacgtcaaaggaaaaggaaaagtggtggaggaacaagatggcgaagcaccccacgcttcgaataaagatatgccagcaaaggggcccccagagaaaagggatggtagaaaggag

SEQ ID NO: 39957 - DNA, 616 bp, Glycine max
  Peptide Sequence Number=SeqID_131642
atgttggtgcgcatgatccgcactcgtctctttgcagcggcacgggtgaaatcttgccccggtatgcatagtagctgtgtgatagcctccctctctggttgtgctcgcacagttggccctcctccaatatcaggggtggcccaggaaccgttaaaaggaaactacttgccccttaaccggaagggcaagtctcgcacactgaaaatgaggacgcgtagccctctaaaggtgagggcgtgcagccctctcaaggcgaggaggtgtagtcctctggaggtgagggcgtgcagccctctgctggcaaggacgtgtagtcctttcaaggtgagggcgtgcaaccctctgatggtgaggacgtgtagtcctctcaaggcgaggacgtgtagtcctctcaacggtgagggacgtgtagtcctctcaaggcgaggacgtgtagtcctctcaatggtgagggtaactagtacccaagaggtgagggcgtgcagccctttgatggtgaggacgtgtagtcctctcaaggcgaggacgtgtagtcctctcaacggtgagggacgtgtagtcctctcaaggcgaggacgtgtagtcctctcaacggtgagggtaactagtacccaag

SEQ ID NO: 39958 - DNA, 588 bp, Glycine max
  Peptide Sequence Number=SeqID_131643
atgcaaggtttgttaaatcataacaaagaagagctctacaagcgaatagtcaaatcttccttgtttattcttaaacctctatctcctagagaagtgtgtgatgaccaaatcaaaatgagagaaaagagagaacaagagaaagaaaatagtgaggcaccacagaggaataggaaaaagaagagtgatacacccaagggaaagagtgatacacacaaggagagagtgatacacatgagagaaaatttaattattttgcagaggcgagtgaagccaacttacaaaagcaatccccaagagactcaacgtaaggatgcacatgccaaagttgagtatgtgaaaagattgtatgaccaagtgaaggtgcaaattgcaaagaagaatgaaagttatgccaagcaagccaaccagaaaaggaaggaagtggtacttgaacccggtgatgatcctagacatttgagggcaaatgttttccaagaaggagggaatgatgagaatcctaaaactggtcaaatacaggctaaaggcccaagtggagaaggacgaaggaccaagtggagaaggacaaagcccccgaatggagaaggatga

SEQ ID NO: 39959 - DNA, 354 bp, Glycine max
  Peptide Sequence Number=SeqID_131644
atgaccgaccctccatcccccgtcagacgccacgtgaagtggaagatggcccacatgaagaaaacagaggagatgaagactaaggccgcaaaggaaaccgttgagaagatctgcccttttgcgggcgagcgaggcgaggctcacgggtgcgctttccaaaggaggaaagatgcgcggagtcgccaccaacgtttatttgtggaaaacatcggaaaaaccgaaggaaaccggtcaaaaagaatattccaagttcgggagttgtatttacgtttgaggaaggtcgacaaaagcggggctcttgctcctacgtaccctccatcgaagaggaaatcagacctacgtagttctttttaa

SEQ ID NO: 39960 - DNA, 522 bp, Glycine max
  Peptide Sequence Number=SeqID_131645
gcaatccatctgacttacaaccctttgaccctgagatagataggacatttcatagattagataggcatcattttataccttttgatcatcctgagcattccattactggtgaatttgtgcattctgctattggtgattttgaacatcctgatttggagcattataattttgagcattctgattctgagcattctgattttgcacattctgaaaacatggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgcaggcttttcctcattcattagagggagtgacaaaggactggctgtattaccttgctccaagatccatcagagctgggatgaccttaagagagtattcttagaaaaaattttccctgcttccaggaccacagccatcaggaaggatatctcag

SEQ ID NO: 39961 - DNA, 950 bp, Glycine max
  Peptide Sequence Number=SeqID_131646
gactacacgtcctcaccttcagaggacttcacgtcgtcgccttcagagggctacacgccctcgcctttagaggactacacatcctcgccttcagagggctagacgccctcgcctttagaggactacaagtcctcgccttcaaagggctatacgccctcgccttcagaggactgcacttccttgccttcagaggactgcacgtcctcgctttcagagggatgcacgtccttgccttcagagggctgcacgccctggccttcaaagggttgcacgtcctcgccttcagagggctccacatctgcgccttcagaggacttaagtttttggaccaccccctgatattggaggacgacgaactgtgggagcacaaccagaaagggaggctatcgtgtagctacaatgctttgtcgaggcttgcgctccctgttcctaggccaccccctgcaaggagggtgaccaactatgcaagcacaaccagagagggaggctatcgcacagctactatgcatactggggcaagatttcacccaaccgctgcaaggagacgagtaagtatgcacgtggctcaattgatttctgatgccatccactatttgcatggatcgcacccacaagacacccagtggacccagagaagtccaacagggccctggggtttccagctctggttatgggcctctgtcagtcctaccgggtgcccatccccccagcaagggatcgcgcctataagacactcaatgggcccggagaagtccaacagggtcctagggtttccaactctgattaagagcctctatcagttctacggagtacctgtcgccactagcaagggtgagacaccacagcagccaggggatggccgacagcgggcaacagacacactgccgccacctccagagcccctcagctcatctacaaaagttggagcattgcctacgacccgtgcttga

SEQ ID NO: 39962 - DNA, 435 bp, Glycine max
  Peptide Sequence Number=SeqID_131647
atggaggtcgatgatccactttatctgatgacattgaccatcccagagcttttcttgaggccttaccaagttacatgggatgtcaccgtgttcggggtctttaatccagacttctcactttacataaagcacaaagacctctctgaaatcgcacatggtggtcaatgtctcagcatatcagtgttacagttgtggattctgcatctgattgaaacaagtatgcaagcagggaattctaatctatggattcctcgagccactgtccattcagagcagacactggcagatgatggtcattgtgcccaacgaacacctagttgtctgcctaaatcaaaggctcccatgctaggtggattgccgtcaagtataatagacaaaaaggaagtactgagtgcggctactatgtcatgcactggatgtccaccgtcattttag

SEQ ID NO: 39963 - DNA, 543 bp, Glycine max
  Peptide Sequence Number=SeqID_131648
atgaccatgattacgccaagctcgaaattaaccctcactaaagggaacaaaagctgtgattatgttaatgatgaaggaaatgatgatcatagctttgattatgatggtgttgatgatggtgatggtggtggggtgatgacggtgatggtgatggtggtgatgatggtgatgataatgatagtgatggtgatgatgatggtggtgagcggccgccaccgcggtggagctccaattcgccctatagtgagtcgtattacaattcactggccgtcgttttacaacgtcgtgactgggaaaaccactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 39964 - DNA, 468 bp, Glycine max
  Peptide Sequence Number=SeqID_131649
atggcttccatgatggaggccatgttaggaatgagacaactcatggagaaaaatgtggccaccgctgccgctgttagttcagttgccgaagcagacccaactctcctagctaccgcgcaccatcctcccccaaacgcgataggacgagaaaggaacacactggggcatagcagcaacccccatttaggatacaaccgggtggcttacccttatggattaccacctaattacacgctgccagtcatgcatgatgacgagggtcacgtcctttcccccatccttgaaggggagcctcctcgacagcccgacgagggtccacgaagatcatcgagagtatgcccaaggggatgtcgatttctaccccccgatccctgtcgaggggccggcacccaacacattgcctcagcacaacctcattgcacaaccaatattcttgtccacagaaggaccacccccagcgccgaataa

SEQ ID NO: 39965 - DNA, 420 bp, Glycine max
  Peptide Sequence Number=SeqID_131650
atggagcgtcaacacggaatgtattacacgcctgcaacattttccgaatatccttcacagatgtgtcagtatccttttgcaggtcatcatactgatacttctgagacctcacattcgttcggtggtgttgcggaaacacagcctcatttttcatggcccactattactccttcacagcaacacgatgcccccattgcaacacccaacgccccatttggtccacaatggaatgtacccggagcaatacctgatatgggcgacttattaggtgttgatttgcgtcaggagttttctgcagaggctgagcaagcagaagcggggagacaacgcggcggcagaagaaatcctgatcgtcaagcgcgaagatgggatcgaccatgtgacacatcttcacgacatcacggacaccataatgactga

SEQ ID NO: 39966 - DNA, 615 bp, Glycine max
  Peptide Sequence Number=SeqID_131651
atggggagagacagcatgtggcaagctattagcaatttgttaagcgagcagcacactgacggcgctgaaatcgaactgcgcaacgagctacccggcggagagatccatgccgcctggcatttacgttttggcggaaaagattatttcgtcaaatgcgatgaacgcgaactgctccccatttttaccgcggaggcggaccagctggagctgctctcgcgctgtaaaaccgtcagcgttccgcaggtttttgccgtcggcagcgaccgggattacagttttctggtgatggaatatttgccgccgcgaccgctggacgcgcataacgcgtttctgcttggtcagcaaatcgcccatttacatcagtggagcgaccagccgcagtttggccttgattttgacaacgatctgtcgacgaccccgcagccgaatgcctggcagcgccgctggtcaacgtttttcgctgaacaacgcattggctggcagctggagctagcggcggaaaaaggactgcacttcggcgatatcgacaacattgtcgaaagtgtacagcagcggctcagcagccatcagccgcagccttctttattacatggggggtgggggtccgggaaataa

SEQ ID NO: 39967 - DNA, 824 bp, Glycine max
  Peptide Sequence Number=SeqID_131652
ttggaactcttacgtgccgatcaacgtctcatttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgattgccttgaagaaaaggaagggctggctgtatggaaaacgcaagtctggcaggaggatgagtgggcgggagacagaggcaggaaagctgcacaggcgcagggagcctccagaggttccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 39968 - DNA, 138 bp, Glycine max
  Peptide Sequence Number=SeqID_131653
atgggtttgtcaggcttaaaggagcactcaaaatcgatgacccccaaggcctatactccgaagagtccgtcagggcctctccctcctgattcaggtccaacccctaaaatcattttagcacacaggcacatctcgtga

SEQ ID NO: 39969 - DNA, 468 bp, Glycine max
  Peptide Sequence Number=SeqID_131654
atgatgaaactccataaaccaagagggggcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccccgtcagtagctgaacaggagggacagctgatagaaacagaagccactggagcacctcaaaaacaccatcatacactaaatcagtaa

SEQ ID NO: 39970 - DNA, 189 bp, Glycine max
  Peptide Sequence Number=SeqID_131655
atgaagatgctcttgatatcaaatgatcggaatggagaaagggagagagagaggagacgccacttcaaggagaagatgagtctagaagaagctcaccaccataggaggccatggataagagcttggaggaagaatgagatgaatgaagggagagggagagaagagcacgaaattttgtgctctaaatga

SEQ ID NO: 39971 - DNA, 222 bp, Glycine max
  Peptide Sequence Number=SeqID_131656
atgacttcaaaagaattgaacgaggagccatatgaagtgaaaatctcatgtacgtttcgtaagggaactggagcaggctaccatgagacaaaagattttctttctaaagaaattcgattcggaactacgatatgtccaaggtccaatatggaaagaatctcagaggtcttccttgactttgtccgtgtcaacaaacaattcgaaatgcctcgacttttttag

SEQ ID NO: 39972 - DNA, 282 bp, Glycine max
  Peptide Sequence Number=SeqID_131657
atgggaagaatcaaaagaattcttagactgtgtcgttttgaattctttgacaagggagaagggagacacaaaagaatttcaggcgataagagagacacaaaaagaattcaggcggttagtcccttggcgaattctttttggcaaaggggagaagagaatgaaaagatgaatagcacaagttttcaaggtttggaaacccagaaaccttcagaaagcttttggtacaaagaagaagaagaagttcaaagagattcaaggcttgtaaaggattgtatgaaataa

SEQ ID NO: 39973 - DNA, 349 bp, Glycine max
  Peptide Sequence Number=SeqID_131658
ttggaactcttacgtgccgatcaacgtctcattttcgccaaaagttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 39974 - DNA, 369 bp, Glycine max
  Peptide Sequence Number=SeqID_131659
atgggtctaccctccaactcctacgttggcgtgagtggtgggatgataaatggactggtcatctgtgaagctttagttgctttctttcttccgaccgatgtgaagcaacctccctactgggggaaccctctaacccactttcccctccccgtcagaggagtattgtacatttacctcaaagatatggatcggtcaaccgcagcaggggaagagaacagatgggaaataataagctcgattaaggagaggaagaataagaagagcaagctagacgtgcagaagactgaggatccttgggaagtaggaggagttgcttgtttatcaatgaacagtgaccataaagtgattcccgatgaggagaagcactga

SEQ ID NO: 39975 - DNA, 759 bp, Glycine max
  Peptide Sequence Number=SeqID_131660
atgggatcaagtcaaaagccttcgcttaaaaagaggttctatcaagtcaaaatcaagagcttagagtattatgaccagcccttaaggtgcttcacatttgaggacttccagctagtgtcgactgtgaaagagttgaagaaatcctgggatgcccactgggaggaaggaagccatatcttttctctgggttctatccctccacgacaagagttgccaaggccttggcaaatcaaggcgaatgggctttcttttattgacatcttggcggttttgatctttggagttgtcctctttccgaatatggaagggttagtggacctagcagcgattgacgctttcctcgcctttcatcatggcaaggaaagcccggtcgtcgccattttggccatgtatgacacgttcgaccggggatgtgaaaagagcggcgcaagaattgtttgttgtgcaccaactcttggctaccccatgagaggagcgccattagacgaaagcatcacgcctttcatcgcacggggttttagtgaccacaacgcgagggacaaagagcttaggggaagcagtaatgggagcatcggcggctatcataagtggctgagagtccggacacaaggattggattggctcccaaatctaaagattgtgagagacgatgaggttaaagcttcggaagaaagtgatgaggtacaagccctaaaggcagatcttgaaagagcctgggtagtcgaagagaagttcaagtccatagccatcaaagtctga

SEQ ID NO: 39976 - DNA, 1001 bp, Glycine max
  Peptide Sequence Number=SeqID_131661
atggtgaaagttggaacctcttacgtgccgatcaacgtctcatgttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgataaacaaggcgctgtgggcttgttcccgggttgccatggcgattcctcattatctccagtcacagagccgtgtgcagggtattggcagcttacacatgtgctgcagcttctcccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 39977 - DNA, 854 bp, Glycine max
  Peptide Sequence Number=SeqID_131662
atgttagctatcatcgccaagtaccaagaagagttgggtctagccacggcccacgagcatagaatcgcggatgagtatgcccaagtatatgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgcccccgaagagattcatgggcttctcggctattggaaaaacaccataactaaacgcgccgcaagggatccctatcgcaccagatccaaatctagaacgatgggtgatcaagaggagacgcaggaacagatgaaagccgacatgtcggctctgaaagaacaaatggcctccatgatggaagccatgctaggtatgaagcagctcatggagaagaacgcggccactgcctgccgctgtcagttcggctgccgaagcagacccaactctcttggcaactacgcaccatcctccctcaaacataagcctcctcaacagcccgaagaagtccacaaagaccctcaagactatgctcgaagggatgtcgagttctatcccccgatccccgaagggccggcacccagcacgttgcctcagcccaacatcgcaacacaaccaagagtcttgtccacggaaggaccgttcccggcacctgaagaaaggaggaagctcgatctccttgaggaaagattgagggccgtggaaggatttggggactatccgttcgcagacatgacggatctttgcttagtacccgatgttgttattcctccgaagttcaaagtgccggacttcgacaa

SEQ ID NO: 39978 - DNA, 195 bp, Glycine max
  Peptide Sequence Number=SeqID_131663
atggctaccattgcgttatcaagtagatatgggagcaagttagcatatgacaccggaatttggggtggtcttcgtcattggaataatgacattgttgggtttggtgggaaaattggccgtataggaatggccgtcacagcatggatctacttcgatcctttcactggcgaagaccaaatccgcaaagctttgagg

SEQ ID NO: 39979 - DNA, 503 bp, Glycine max
  Peptide Sequence Number=SeqID_131664
tgagaggactacacgtcctcgccatcagagggctgcacgccctcaccttcagaggactacacgtcctcgccttgagagggctacacgccctcaccttggttaccctcaccgtcagagggctacacgccctcaccttgaaaggactacacgtcctcgccggcagagggctacacgccctcatctccagaggactgcacctcctcgccttgagagggctgcacgccctcacctttagagggactacgtgtcctcattttcatagtttccttttaacggttcctgggccaccccctgatattggaggagggccaactgtgcgagcacaaccagagagggaggctattacacagctactatgcataccggggcaagatttcattcgtgccgcagtaaagagacgagtggctacacgtcctcgccatcagagggctgcacgccctcaccttcagaggactacacgtcctcgccttgagagggctacacgtcctcaccttgagtactag

SEQ ID NO: 39980 - DNA, 486 bp, Glycine max
  Peptide Sequence Number=SeqID_131665
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgtttcatctcaccggtgagccccttggccgctggcgagatccttag

SEQ ID NO: 39981 - DNA, 378 bp, Glycine max
  Peptide Sequence Number=SeqID_131666
atgaagcacttcactgacaccctcatcagtgccaacataagcggccgccaccgcggtggagctccaattcgccctatagtgagtcgtattacaattcactggccgtcgttttacaacgtcgtgactggggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 39982 - DNA, 366 bp, Glycine max
  Peptide Sequence Number=SeqID_131667
atggggctccgaaaaagggtgagaattaggattgccttgcgctccactgcccgctttccagtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggcggagatttcctggaagatgccaggaagatacttaa

SEQ ID NO: 39983 - DNA, 626 bp, Glycine max
  Peptide Sequence Number=SeqID_131668
atgagtgatgtggtcagcctgcacgtgccggaaacgccgtccacgcagaacatgattggcagcgaagagctggcgctgatgaagcccggcgcgctgttgatcaacgccgcgcgcggcaccgtgatcgacatcccggcgctgtgtaatgcgctggccagcaaacacctcgccggtgccgccatcgacgtcttcccggttgaacctgcaaccaacagcgatccgttcaactcgccgctgtgcgaattcgacaacgtgatcctgacgccgcacatcggcggatcaacgcaggaagcgcaggagaacatcggtctggaagtgtctggcaagctggccaagtactctgacaacggctcgacgctctccgcagtaaacttcccggaagtctcgctgccgatgcacgccgccagcgccagccgcctgctgcacatccatgaaaaccgcccgggcgtgctgaccgccatcaaccagatctttgccgagcagggcatcaacattgccgctcagtatctgcaaacctcgccagtgatgggttatgtggttatcgatattgatgccgaagaggatgtggcggagaaagcgctgcagctgatgaaggcgattccgggcaccatgcgcgctcgtctgct

SEQ ID NO: 39984 - DNA, 396 bp, Glycine max
  Peptide Sequence Number=SeqID_131669
atgaacaatggattcgaggcttttagtcctcacgggcaggatcatcttgggctaccttctggggtagagacaaaacatgaacggcagaaaccaatcaaggtacttaagaacggatgcaagtggggatggggtcacggccgaccgatcgttgccccttctctgcgcgaaacgagcagagaatgtcgctgcaaggcagccccgtatcctttgtattttgcagctttcttttactatttgtttgttttaaaaagtaaaataagtaatcaacacctaaattctaacctaagtaagttcaagttaggcaagatgctaatccatgagaagggaggggacatggttagctcgcctgggcgagctgggctcgcctgggcgagccacccctgcaccaaattataa

SEQ ID NO: 39985 - DNA, 48 bp, Glycine max
  Peptide Sequence Number=SeqID_131670
atggccgaccagcaggcgaccaagtccagggccaaaggatgcacctag

SEQ ID NO: 39986 - DNA, 498 bp, Glycine max
  Peptide Sequence Number=SeqID_131671
atggcgcctaccaggcaccctctggacccatataagtccaacagagccctgagatttcccgccttgatcacaggactctgccagtcgttcggcgtccccgtcacacctaacaaggtgattcggccgcccatcacccgagcttttattgagaagtactacacgcagagacaggtccagggtgatgcaccacaggccgcggacgtgtcgccacctcatcaggctggtccagccggatcatttgacacggagcagtatttgcggcatttggttcgccagcaggcagccaaccaccgagcacatggctttacttcttttccgtgccctactccggaccagttcagggcagaggtcgcatggcctagagattggcctgaggcccaggcaggagaggcaccagcaggggcaccagcagaggctcccgacgaggcagatgaggcccgcgaggacgaggagatgaccgatttacttgatttcttgggaggaagcggggccacatga

SEQ ID NO: 39987 - DNA, 173 bp, Glycine max
  Peptide Sequence Number=SeqID_131672
caccactcattgagctggtgagaaaccatgttccttcatgggaagatgcccagcaaatgggtgttgagggaaggatcccagggtatgaagaacctcgagatttgaggtcaaattctttccaaggtggagggaatgctaccccgcaagggcattgggtagaagactccaagtag

SEQ ID NO: 39988 - DNA, 249 bp, Glycine max
  Peptide Sequence Number=SeqID_131673
atgtcacgatggcatgaacttgctgggggggacgggcaccctgtaggactgacagaggcccgtaaccagagctggaaaccccagggccctgttggacttcttcggagtggtcatgttggcgcgcatgatccacactcgtctctttgcagtggcacggcctccctctctggttgtgctcgcacagttggtcgccctccaatatcagggggtggcccaggaactaaaaaaaggaaactactggtcccttaa

SEQ ID NO: 39989 - DNA, 295 bp, Glycine max
  Peptide Sequence Number=SeqID_131674
atgacaagcagagaccaagattggtcattctgcacccatgatacgcggagataccttatggttattcgcacccttttgtcatccagaggcggcgggcccgatgacaagcagagaccaaagaccaagtttggtcattctgcacccatgatacgcggagataccttacggttattcgcacccttttgtcatccagaggcggcgggcccgatgacaagcagagaccaagtttggtcattctgcacccttgtatcatccagaggcggcgggcccgatgatacgcggaaatacccaagtg

SEQ ID NO: 39990 - DNA, 928 bp, Glycine max
  Peptide Sequence Number=SeqID_131675
gaaagtccatgtggtggctatcttggtagatttgtttgacacctttgaccggagcgcaatcaattggtttcctcgttggaaggaaggtaaggaaggagttcttttctcgtgtggggactaccctaatgttccattgatagggactagggggtgtattaattataatcccacgctcgccataatacagctacggtaccccaagaggggagcgctaacggaagggagtctctcacctttccttgtgaaagatttaggcgcgcaaggtctcaagtttatactaagtatccacaaggcgtggaggagtccgttgaggaaagacaaggagcttaggggcatccgtaatggcgtcatcggacgttatcatggatggctaagagttcacacgcgagggttagattggctctccaagttgaaagttatcgatgaggagaacttcgaagctccggaggaagatgaagaagagaagttcaaatcagctgctacacacatccggaaagagtgcaccgagttacaagaggaaaacgcggccactggaagagcccttgaacaagaaaccaaaagggcccgcaagcaggaacatggtcgagagaaattccaaggagcattgtggggtagcaacaatgagctcaagctccgaagagaggaaagagaccgatcacgggtgagtttggctcaacacttggaagccacggagcaaagcatgctagctatcatagggcagtacaaggaagaattgaaccagtctgtgacccatgaacaaaagctagcggaggattttgcacaagtgtacgccgaaaaagaagcaagagggagggtgattaatgcattgcatcaagaagcgactatgtggatggataggttcgccttgaccttgaatggaagtcaagacctcccgcgtctattagccaaagcaaaagccatggccgaa

SEQ ID NO: 39991 - DNA, 992 bp, Glycine max
  Peptide Sequence Number=SeqID_131676
gattagatccagtaactggaggtctatggctgaccgatattatacaccatcatttagctattgcaattcttttcttgatagcgggtcacatgtataggactaactggggtattggtcacagtataaaagacattttagaggcacataaaggtccatttacgggccagggtcataaaggtctatatgagatcctaacaacgtcatggcatgctcaattatctattaacctagctatgttaggttctttgaccattgttgtagctcaccatatgtattctatgcccccttatccatacctagctactgactatggtacacaactgtcattgtttacacatcatatgtggattggtggatttctcatagtcggtgctgctgcgcatgcagctatttttatggtaagagattatgatccgactattcgatacaacgatctattagatcgtgtccttagacatcgcgatgcaatcatatcacatcttaactggggtgttctatttgctcgtagttcacgattaataccggataaagcaaatctaggttttcgttttccttgtgatggacctggaagaggggggacatgccaatcagatgtttggggtagtataagtgatcaagggatagtaaatcatatcacaggaggaaattttgcgcagagttccattaccattaatgggtggctccgtgatttcttatgggcacaggcatcccaggtaattcagtcttatggttcttcattatctgcatatggtctttttttcttgggtgcacattttgtatgggcttttagtttaatgtttctattcagcgggcgtggttattggcaagaacttattgaatccattgtttgggctcataataaattaaaagttgctcctgctactcagcctagagccttgagcattgtacaaggacgtgctgtaggagtaacacattaccttctaggtggaattgccacaacatgggcattcttcttagcaagaattattgca

SEQ ID NO: 39992 - DNA, 177 bp, Glycine max
  Peptide Sequence Number=SeqID_131677
atgtcaccctttgaaggtgagggcgtgcaccctctaaaggcgagggcgtgcagtcctctaaaggtgagggcgagtaacccattggaggcgaggacatatagtcctccgaaagggaggacgtgtagtcctctgaagactgtaatcgattacacaatattggtaatcgattaccaatag

SEQ ID NO: 39993 - DNA, 633 bp, Glycine max
  Peptide Sequence Number=SeqID_131678
atgggaacaaatcaaaatggaaaagggttttatcaagtcaagattaagggcctacatatcaccagcattaaggagttagggcggttgatgggacctctccaaatgcaagccttccacaaggcgtacggaaagatcttagatttgaccatagcagagatatccacagaagccattgcatcactcacccaatactatgaccagcccttgagatgcttcacgtttggagacttccaattagtatcgaccattaaagaatttgaggagattctaggatgtcctcttgggggaaggaaaccatatcttttctccgggtttcttccctccttgagcaaaattgcaattgtggtcagggattcggcgagaggattggaccgcgtaaagcaaactcaaaacggcatagtgggcctaccacggaagtacttagaaggcaaggcgagggatatggtgaatcaagaggactgggtcccgtttatggatgtattagcattgctaatctttggggttgtcctctttccaaacgtggatggtttggtggacctagccgcaattgatgctttcctcacatatcaccatagcaaagagagcccgggtggtagctatcttggcggacttattcaacacatttcaccgaag

SEQ ID NO: 39994 - DNA, 498 bp, Glycine max
  Peptide Sequence Number=SeqID_131679
atggcttacccccccaattatacgccacccaccatgcacttgcctaatgagaacgttcatcatgttgttcccatttcctttgaggggcagcaacccctgtctgtaggaggtgcccgtgaagaacctcggaagcatgctcaaggggacttcaacccatatcccactttcaccgctaagggactggtgtgtaatgatatgcctaaacccaataccgcaggagctcctcaaccccgccctctacaaccgttgcatttctcagtaggggggccgcctctggcaatggaagtgagagagaaacttgatctcatcgaagagagattaagagttgtcgaagggtttggtgattaccctttcgccgaaatgacggaattgtgtttggtacctgatgttgtcatccctccaaagttcaaggtaccagattttgataaatacaaagggaccacttgccccaaaaaatcacctaaagatgtattaccaaaaaatgggggcataccctag

SEQ ID NO: 39995 - DNA, 1006 bp, Glycine max
  Peptide Sequence Number=SeqID_131680
gtcgactctagaggatccccgtgttgagcaccagcagtgtttcgaggccatcaaaggatggtcattccaccgagagaaacgcgtccagctcagggatgatgagtacatcgacttccaggaagagatagctcgccagcggtggacatcgctggttacccccatggccaagttcgacccagacatagtcctggaattttatgccaatgcttggcctacacaggagggcgtgcgggatatacgatcttgggtgaggggtcagtggatccctttcgatgcggatgccctcagccagttcctgggataccctttagtgctggaggagggccaagagtgcgagtatggccaaaggaggaatcgggccgatgggtttgatgaggaggccatcgcccagttgctgtgtataccgggacaggattttgcccagaccgctgccgggagacgggtgcggatcatgcgcaccaacataactaccctgactcagacatggatgacattgctgcttagcaacatcctgcccagcaatcataattccgacctccccctgccgaagtgtcagctggtgtatgccattctgacacggatgagcgttcatgtggctcagttgatcgctgatgccatttatctatttgcaggtatgccacctaccaggcaccctctagacccgaataagtctaacagggccctgggttttgcggaattgatcatgggtctctgccagtcgttcggggttcctgtcacacctagtaaggcggccaaccacagggcgcacgtgcagacccatgactgcctctaccagctcagcctcagcctgcagagccagggtttttcctcttttccatgccctactctggatcagttcagggtagaggtcgcatggcccggagattggcctgaggcccaggcaggggaggcacccgcagaggcacccagcgaggcagatcaggcccgcatggacgaggagatgaccgatttgcttgatttcttgggagggagcggagccacatga

SEQ ID NO: 39996 - DNA, 567 bp, Glycine max
  Peptide Sequence Number=SeqID_131681
atgaaggatagtaaggccttgtcttcaaaggccaagaggaaggaaaaagaggaaaaggattccaggaagaagattgttaagaaggacaatcattttgcaacaaaaggtgatattaaaagagcactccttcttaaacaatctttctaccttctcctatcaagggaaacatcccttagcactgccataccttttgagcttgaggttattcctcaagtaaaggagttgttggatgagggtttggttcgtaagagcttaaatccttgtgctttgttggtgcctaaaataggtattattaggcaccaaatccctatgataggtggtatgatgaatgtgttgagtggtgcaacactcttttgtaaaatcactcatgcacccaacatcttcatgatttgtgtacatagggactcattaggtaggaataatcaacatgaaaataaagaaaaaggtattttttattccattactttccttaaatctttaaatagtgatcaagggcttcccatggatcctaagagaataaaggtgttgaggaaagaatccatgagtttcaagaacctctggaattga

SEQ ID NO: 39997 - DNA, 351 bp, Glycine max
  Peptide Sequence Number=SeqID_131682
atgccaccgagaaagctttccacaaagagatctaggaaggacgccgcggctgaagggatcagtgccactcctgagtttgacagccatcgtttcaggagcgcagagcaccagcagcgtttcgaggccatcaaaggatggtcgttgcaccgagagagacgcgtccagcttagggacgatgagtacacagattttcaggaagagatagctcgccggcgttggacgtccctggtcactcccagggctaagtttgacccagatatagtcctagagttttacgctaaggcttggcccacggaggagggcatgcgggacatgtggtcatgggtaaagggccagtggattcctttttga

SEQ ID NO: 39998 - DNA, 162 bp, Glycine max
  Peptide Sequence Number=SeqID_131683
atgggtgccttgatcactaacgatggctctagggactccaaacctgcaaaacagattagatctaacaaaatccacaacaaccctagcatcgttagttctggaattaatgaagcattgggcttgaatctagaattgggcttggacttgaagagggcagactaa

SEQ ID NO: 39999 - DNA, 1007 bp, Glycine max
  Peptide Sequence Number=SeqID_131684
atggcacttccaaggaagaatgagtcctctagcatcccctccttcaacaacattgaagatacctcacaagctttccctgaagactggtttatccctgggaagtgggtaaactttcaaagcttaaaggaggaaggctttgacgtgaaaggactatttgacagggtgggccggacttctttcttggaaaatttcaacacttggcactatggcccctatgctctcttttgggaaactgctaggcaagatggagtcaacatcaaagggacttttgttaggactcaagtggtgatttctctaaccaccattattgttgtgtctgcatgtgctttggatggtctgaccatgagcaaagattgggagaaggagataaccttggagactatggacaaactactttatggaaagcctcacccagatagaaatggtaataaggctctcaacaccttcttaaggatagctaacttaacctacttgtgtaggatgatccacaatgtgttgttcaacacagtcatgcctagactacactcaaggcactatgtcagtgatagagaccatttctgcatctgcaagatcatggtaggtgagaagacacaggaggagttagccaagccaagccaacctagacacaagctacccaccaaaagaaaagatcaccctccatcttctaaccccaaacccccaacctcagccaaaaagccaagaacccaacctccatctaaccccaaaaagagaacggctcaccatttttgggctaagcacaacatcagcgcgcttaacgcgatagaagaatatggcagaccatcaatatcaaggccgtgcgctaagcatgagatctgcttgcaaagtgcagcggttgtcttcagccaggctcaacgcatgactggtgctaactcaaatccacttacacacgctaagcacgaggagaattctagagtacaccacagtgcctatttcgagaaaagagctctggaggcagcaagaggagcaacttttgcaaagagacctag

SEQ ID NO: 40000 - DNA, 563 bp, Glycine max
  Peptide Sequence Number=SeqID_131685
acctggacgacactttgtcagaggaagacgatgaagaagccaacatatggatgatggcggacataacttttgaagggtttgagttataccaaaaagatgaggtaaattttgatgatcctaaatctcttagaaaagcttatcatgagcttctatcttactcatatattgtctcaaaagcttataaaaacctacgaagagatttcaagaatctatcccaagaacacaagaaatctatgagtttcttgaataatgagcttctgaagtatcaagaacttaaaggtcaacctcaagatgttgtcaaacttcatgaggaaataagaaccttaaagtctacattatccaaatttttcaatggaagaaaaaatcttaacaaattgttaggatactatagaagttctttagatgaatttggaaatggatatgatgggaaggccttggatcttcttcataaatggagtcctttgcttcttgaaatcaatggcagtggaatggagaaggaagaaagaaaattggaggcaccacttcaaggagaagataagtcaagaacaagctcaccaccatag

SEQ ID NO: 40001 - DNA, 207 bp, Glycine max
  Peptide Sequence Number=SeqID_131686
gattgtcatcatcaaaaagggggagattgtggaagcaatgtcttccaaggttattttgatgatgccaaagaatcaaaagtcaagcaaagtttcaagcaaagattcaagaatcaagtttcaagttccaagattcaagattcaagaaaaatcaagatcaagattcaagactcaagattcaagaatcaagagaagactcaatcaagataa

SEQ ID NO: 40002 - DNA, 800 bp, Glycine max
  Peptide Sequence Number=SeqID_131687
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgacgatgctctgcgagatgagctcgtgaagtcgagaaaagcagcatgcagaaaggcaaacaagctaccgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40003 - DNA, 480 bp, Glycine max
  Peptide Sequence Number=SeqID_131688
atgactaggggcaatccaggtgatttacaaccctttgatcctgaaatagatagaacctttcatatattagttaggcatagtgtgcatcctggtcattttgagcattttgagcattctgttgctggtgattctgaatattctgattttgagcattcaactaataattttcatactgagaacatggctcaacccccacctcgtgagaggactcttagggagatggctgcacctgatttcacttatgaaagcttgtgcattcaatatcctgatgagggtgttccatatgttctaaagactggactaatacatttgctacccaagtttcatggtcttgcaggtgaagatcctcataagcatcttaaggagttccatattgtttgttacaccatgaagccccctgatgtccaagaagatcatatctttctaaaggcttttcctcattctctggagggattggcaaaagattggctatactactga

SEQ ID NO: 40004 - DNA, 185 bp, Glycine max
  Peptide Sequence Number=SeqID_131689
agcacaaggtggatttcaaggataacaggtcagtagacccagagagatacactttcagcctaacaggaacaaagcctattagtttggaagacaaaaggaagcttggtgaagggtatagtccattgctacaaacctctataccagagaaaatggagacacttacatcacattttcacacagagtag

SEQ ID NO: 40005 - DNA, 92 bp, Glycine max
  Peptide Sequence Number=SeqID_131690
tctccttcgttttggcatggtaaaggcttgtgtggaatcgacgagcaaggacaaaaaggaatcttcaagtggcgcgacgaggaatctgtggg

SEQ ID NO: 40006 - DNA, 186 bp, Glycine max
  Peptide Sequence Number=SeqID_131691
atggccgatgacaaaccggtgactgagcaactggtagataccctaaccacgctttcaggcggaccacatgccggcttccgcgcaaaccatgccaaaggcatcatggttgaaggcacatttacgccgacggtccaggctgccagcgttagcaaagcagcgcatttccagaaagcgacgcctgtgctg

SEQ ID NO: 40007 - DNA, 1232 bp, Glycine max
  Peptide Sequence Number=SeqID_131692
ggcttattccacttaaatatgccctggtcaaacatgccaatacgctcgctgaggaccagattgatgtgggtcagcgtgtgttcgtcagcttgttgcaacacaatacccaaagcctcaaacaggccacccaggtgctggcggctgattttgctttcagggaagcggttgccaccaacgatgcagaaaccatagagtccgcgcttgaaagttatcaggggcgtattcgcgcacaaatcgcgttttacattagcagtgatgaaaacctgattgtaggaacctcggatgctaaagctatcctgaattcggtcgatgccagggaggattccaggcaggcgattattcaatcaaatgcgggtacgcttaagtttgatattgtggatggcaagccataccagctgattacggtaccggtgaaagcgccggaaaccataggctggatagtgatgggttttgccgtcgatagtcagcttgccagccagatcaagcagctcacgcacctggatgtgacctttgtgcaaaaaccccatgcacaggattggcaactgcgctgcatgaaacgcgacgatgaggcgctattggttgtcttgcaaggatcggtggcaccttttacgcaggatttgaacatcctgttcaaggtgatgattttcctgacctttgtgggcgtggtgatttttgctgtgctgatctggtacgtgtcgcgcaaaacgactgagcctattgccgccttggtcaaggatgccgacaaaatggcgatgggtgattatgaaaccgagatccaggtaaatagtacggacgaggtgggttttctggctaaagcgatgaacaatatgcgcgaagcggtgctacagcgttctttgcgtatccagcgcctggcgttcaatgatgaattaaccggtttatcgaatcggctggcatttaatcagggcgtgcatcaggccattcttacgcacgcagatcgtcagcaaaagttgagtgtgattgtgatcaatatccatcggttcaaaccaattaacaaaactctgggccgcgattttggtgacgatttgttgcgccatgtcggccaggtgctcaaacaaaactgccttggtgagcaggatatggtggcacgactggatgccgacgagtttgccgtgctgttacagcacacagaccaggccaaggccacgcaatatgccaacaaagtccagcagatatttgaacgccctgtgaatgtccaggggcaggccattgat

SEQ ID NO: 40008 - DNA, 657 bp, Glycine max
  Peptide Sequence Number=SeqID_131693
atggttgtgatatctcccgggaagatctaccagcctcctttcccaaagtggtatgaccctgacgcaacctgcgcataccatgggaaaaccccgggccactccaccgaacgttgtctggcccttaaatacaaggaccagcccaacatgaaaacgaacccgctcgctaatcatggagggggagtagttaatgtcgtcaagtcgggtaggccacgcattgttcaagcctttgaaggacgtgacgacccccaggagtccgtagatgagggaagttttggaaagcctaagcctttggtggtatatttcaccagagacgcagctccccaaacgccccgatacccctcggtagttaaacctatttcgttttcataccaaaacagccatgcagttccgtggaggtatgtgcctccaagcgaaaggaaggaagaagccaccgacatcagctcattgtcagccaaggtaactaatatcacggggctgagcggcgtgacccgcagcggtcgcgtgttcgcaccccctgacctaccgacacaacccgcaaatgttaaagggaaggcaaagatagcggaagaacaaaatgacaaaatgatccccactccgaatgagaatattccagtgaaaggtctttcggagaaaaaggatggatgtggcaagaaagaa

SEQ ID NO: 40009 - DNA, 402 bp, Glycine max
  Peptide Sequence Number=SeqID_131694
atgaattgtgttttcgttcatgcgtcctccacccccgagtttggagccatgcgtagtgatttcttagtgcaattgtccattctcaattcttttttggagccccatgaattgcgttttggttacgggcctctgaatcgcgcccacaagacacccagtagactcggaggagtccaacagggccctggggtttctagctctggttacgggcctttgttagtcctggggatcctccagagtcgacctgcaggcatgcaagcttggcactggccgtcgttttacaacgtcgtgactgggaaaaccctggcgttacccaacttaatcgccttgcagcacatcccccccagcatggtcatagcgaagaggcccgcaccgatcgcccttcccaacagttgcgcagcctga

SEQ ID NO: 40010 - DNA, 294 bp, Glycine max
  Peptide Sequence Number=SeqID_131695
atggttacgcaattcgtgaaattccataatgcaacagaaaccaaaaggaagtattgttgcgcaatccgcccacttgggccttccagattcttcctccagaaggcgattgcttctagaggaagcaaccttgctcgcctgggcgagctgggtggcaagctcctcccttattttgctataaatagggggaggagtgaagaggaaaggggttcagccttcttgacacttcgtattctcttgaaattgctgaggaaaattgtttccgtgaagaaaattcaagccgagacgcttccgtaa

SEQ ID NO: 40011 - DNA, 222 bp, Glycine max
  Peptide Sequence Number=SeqID_131696
atgaagatgaaagcaaacaaaacaagaaatgaattgaaagtttcggattcgaacacttaccggttgaagaccaaagaacgaatgaagaacggacaaagaacggtaaagaacggcggaaaatcttcacggatttgctcacggaaacgtctcggaagcgttacggaagcacctcggcttggattttcttcacggaaacatgtttttttcacccaaaacagctga

SEQ ID NO: 40012 - DNA, 291 bp, Glycine max
  Peptide Sequence Number=SeqID_131697
acacccagtggacccgaagaaggccaacagggtcttggagttgccagctctaattacgggcctctgtcagttctacagagtgttcgtcatccccaacaaggccatcaggcccctactaatcgagctttcatcaagaagcactgcgccctcaggcaggtgcagggcgaaacaccacaacagcctggggatggccggctgcgggcaatagacgcaccaccaccaccttcagagcccctcagctcattcacaaaaaggttagagtattgcctacgacacatggccgaccaatag

SEQ ID NO: 40013 - DNA, 372 bp, Glycine max
  Peptide Sequence Number=SeqID_131698
atggataatgaagagggcgtgcaagaacagatgaaggccgacctatcggccttaaaagatcaaatggcttctatcacggaggtcgtgctaaaacttcagaaaactatagaagataattccatgacggccgcctccaatacagctagggaagcggaaccggtgctacagcccgcaataaacttgggccgagacagaaacatgacggtgttaggtcggaggtatagtcctcaagcctacccttatgatttgccttcggacttcactccccgtaccgctccggatgatttgagccaagcccctaccttcgtggggcaactccctccttatgccgactatcccttccagaagatgatgaaggagatgcccatctag

SEQ ID NO: 40014 - DNA, 399 bp, Glycine max
  Peptide Sequence Number=SeqID_131699
atgggtgaagtagaggagatacaagagaagatgaaggccgacatggaggccatgaaagagcaaatggccactatgatggccatgatgagcatgaggaagataatggaagccaatgcggttacaattgccgctaccagcactgttgctaaggtgaacccgatgcccccatctggcctcaaccaaatgaatcatccaaccttagatatggtaggcaaagatttgggaagtaggggcggcccccattatgcgcaaaacaagcatgccttcccaccatatggcttgcctcccaactatatgccacccaatgtggcgtacactcccaataagaatgtcaataactccactcctatacccattgagagccaacaaccccaaactgatcatgcacatgtctcttaa

SEQ ID NO: 40015 - DNA, 479 bp, Glycine max
  Peptide Sequence Number=SeqID_131700
atgactcaatctcttgctttctcaaaagggtggacccttggagggttgcacgccctcaccttcagagggctccacgccctcgccttcagaggactacacgtccttgcctttagaggactgcacgtcctccacttaagaagaccacacgtcctcgccatcagaggactaaacatcctcgctttccgaggactacacattctcgccttcagagggctacacgccttcgccttcagggagctgcacgccctcaccttcaaagggctacacgccctcaacttcagaggactacacgtcttcgccttgaggactacatgtcctcaccttcagacgactatatgtcctcacactaagagggctacacgccctcgccttctgaggactacacgccctcgccttgaggagtacacgtccacaccttcagagggttgcacgccctcaccttcagagggcttcacgccctcgccttcaaaggactacac

SEQ ID NO: 40016 - DNA, 276 bp, Glycine max
  Peptide Sequence Number=SeqID_131701
atggcaacattcagccacatgcagtcccagtttgagtcccagatgcaatctcagggacttgcactgcctcccgagcctctggttggtccctcaggtcctcaagtaagcacaaaggagagttgtgttgatccctcagcaaacgatcctaagacgggtgactcagacaggtgcgacttgtacattgaagcaaatcctaccatcctggttgccctgggaagagtttatgagggatccactgttgctcataacactcctttattgcctggccaagtaaag

SEQ ID NO: 40017 - DNA, 264 bp, Glycine max
  Peptide Sequence Number=SeqID_131702
atggatggctatgtggatagatacaaagctcgattggttgccaaaggttatactcaacaagctgggatcgatttctctaatacattctctccagtagccaaacttaccactgcaggctgtgaggcaactatggaatccgccttccctgattccgatgttgttgagtggcggctggtagtgaaaggaactgacgatcttggcttagatggctttgctcttggggaacatcatttatcgatagtcaaggtacctgaagtttcatga

SEQ ID NO: 40018 - DNA, 315 bp, Glycine max
  Peptide Sequence Number=SeqID_131703
atggttgggcaaaaagtgttattgtataattctaggcttggattcatgagtgttgagatcaaaagcgactccacaaacaagagcttcaaggtcaacggacttgacttaagccgttttattgcctcacgaaccctttttaatgtggaagatctcagcacttgtgagcagtgtgagagcaggaaattacacttactggcgacacctactctaatgcctcgcaacctatgctattctatgaggtgtttgatgtctgggttgactaatgtttcaaatgggtggaagccaagcccatctagaactaatgagttttgctaa

SEQ ID NO: 40019 - DNA, 357 bp, Glycine max
  Peptide Sequence Number=SeqID_131704
atggaagaacaaatgagatgcctcctctacagcttctctacagaaaggacatcgcataacaggccagacaactaccttaaggggattattaatagtgctatcaagggtcttgatgatgctccacagcctaaatcaaaagctcctgctaggtggattgtcgtcaagtgtaatagacaaaaaggaactactgagtgcggctactatgtcatgcactggatgtccaccatcattttaggaagttttagaaataattgggaagcgtattttaacgaccctagaccattggagcccgagagattaaaagcattgcggattcagtgggcacagttttatctccgagttagagatcaggcctag

SEQ ID NO: 40020 - DNA, 731 bp, Glycine max
  Peptide Sequence Number=SeqID_131705
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggatgtcatctgtccatatcgctttgtgcaagccatcttccacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40021 - DNA, 288 bp, Glycine max
  Peptide Sequence Number=SeqID_131706
atggtgaaagttggaacttcttacgtgccgatcaacgtctcattttcgccaaaagttggcccagggcttcccggtatcaacagggacaccaggatttatttattctgcgaagtgatcttccgtcacagctgtccctcctgttcagctactgacggggtggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 40022 - DNA, 117 bp, Glycine max
  Peptide Sequence Number=SeqID_131707
aaatgggtttatgatcccaacatggaaaacgcaaggatgagcaaacatgaaaacaaatggtatgcaattttgcagatcaaaaagtttgttgaacgcctatgcatgatgatgccatga

SEQ ID NO: 40023 - DNA, 663 bp, Glycine max
  Peptide Sequence Number=SeqID_131708
atgccggatatcgagaaacgcctggaggcgtttgtccgtatcgcgcacggtattatcatcttcccgggcggcgtgggcacggcggaagagctgctctatctgctgggtattctgatgaacccggccaacaaagatcaggttctgccgctgatcctgaccgggccaaaagagagcgcagactacttccgcgtgctggacgagtttatcgtgcatacgctgggagaaaccgcgcgtcgtcactaccgcatcatcatcgatgacgcggcggaagtggcgcgtcagatgaaaaaagcgatgccgctggtgaaagagaatcgtcgtgataccggcgatgcttacagcttcaactggtcaattcgtattgcgcccgatctgcagatcccgtttgagcctacccatgaaaatatggcgaacctcaaactctacccggaccagccggtggaagtgctggctgccgatctgcgtcgcgccttctccgggattgtcgcggggaacgtgaaagagatgggcattcgcgcgattgagcagtatggtccgtacaagatccacggtgaccgggagatgatgcgtcgcatggatgacatgcttcagggctttgtggcccaacaccgtatgaagttgccgggctcagcctatattccgtgctacgaaatctgcacgtaa

SEQ ID NO: 40024 - DNA, 837 bp, Glycine max
  Peptide Sequence Number=SeqID_131709
atgcctacacgccctcgccttcgtagggctgcacgccctcaccttcagaggactacacgtcctcgccttcagaggactacacgtcctcctcttcagagggctagacgccctcatagtcagaggactacacgtcctcgccttcaaagggctacacgccctcgccttcagaggactacacgtccgccccttaagtgggctacaccccttcgccttcagagggctacatgtcctcattttcaaaggactacacgtccatgccttagaggactacatgtcgtctctttcaaaggggtacacgccctcgccttcataggactatacgtcctcaccttcagaggactacacgtcctaaccatcagagggctacacgtcgtcgccttaagaggactacgcgtcctccccttcagagggctgcacgccctcgccttgagaggacaacatgtcctcgccttcaaaggactacaggttctcaccttcagaagactacacgtcctcaccttgagagggctacacgccctagccatcagaggactacatgtcctcggctttagagtgctacacgccctcacctttagaggactacacgtcatccccttcagaggactacacgttctcgtcttcacagggctacacgccctcatcttaagaggactacacgtcctcgtctttagagggctacacgatctcaccttcagaggagtacacgtcctcgcctttagagggctacacgccttcaccttcagaggacaacacgtcctccccttaagagggctacacgccgtcgcattcaaagggctacacgtcctcatcttcagaggccacacgtccttgctttag

SEQ ID NO: 40025 - DNA, 784 bp, Glycine max
  Peptide Sequence Number=SeqID_131710
atctaggagggatgccgcgactgaagggaccagtgccgctcccgagtttgacagccatcgtcccccccagcgctaagcaccagcagcgtttcgaggccatcaaaggatggttgttccaccgagagagacgcgtccagctcagggacgatgagtacgcagattttcaggaagagatagctcgccggcggcgtgcgggacatgcggtcatgggtaaggggccagtggatccttttgatgcagatgccctcagccagttcctgggtgacccgctagtgttagaggaaggcagagattttgccccaaccgctgccgggaggcgggtgcggatcatgcgcaccagcatgaccaccttgacacagatgtggattacattgctgctaagcaacatcctgcccagcgatcataactccgacctccctctgccaaagtgtcatctggtgtatgccatcctgacacggatgagcgtccatgtggctcagttgatcgctgacgccatttatttatttacaggtatgccacctaccaggcaccctttagacccagataagtctaacaaggccctgggttttccagcattgatcacgggtctctgctatattgaacgcctagacaagcgcagggtgatgcaccgcaggccacagacgcaccgccaccacctcatcaggctggtccagctgggtcatttggcatggagcggtatttacagcacttggttcgccagcaggcggccaaccacagggggcagggctgaggttgcatggcccagagattggcctgaggccca

SEQ ID NO: 40026 - DNA, 135 bp, Glycine max
  Peptide Sequence Number=SeqID_131711
ggtgcggataaccgtaaggtatctccgcgtgtcatctggcccgccgcctctggatgcccgccgcctctggatgacaaagattatgggtgcggccgacaaaagcaaggctcttgctctgctgtcatcctccaatga

SEQ ID NO: 40027 - DNA, 450 bp, Glycine max
  Peptide Sequence Number=SeqID_131712
atggggatcgcacccacaaagacacccagtgaacctgaagaagtccaacagggccctggggtttccagctctggttacgggcctctatcagtcctacagggtgcccgtacccccccggcaaggtcacgtcatcatagggatcgcgactgcaagacacctagtggacccgaagaagtccaacagggtcttggaattttctacggagtacctgtcacctccagcaagggcatcaggccccctactaatcgagctttcatcaagaagtactgcgccccagataggcgcagggcgaaacaccacagcagcattgggatggtcggcagcggggaaatagacgcaccgccatcacctctaggagttcacctctgctcatccacaaaaaggtttgaagtattgcctacaccacatggccgaccaataggcggaccaagtcccaaagccaaaaggtaa

SEQ ID NO: 40028 - DNA, 927 bp, Glycine max
  Peptide Sequence Number=SeqID_131713
atgcatgagtatcatatacccttttgcttatgttcggtaaatattgtcatactgtgtacattcccgcattgtgtcttttgcataggcattgcatatgggttcttcttgatccctactgtaaacaaaccaacggagggtccgtgtcgccttcttaaaaacgtgcgttggggcattttgctacccctagacgtcgtatctaagaaggggacaaattccccggacccccgcattcctagattgcatctgtgtcatatgcattccatcatgcattcatccatcccacccatgagatatcggagttttgatttgcaccagcttttgtctcactttagtaagcatgggaacaaatcaaaccggcaagaggttctaccaagtcaaggtcaaaagcctagataccaccagcatcaaggaattagggcggttgatggaacccctccaaatgcaagccttccgcaagacttacggaaagatcttagagttgaccatagcagaggtgtccatagaagccattgcatcacttacccaatactacgaccagccttgagatgcttcacattcggggacttccaattagtaccaaccattgaagaatttgaggaaattctaggatgtcctctcgggggaagaaaaccatatctttcctccggatgtctcccctctttgagcagaattgcaactgtggtcaaggattcagcaagaggtttggaccgcataaaacagactcggaatggcatagcgggcctaccacagaagtacctagaagacaaggcgaggggtatggccaatcaaggagactgggtcccgtttatggatgtgttagctttgctaatttttggggtcgtcctctttccaaacgtggatggtttggtagacctagcagcaatcgacgctttccttgcctaccaccatagcaaggagagtccggtg

SEQ ID NO: 40029 - DNA, 251 bp, Glycine max
  Peptide Sequence Number=SeqID_131714
tcttggaagtcaacactcaggagcgcaggtcgcttgagcaaactgaccaatggcttgcacttgaaaatcctgatgagtcattagagacatctaacaacaaccttgcaccttacgcttcagagccctacaatgctcaatggaacgccccggggcttctccgtgacaagcacacgttgcgttcgagtcgtattctcggagaaatggaggtggtcttcgtcattggaagtgcggtagacagactttgtggttga

SEQ ID NO: 40030 - DNA, 444 bp, Glycine max
  Peptide Sequence Number=SeqID_131715
atgagaggggcaccactagaggaagagctcgcgcctattattgcacgaggtttcaataagaccaacgtggaggtgcttcaaaaggtccgcaaggcatgggagatggtgcaaaagaaggataaggaactcataggcaataacaatgggctcatcggcagctatcgtaggtggttgaaagcccactttcaagatttggattggctcccaagtttgagaaccactaaaggggtggaagttgaggctccggaggaagacgaagaggtgcaggcccttagggcagaactcgagcaagcccaatcagtcaaagaaaggttcaaatcagcagctcttaagatccgaaaggagaatgccgaactaagagacgtaaataaagctaccaccaaggccttagaacgagagaccaaaagggctcgtaggaaggaatacggccggaacaaattctga

SEQ ID NO: 40031 - DNA, 723 bp, Glycine max
  Peptide Sequence Number=SeqID_131716
gcttgtaggaccaccacccgacagcttgcggggtacttgacgctacttcagtgctggatctatgagcacttccctagtgtgcatcagtgcgtgactgacgatacataccaggagacgtccccacgtgcttcccggtggttgacgtcgaaggcgcacatgaagggcatcacaggagcaccttacagggcacgttgtgatggtttgatcgtcacagatgtgtcctggttgccgtacacggagcatcggggtgttagggcgtttcaggagatttcatcgttccagggtcagctcagatggggtcctatgatcgtcacagttcgaccggagagggtggtacgccagttcggttacatccagagcatccctccgccgcctgttagtgcacgattgtcacaggatcagatagatgacaggtatctgcggattacattgagtgggtttttccgcatatctcaccctttcatgacaccgacccaggcagctgaccagcagagggatgcaccagctacagaccctgaggactacatacagccgcccagcccccaggttccagtggcatttgacccccctccacatgtggatgattacgagggatatgaggcgattgcacagaggttggagcgtgtgctcaaccttaggatagtcactgcaggcacagagttatatgacattatgcaggactgtttgacgatcgcgagagggggacccagtgctgatgggacg

SEQ ID NO: 40032 - DNA, 294 bp, Glycine max
  Peptide Sequence Number=SeqID_131717
atggagcagtatttacggcatgtggttcgccaggaggcggccaaccacagggcccatgtgcggaccaatgagaccctttaccagttgagcctcagcatgcagagccagggcttcgcttctttttcatgccctactccagaccagttcagggcagaggtcgcatggcccggggattggcccgaggcccaggtaggagaggcacccccagaggctcccgacgatggagaggaggcccacgaggatgaagagatggccgatttgcttgacttcttgggagggagtggagctacatga

SEQ ID NO: 40033 - DNA, 225 bp, Glycine max
  Peptide Sequence Number=SeqID_131718
atgaaagtaaccgtactgggatgcggtgcattggggcaactatggttaaccgcgctgtataaaaacggacatgaggttcagggctggttacgcgtcccgcaaccattttgtagcgttaatctcattgagactgacggtagtaatttcaacgaatcaatgaccgctaacgatcctgattttctcgccaccagcgatttactactggtgacgctaaaggcatggcag

SEQ ID NO: 40034 - DNA, 474 bp, Glycine max
  Peptide Sequence Number=SeqID_131719
atgggtggtggtgcatggccgttcttagttggtggagcgatttgtctggttaattccgttaacgaacgagacctcagcctgctaaatagctatgtggagatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgaacctgcggaaggatcattgtcgatgcctcacaatcagattgacccgcgaacttgtttattcatctaccgtcgggagggaggggatgaccacggcgccccgaactcaaatctgttaagtgcgactcccgggggcccggagacggtgtcccgcgggagtcgtcacgacacaacatttacatacatgactctcggcacggatatctcggctcttgcatcgatgaagaac

SEQ ID NO: 40035 - DNA, 237 bp, Glycine max
  Peptide Sequence Number=SeqID_131720
atggcttacacccacattccggtgaaagttgaaaatcctggattttacacacgattctcctcaaatttcagccagcatcaattagacctcgcaccctacacttcagagccctacaatgctcaatggaacgccccggggcttctctgtgacaagcacacgttgcgttcgagtcgtattctcggagaaatggaggttgatgaaccttggctagggttatggctaccattgaattatcaa

SEQ ID NO: 40036 - DNA, 384 bp, Glycine max
  Peptide Sequence Number=SeqID_131721
atgaagcacttcactgacaccctcatcagtgccaacataagcggccgccaccgcggtggagctccaattcgccctatagtgagtcgtattacaattcactggccgtcgttttacaacgtcgtgactggggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcggggtgtggtggttacgcgcagcgtgaccgctacactttgccagcgctgatgtccggcggtgcttttgccgttacgcaccaccccgtcagtagctga

SEQ ID NO: 40037 - DNA, 399 bp, Glycine max
  Peptide Sequence Number=SeqID_131722
atggtcttaaaagaggagttagctgcttgctcgaggtccaaaagaaacttgtctcagcgtttatgcgagacagagataagcatgttagccatcgttaacaagtaccaagaagaactaaatcttgccatggcccatgagcataaagtggcagacgagtatgcccaagagtacatggaaaaggaggctagaggacgggtgatcgactcgttacatcaagaggcaacaatgtggatggaccgatatgctcttaccttgaacaggagtcatgaacttcctcgattgctacccaaagccaaagcgatggcgaacacctactcttcccccgaggagatccacggacttctcagctattgtcaacatatgatagatttaatgacccatataattagaaaccgctag

SEQ ID NO: 40038 - DNA, 650 bp, Glycine max
  Peptide Sequence Number=SeqID_131723
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40039 - DNA, 748 bp, Glycine max
  Peptide Sequence Number=SeqID_131724
gggagcgtcaacaaaagaaagtctctcgcctttccttgtgagggatctaggcgcgcaaagtctcaaggtgatacaaagagtccacaaggcatggagaagtccgttgaggaaagacaaggagcttagaggaatccgaaatggcgtcatcgggggttatcatggatggctaagagttcacacgcgagggttagattggctctccaagttgaaagttatcaatgaggagaacttcgaagctccggaggaaaatgtagaagtccgagctctaaaattagagctttttgttaggcaagactcgccaaggagaagttcaaatcagtcgctgcacacatccggaaagagtgcaccgagttacaagaggaaaacgcggccactgcaagagcccttgaacaagaaaccaaaagggcccacaaagaggaatatggccgagagaaatttcgaggagcattgtgggagtttagctgcttgcgcaaggtccaaaaggagtttggctcaacacttggaagccacggagcaaagcatgctagctatcatagggcaatacaaggaagagttgaaccagtctgtgacccatgaacaaaagctagtggaggattttgcacaagtgtatgccgaaaaagaagcaagagggagggtgattgatgcattgcatcaagaagcgactatgtggatggataggttcgccttgaccttgaatggaagtcaagacctcccgcgtctattagccaaagcaaaagccatggccgaa

SEQ ID NO: 40040 - DNA, 432 bp, Glycine max
  Peptide Sequence Number=SeqID_131725
atggaaccgagttggaaaacactctgcaggatattatcctggagaacttccccaatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 40041 - DNA, 444 bp, Glycine max
  Peptide Sequence Number=SeqID_131726
atgggtgaagtagaggaggtgcaagagcaaatggccacaatgatggaggccatgatgagcatgaagaagataatggatgccaatgcggttgcagttgccgctaccagtgttgttgctaaggtgaacccgatgcccccatttgacctcaaccatatgaatcatccaacctcaaatatggtaggccaagatttgggaagtacgggcagcccccatgatgtgcaaattcaaaacgagtacgtcttcccgccatatggcttgcctcccaactatacaccacccaatgtggcgtacactcccgatgaggatgtcaataactctgctctcatactcattgagagccgacaacgtcatcatgcacatgtctctcaacccatgggggagacatatgaaataccccaccacaatctagccgacttcgagccttgcctcggatatgccacttaa

SEQ ID NO: 40042 - DNA, 348 bp, Glycine max
  Peptide Sequence Number=SeqID_131727
atggatggtggagaaaaaggtgttagggtttgggttggaattgtagttaacgcacttcttgcactaagtaagaggtcagaagttgttagttacaaatcccaatcgaattcctgcagcccgggggatccactagttctagagcggccgccaccgcggtggagctccaattcgccctatacacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgat

SEQ ID NO: 40043 - DNA, 216 bp, Glycine max
  Peptide Sequence Number=SeqID_131728
atggcagaaatcaaccaaggtaagacgatgaccggtcacgatcggccgcgtatttttgtttcctacttacatgtacatagggacggatcgagtggggctagggtcacgaccgaccgatcattgccccttcccggcgctaaacaaacagagaacgtcgctgcgaggcagcccagtatcctttgtagtcgcattttcttttactattgtttgttttaa

SEQ ID NO: 40044 - DNA, 414 bp, Glycine max
  Peptide Sequence Number=SeqID_131729
atggacaatgaagagggagtgcaagaacagatgaaggccgacatgtcggccttaaaagatcagatggcttctatcacggaagccatgctaaaaattcaaaaatcaatagaagacaatgctacaacgactgcttccaatacagctagggaagcggaaccagtgctacaacccgcaataaacttgggccgagatagaaacacgacgggtttcaatcggaggtatagtcctcaagcctacccttatggtttgcctccagacttcactccccgtaccgctccagacgatttgagccaagcccctaccttcgaggggcaactccctcctcatgccgactatcctctacaggaagatgatgaaggagatgcccatctaggccctcttcttcccctcaaggaaccgcccccccccccatga

SEQ ID NO: 40045 - DNA, 180 bp, Glycine max
  Peptide Sequence Number=SeqID_131730
atgacgaacaaggccaaaggaaaaggcaaggaggtcgccggaaaaggttctgccggcaagcgtaagggcgccttcgacgatgacaagaccggtggcgaccgaaagagaaacaagcgaggccgtgttgaatgcacggtgtctcctgttattttttttggattcgttgacgtgcaaacatga

SEQ ID NO: 40046 - DNA, 378 bp, Glycine max
  Peptide Sequence Number=SeqID_131731
atgacaaaagggtgcgggataacccgtaaggtatctcccgcgtatcatccgggcccgccgcctctggatgatacaagggtgcagaatgaccaaacttggtctcctgcttgtcatcgggccccgccgcctctggatgacactaatttcattcctctcgatttgacgagagtcgcggcctccaaggaccaaacttggtcgcatgtcatcaagcaggtcccccctggacgacaaattagggtgatgacactaaggtatcctccgcgtatgacagagtcgggtgcccatgaaatttccgccatgatgactcccggagaacaagggtgcagaatgaccaaactatggtctctgcatgctatcgggcccgtccgtcttggatga

SEQ ID NO: 40047 - DNA, 177 bp, Glycine max
  Peptide Sequence Number=SeqID_131732
atgtccccagtggagtcaccaactgtcgcaacgtgcccttcgcgggcgagcgagggcgaggctcatgggtgcgctttccaaaggaggaaagatgcgcggagttgccaccaacgtcgacaaaagcagggcttttgctcctacgtaccctcctttggagaggaaatcaaacctacgtag

SEQ ID NO: 40048 - DNA, 141 bp, Glycine max
  Peptide Sequence Number=SeqID_131733
atgtatgtgaggcatggattgtcccacacaaggagacatttatcacaacccggacgaataagggttgaatttgctcattgggctctgaaagggtattacagaatagcgttggagacctctgtagtgtttgggatgcaatga

SEQ ID NO: 40049 - DNA, 363 bp, Glycine max
  Peptide Sequence Number=SeqID_131734
atggctcctcagttgaaccaagctcagtcccaaaattctgacaaattgccttcacaaacaatgcagaatctgaaaaatgtgagtgccatcaccttgaggtctagcaaccaaattccagtgcctccaccagtagcagcacctgcacctgaacctgtcaagcttcattctacacctgaaaaagaggatgagatagttgcacaaaagagaaagcttcctaacaaaaattttcatcaacctcctatcgctcttccattcccacctagagcaattccaaacaaaaagatggaagaagcggaaaaggagatcttggagaccttcagaaaagtagaggtgaacatacctctgctagatgccatcaagtag

SEQ ID NO: 40050 - DNA, 444 bp, Glycine max
  Peptide Sequence Number=SeqID_131735
atgggtaaggtagaggaggtgcaagagcagatgaaggctgacatagaggccgtgatgagcataaaggagataatggaggtcaatgcggctgcaatagttgttactagcaccattgttgaggtggacctaaccccccccccccccatatggcctcaaccaaataaatcatccaacctcatatatggtaggcaaagatttaggaggtacgggtggcccttatttagtgccaaaaacgagcacgccttcccaccatatggcttgcctcccaactatacaccacccaatgtggcatacactcccagtgaggatgtcaataactccgctcccatactcattgaaaacctcaaattgatcatgcacatatctcttgacccatgggggagatacacgaaatgccccaccaaatctagccgacttcgagccttgcctcagatatgccactga

SEQ ID NO: 40051 - DNA, 480 bp, Glycine max
  Peptide Sequence Number=SeqID_131736
atgaatatgtttatagataggctgagaccacaaaccaagcaactgttagatgttactatagagggaaagataaaactgaagaccccgaaagaagcaattgagctaattgagaacatgttacaagttgtaccatctgtggtgaggctcatgaaacaggccaatgtattcccactgaagaaaacactcaagaaattcattatatgggaaatcaacagcggcaaggtgatgacaacaaaagatgatgacaaaggtgatgaacaaaaacctcaaagatcaaagaacaaatcaagtgaatcaaagaacatctcaagtgaatcaagaacaagtcaagagttcaagaatcaagaagaattcaagactcaagaagaaaacctagaatcaagaatcaagattcaagattcaagatctcaagaatcaagatcaagattcaagactcaagattcaagaatgaagaaaagactcaatcaagataagtattaa

SEQ ID NO: 40052 - DNA, 432 bp, Glycine max
  Peptide Sequence Number=SeqID_131737
atgaagcacttcactgacaccctcatcagtgccaacataccgcatcagtcatgtctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 40053 - DNA, 324 bp, Glycine max
  Peptide Sequence Number=SeqID_131738
atgatcaaggaggtccacgagggttcgttcggaacgcacgccaacgggtatgctatcgccaggaaaatcctgagagcaggtgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 40054 - DNA, 1273 bp, Glycine max
  Peptide Sequence Number=SeqID_131739
atggaatctattccaacatatataccatggttccttacctcgacagggtacaaatatctaaatttcatatttttagatactttttcagacctattgccgatactaagtagcagccaaaaatttgtatccatttttcatgatattatgcatgggtcagatatattatggcgaattcgtcagattccattgtgtcttccacaatggaatctgataagtgagatatggaatctgataagtgagattccgggtaattgtttacataatcttcttctgtccgaagaaattattcatcgaaataatgagttactattaatatcgacacatctgagatcgctaaatgttcaggagttcttctattcaatccttttccttctccttgttgctggatatctcgttcgtacacatcttctctttgtttctcgagtctatagtgagttacagacagagttcgaaaaggtaaaatctttgatgattccatcatacatgattgagttgcgaaaacttctggataggtatcctacatctgaactgaattctttctggttaaagaatctctttctagttgctctggaacaattaggagattctctagaagaaatacggagttttgcttttggtggcaacatgctatggggtggtggtcccacttatggggtcaaatcaatacgttctaagaagaaatatttgaatctcatcgatctcataagtattataccaaatcccatcaatcgaatcgctttttcgagaaatacgagacatctaagtcatccaaaaagacgtatattccttgctaattatcagacaattacttattcacaaaccttgcggggggctaatagttttcatttcccatctcatggaaaacccttttcgctccgcttagccctacctccccctagtaggggtattttagtgataggttctataggaactggacgatcctatttggtcaaatacctagcgacaaactcctatgttcctttcattacagtatttctgaacaagttcctggataacaagcctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggatgtgaatgagtcgaattacttatccctcg

SEQ ID NO: 40055 - DNA, 582 bp, Glycine max
  Peptide Sequence Number=SeqID_131740
atggagagaagtatgatagatgctgccagtggtggagcccttggagacatgactcctgctgaagccagaaatttaattgagaagatggcttccaactcccaacagtttagcgccagaaatgatgccatagtcattagaggagtgcatgaggtagctacaagcccatctgcatcatctgaaactaagaagcttgaaggcaaactggatgcattggttaacttagtaacccagctggccttgaatcagaaatctgttcctgtcgcaagagtttgtgacctttgcccttccatgcagcaacctggagcaattgtgcagcctaaagcttatgctgcaaacatttacaatagacctcctcaacctcagcagaacaattatgacctctccagcaatagatacaaccctggatggaggaatcaccctaacctcaaatggtccagccctcagcaacaacaacagcagcctgctccttccttccaaaatgctgctggcccaagcagaccatacattcctccaccaatccaacaacaaccccagaaacagccaacagttgaggcccctccacaaccttccctcgaagaactt

SEQ ID NO: 40056 - DNA, 408 bp, Glycine max
  Peptide Sequence Number=SeqID_131741
atggctcctgaagaactcgagcagctgactcaacaaatagggaccatgtggaggagtcgatcacagaaaaaccagatgcagtcccagttgcaagcacagatccatgcactgcctctggagcctgaggttggtccctcagctgctcgtgccagcacaaaggggagttgtgttgatcccttagtcaccgatccagacacgggtgactcagacaaatgcggtggctcacaacatcctttattgcatggccaagtgaaggttagtgttgaggaagttaaagatgcagatgctctcattcttgtacccactgacgaggcagctgtgtctccagcaaaacctatagataggtcggatcatgaggtcgatgatcccctatatttgatgacattgaacatcccacaacttttttga

SEQ ID NO: 40057 - DNA, 81 bp, Glycine max
  Peptide Sequence Number=SeqID_131742
atggagaattggcgaacagcgctaggcaatgacattcatggggctccgaacaacaaaaggggaaacatggggctaagctga

SEQ ID NO: 40058 - DNA, 414 bp, Glycine max
  Peptide Sequence Number=SeqID_131743
atgctcaatggaacgccccggggcttctccatgacaagcacacgttgcgttcgagtcgtattctcggagaaatggaggttgaggaaacctagcagggtttatggctaccactgcattatcgagtggatatgggagcaagttagcataggacaccggaatttgggtgaattctacaggaatggcagtcacagcacgagcttctccttcatcctcaccctcttcatttgccccagttttctcattcgtccaagcaggatgactaaatttgcctcttttcagacccacatcgatcctttcactggcaaagaccaaatccgcaaagctttgaaggtgccacttgagctgccaggtctctccacctttgggcgtattcttttgaaagattcgtgccacctttttgcacatgttctgtag

SEQ ID NO: 40059 - DNA, 183 bp, Glycine max
  Peptide Sequence Number=SeqID_131744
atggtgctggtagcggctattgcagccacattgacctccattatctcctttatgctcatcatggcctccatcattgtggccattttctctttcaaggcctttgtgtcggccttcatctgctcttgcacctcctctacttcacctattactctagctctatcacgggttcggagatcgagttaa

SEQ ID NO: 40060 - DNA, 519 bp, Glycine max
  Peptide Sequence Number=SeqID_131745
atggcgtcaagaaagagagcgagaactgaggatatcccttcatcatccaacccatttccatcgacaacaaccatggaaccagatgcccaacaagcacattctttaattcctatgttgcaaagcttattcaggggacagttgatgatcgtatataaccagcaggagttggctcacaataggccaatcatatctatggagcagtttctggaaaaagtggcatggcctgaagctcatctccctctggaaagatcccatgaggttgttcctcccgagcttgtactagctaggatcgttgtttctcctgggcctgtaccaactaggactgagccgacatcagctgagccacaatctcctgtaatagatccacctgtttctctgggacttgagatattgtctcctctagcaccacctctgataatcatccccaatgactcaactgatgaagctcatgctcctcctaattcaccatcttgcaacatagatgatggttctgacttttcctcctggatggactgctaa

SEQ ID NO: 40061 - DNA, 306 bp, Glycine max
  Peptide Sequence Number=SeqID_131746
atggttaagcagctaagggggaaagagattcccttggtcaaagtagtatggggaagtgcttcgggcgaggatgccacctgggaactagagggtcataaattcccactatataagccaaatgttaacctagagcaacattttggaaaacacattttgttcctttcttcttttctgacgcacaagaaccctaacagagcaaccagaggaggagctctagagagcactagagacgccaccattgctaatagagaatatttaagcgactacatcgaggtaagggatgagttactcacgcttggggattag

SEQ ID NO: 40062 - DNA, 711 bp, Glycine max
  Peptide Sequence Number=SeqID_131747
atggtcattgaccaatccctattctatgatctaactcaattaccaagtgaaggtgtaccatttaaaggtacactgattgatgattggaagtttgacttctctgtgcatgatgcccgccgattggtttgcaccaaccaagcggatatgaccggaaggcttcttgccggttcattggcttttgagagccgcatccttcattatctcatagtttctgaagaagatcttattgttatgtgggcttttcataaaggtctacaaattgattgggcacatcttgttagatatcgcatgcataaggcattgcgattaaatgctccattgccatatccacacctagtcaccctcttccttcaacactttaacatcccttttgattctgaaccttatgttccaatcaagagatcctttctaataggcgcttcagtcattgcatcctttggttatcaaaaagagcatgatgactcttgggtgaaaaagggtgctcatgttgatgaagaaggacatggtggagaagattcatctcttcttcaaaagattttggataggttcgatggtcttcaaacctttgttggtgaaaggtttgatactttggagttacaaaaggacatgtgcttcaatgagatggagtcaagaatcaccaaggtcgaagaagatgtttcttatattcgttcaagctttgatctaccaccaccgctgccaccatcatcttag

SEQ ID NO: 40063 - DNA, 429 bp, Glycine max
  Peptide Sequence Number=SeqID_131748
atgaccgatagattgctggccggatcattgaccattgataatcgcatcatgcactacattattgttagaattttgcttccccggtcttcaaatttggctcaagcctccgaggaggacttgattttgatgtgggctttccttaccggtcgtcagatcgactgggctcacttggttcggtaccgaatgcataaggcattacgggccaatgcacctcttccatatcctcaattggtcaccctctttctccatcattttcaaattcctcttgatgatgaatcttttgttcaagtcaagcgttcctttgctataggtgctggtgcagtcacttcatttggttaccgaatggatatccgtctcacacagcttgaagaagatgtgggttatattcatcagagcttcaatcttccaccaccaccaccaccttcttag

SEQ ID NO: 40064 - DNA, 213 bp, Glycine max
  Peptide Sequence Number=SeqID_131749
atggagcttgcatcaggtatcatcactcaagataataatattgtgacggcgaggctcacaggtgcactttccaaaggaggaaatatgcgcggagtcgccaccaacgaaggtattagcacctcttacgtcgacaaaagtggggcttttgctcctatgtaccctcctttggagaggaaatcagacctacgtagttctttcttatgcgtgaatcaa

SEQ ID NO: 40065 - DNA, 123 bp, Glycine max
  Peptide Sequence Number=SeqID_131750
atggtgcgcatgatccacactggtcttttggcagcggcacgggtgaaatcttgccccgttggtcgccctctaatatcagggggtggcccaggaactgataaaaggaaactattggccccttaa

SEQ ID NO: 40066 - DNA, 625 bp, Glycine max
  Peptide Sequence Number=SeqID_131751
atggcttctaggaaaagaaaggctccctctacacctacccaagccaaatttgatagatccagattcacttcccaagaggcttggggagatacactgacattgtggtgcctcacccttgttgttgtggaagatggggaaacactttgtgcttactctagatttacactcctgaggcctgatcctcaagagttagctgctaagctctgtatcccagggaggagattcgagcttaatgctgatgggcagcctttgaagattttgaggaagaacaagaccactcttgctcaaacttggagcgttctttccttttccaacctcatcctcacttcccacacttctgatgtcactcttgatagagccaaactcatttatggcatcatcatgaagatggacatgaatgtggggtacctcatctcccaccaaatctccctcatagcacaacatgacacatctagacaaggattccctgccgtgatcacagctttatgtacggctaggggagttcagtcagattcgaggtccctggagagccagagtcctgccattaatttggcatatattaagaagaactattggaatcttaatgatccaacagtaactttcagaggacccaggatggccaagg

SEQ ID NO: 40067 - DNA, 1067 bp, Glycine max
  Peptide Sequence Number=SeqID_131752
ggggactatacatcctcaccttcaaaggactacacgtcctcgccttcagaggactacaagtcctcacctttagagggctacatgccctcacctttagaggactacacgtcctcgccttcgggggactacatgtcctcgccttcaggggactacacgtcctcaccttcagaggactacacgtcctcgccttcaaagggctacacaccctgaccttcagagggctacacgttcacgccttcagaggtctacacgccctcaccttgagaggactacacgtcctcgccatcaggggactacgcgtcctcgccttcaaagggctccaagccctcaccttcaaagggctaaatttcctcgccttcagagggctacacgccctcgccttcaaaggactacacatcctcaccttcagaggactacacgacctcgctttcagaggactacacgtcctcgccttcagagggctacacgccctcaccttgagaggactacacgccctcaacttcagagaactacacgtcctcgcctttaggggattacacgtcctagcctttagaggactacacatcctcgccttcagagggctacaaaccctcacttttagaggacaacacgtcgttgccttcaggggactacacgtcctcgccttcaggggactacacgtcctcccctccaggggactacaggtcctgaccttcagaggactacacgtcctcgcctttagagggctacacgccctcacctttaggggactacacgtcctcgcctttaggggactatacgtcctcaccttcaaaggactacacgtcctcccctccaggggactacacgtcctgtctttcagaggactacatgtcctcgcctttagagggctacacgccctcacctttagaggactacacgtcctcgcctttaggggactatacgttctcaccttcaaaggactacacgttctcgccttcagaggactacaagtcctcacctttagagggctacatgccctcacctttagaggactacatgtcctcgccttcaggggactacacgtccttgccttcaggggactacac

SEQ ID NO: 40068 - DNA, 819 bp, Glycine max
  Peptide Sequence Number=SeqID_131753
atggccggtgatgaggacttcatggccgcactgcgcgacgacgaggccagcctgctgtcgctgactggcgcggccggcgcggtgatcgtgcacaagggcgattgcctgcgtgtcggccagtgcccttctgccagcgacgtgctggccctggcgaattggctggccacgcagcaggccggccaggaaacctactgcaccgatcacctggcagccgactggtcacctgccgcgcacctggccgacgtagccagcggcgtgctggcggtgtccatttcgcagttgcatgacagttacctgatgtggttccggccggaagtggtgcgcaccgtgcgctggggtggcgatccccgcaaggaagcagcgccgggcgtggcgctgtctccgcgcaactcgttcgaggcctggaaggagaccgtgcagcagcgcagcctgccgtggagcgatgctgactgcgacgcggcacacgagatgcgcacggccatcgtcgatatcgtgttgcgcaaggccgaggaaatggccgaactgaacgagcagctgctccgcatcaacaaggaactggaagccttctcctactcggtcagccacgacctgcgcgctccgttccgtcacattgtcggctattcggaactgctgggcagctcggcgggcgagcgcctgaacgataccgagcgccgcttcctggacacgatcgtggaatcggccaagtccgccggaacactggtggatgacctgctcagcttctcgcagatggggcgctccaccctggggcgtgtgcggatggacatgaccgagctggtcgaggatgtgcgctggatcctg

SEQ ID NO: 40069 - DNA, 564 bp, Glycine max
  Peptide Sequence Number=SeqID_131754
atgagggtgagaggtcatctgattatgtttgatgaggatactcttaacacatttttgaagacccctgttgttgtggaaaagggggaaacactttgtgcttactctagatttgcactcctgatgcccgatcctcaggagttagctgctaagctctgtatcccagggaggggattcgagcttaatgctgatgggcagcctttgaagattctgaggaagaacatgaccattcttgctcagacttggagtgttctttccttttctaacctcatccccacttcccacacttctgatgtcactcttgacaaagccaaactcatttatggcatcatcatgaagatggacatgaatgtgggaggacccaggaaggccaggggtaagagatctgaggtccctaccacttcagcaccaaagacaccagttccttcttcttccacggcttcattgcctcccactcagattccaattattcctccagtacctctacagataccacttacagctcctttatctgcaggtccatcagattttatttttacaccacaattgctgcactccatgctctag

SEQ ID NO: 40070 - DNA, 279 bp, Glycine max
  Peptide Sequence Number=SeqID_131755
atgtcatggttcctcttgtataggatattttcactcaggaagaagttggctgccagccttcgctacattctcttgtcgttgttagaggcatcctgtgggtattccttgtcttcgatgtatcatttgatattgaagtaccaaggtttaccatcctgctcttcttctatcaagcagaaatatgcaggcttgccacgacatctgaattcgatgtatggaaaatccccgtgtggggttaattggaacatggacgctagagtggcaagggcatcatccatctga

SEQ ID NO: 40071 - DNA, 198 bp, Glycine max
  Peptide Sequence Number=SeqID_131756
atgaaggctgatgcaatccttcctaggaaaggaccagttactagagccatgagcaagaggctccaagaggattgggctagagttgataaagaaggccttagggttctcatgaaccttaggctaagctctagcttctcaaggaagcttctcaaggaggtgagcttagtttttagatgggtgtgtgtagctaagctctag

SEQ ID NO: 40072 - DNA, 135 bp, Glycine max
  Peptide Sequence Number=SeqID_131757
atgggagaagcactcacaagtgtttctagaatacacgagtttcatggcgtctctaactatgaggcgaaaatgcaaggaagatgtgttctacgtgaccttcatgccaccttgaaggcatttgactcgtcaagctaa

SEQ ID NO: 40073 - DNA, 186 bp, Glycine max
  Peptide Sequence Number=SeqID_131758
atgttgcaccatcaacttcaaatgaaggatgaccacctattatctcaagatgaacaagctttgaatgaggctaaagaagctgttgctcatgtccctgcaactattgttccaccaatagcaaggaataagctaaccataacaagagccaaacaaaggaaggttgctgataaagatgatgcagtataa

SEQ ID NO: 40074 - DNA, 632 bp, Glycine max
  Peptide Sequence Number=SeqID_131759
atggggacaaatcaaaacggaaaaagattctatcaagtcaagatcaagggcctagatgtcaccaaccttagggagttgggacggttgatgggacctctccaaaggcaagccttccgcaaaatgtacggaaagattttagatttaaccacaacggaagtatttatggaagccgttgtatccctcgcccaatactatgaccagccgttgagatgcttcacgtttggggacttccaaatagtaccgattgttgaaaaatttgaggagattttaggatgccctcttgggggaagaaaactgtatcttttctccgggtttctttcctccttgagcaagattgcagctgtggtcggagattcgacgaaagagttggatcgtatgaagcaaactcgaaacggtgtagtgggcctaccgcggaaatacttggaaggcaaggcaaggggcatggcgaatcaagaggaatgggtcccgtttgtagatatactagctttgctgatctttggggttgtactctttccaaacgtggacggtttggtggacctagccgcaattgatgctttccttgcatatcaccatagcaaggagagtccggtggtagctatcttggcggacttatttaatacatttgaccgaag

SEQ ID NO: 40075 - DNA, 576 bp, Glycine max
  Peptide Sequence Number=SeqID_131760
atgttatcctttagccagatgcagtcccagtttcagtcacagaggcaatcacagggacttgcactgcctcctgagcctgaggttggtccttcagttgcttgtgtcagcataaaggagagttgtgttgatcccttagggaacgatctagacacaggaagagtttatgagggatccacaaccattcacaacatccctttgttgcatgatcaagtgaagttcggtattgaggaggttaaagatgcagatgctcccattcctatacccactgaagaggttaagttagtggggcatgcacttaacaccttccttgcttggccgacaaatctcgtcaagcgtttatcagaacagggagctgtgggaccgacaaaatctgcagataggccagatcatgaggtcgatgatcccctatatctaatgacattgatcatccaacagctttttttgaagccattgcaggttatgtgggatgctaccgtgtttggggtgtttaatgaagacttccccttgtacataaagcatgaagatctgtctgaaatagcacacagtggtcaatgtctcagcatctctgttatatag

SEQ ID NO: 40076 - DNA, 195 bp, Glycine max
  Peptide Sequence Number=SeqID_131761
atgggtatgaatgaagtagctgaagatgcacatgctggtgtagagccgcctcgacatgcagtggaggattgccaagcaatagctgaaaggttggagcggttgctcaacctaaggatagtcactaaaggcatagagacatacgatatcttggaggactgcttgcagatcgctagaggtgtgattgcggatcacaat

SEQ ID NO: 40077 - DNA, 594 bp, Glycine max
  Peptide Sequence Number=SeqID_131762
atggatatcattccagacaagtatcccctaagcgtgcagaatatcaaatttggatctaaattgtatgtcaacgctgatattacagagatacacgaatttcgtcaaagtttgtctgccccattttattttggtgggataatcaatgataaagatggttctcagtcccaatctagccagattgacgaaatcattattgatgctccatggagttatgatagttgtcctaactgtacaaccacattagatccatcaaaaggtggctcagcttgccattcttgccgtaccagtgtgatcgatacagttccacggatggagcataatggggacaaaggaaacttccttctctggaatgcaacatgtatcaagctgtttggtaagactgctgaagaatgtcgagatgagttgatagcggttggggatgatattaaagtgtttccaacgtgtgttgatgaaatcctgtcgaaaacttgggctgtcagatttaagttccgttcacaattacgccaatcatttgtgttggatgtgagtaaagaactccatcatattcaatcattgatagccacccttgggttgaaggtaatggggatcctctag

SEQ ID NO: 40078 - DNA, 435 bp, Glycine max
  Peptide Sequence Number=SeqID_131763
atgaccatgattacgccaagctcgaaattaaccctcactaaagggaacaaaagctgggcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 40079 - DNA, 441 bp, Glycine max
  Peptide Sequence Number=SeqID_131764
atgccgcgcctagcgagttgtgttgcttgggtcagagtccaagaggctgttggtcttctatgtcctccaggaagaggaaatccacagtctccagacccctggagccctatgacaccaccagattcatctctgaggctgcctaggagagagaggaacattgtcctctacgtcacagaatacgacgagttccgtcgggagctggagaggcgatgctggcataaatccttgaccaggcagatggatgggcacatagatgtggccctggagctttctaagacatttttccaacatctgaccgttgggattttgaaaataacaacttttgatctcttgctaggcgagaatggcgcgctaagtgcaattccaaccaaagaaggaattgcgctgagcgccccgaggtgcgctaagcccaattccaaccagagagggaattgcgcttaa

SEQ ID NO: 40080 - DNA, 228 bp, Glycine max
  Peptide Sequence Number=SeqID_131765
atggaatacgattcgctttcaagatgccttggtggtgaaatggtagacacgcgagactcaaaatctcgtgctaaagagcgtggaggttcgagtcctccttcaaggcataatattcgagatctcttattcggaatgtggaataagttggcagcgaggttatcagaaatcttggtggatcctctacgagtgttgtttctgaaatctccctacctccccgggattatttaa

SEQ ID NO: 40081 - DNA, 548 bp, Glycine max
  Peptide Sequence Number=SeqID_131766
atggttaggactagaggattaggtcatgccttaggtcacgttactggcagagcgcacgatgagccagtggtccctgcaccagatgttgaggctgatgtatttccggatgacccgatgacaccagctgatgtagaggacattacggcagacattcctgcgaacacaggcgcggaggctgctgaggatgagcatgagggattttcgggtggtccgagcgaccctacccatccgcctgtccctgccattgagggactcgttgctgggacaagactaagtcctctgatcgcatgttcggtagacaccgatgatcggggacttttgtccccgttggtggagcgatggcaccgggagacgtctagtttccatctcccggtgggagagctcacgatcacgctggacgacatctcctcgcttcttcatctgcccgtggttggcaacttgcacgcctttcaacccttgcacgtggacgatgcggttcagatgctggtggacttattgatggtctctgcagagtctgtcagggctgagatagcccagtgtcgtggacc

SEQ ID NO: 40082 - DNA, 567 bp, Glycine max
  Peptide Sequence Number=SeqID_131767
atgccaaaggtgaagtgttttagaaatccacaaaaatcagcacctcaaccacaatgtccctcaccaagtgattccacacaagctcctgaagtcccaactggtaatgtccctctttctcatgtatcaacatctgaagttccagcaatgaatcctgaaatttcttccccaccaagtgattccacacaagctcctgaagtcccaactggtaatgtccctctttctcatgtatcaacatctgaagttccacaagaagatgaaacaactagacgtcatgttgggcgtgagtctacacactggtggactgttgaggcaatagactctgaagaaacgatcaagaagattaaggtgaaagttaggggagtcaatagcttacctagggagttaagcatcattgtgaattttgatgaccaaggccaagcaattggtgaagcacaagccttgcttgcaggatttcttggaacactagtagctgattgcaaattatttcctatggattatgatagatggtctggaccttcaggcgtacctaaagcatattttgatgattgctttgaaacaattttaaag

SEQ ID NO: 40083 - DNA, 204 bp, Glycine max
  Peptide Sequence Number=SeqID_131768
atgaatttaagaggaagacaagtggagatagctgatccattgtgcccattctacaacaatttggatgaagatgcagcgcaccttttcttcaactgcagtaagatagagtacttgggacatatagtttcaggtgaaggagttgctatggatgctactaaggtgcaggcagttctagagtggcctacaccactcaatatcaagtag

SEQ ID NO: 40084 - DNA, 379 bp, Glycine max
  Peptide Sequence Number=SeqID_131769
gttgccgtctcttgtgacggacgcatggggtgctaataccttccccgtgcgtaaatacaactcccgaacctttcacttagagttcgtagatcacgtcttttccgaaataaacgttggtggcaactccgcgtgtattcctttctcggaacatgcacccgcgagtcacacgtcgccctcccacctaagggaatttcttgatgatattgcagattctttggaagatacacacaatgaagaaagaaatctaaaaaggaagagagatgaagaaaacaaggatgatcataatgacacagcccaagaaaatgataatcttcccaaagaatggaaaacttcaagaaatcatcctcttgacaacatcattggagatatctcaaaaggg

SEQ ID NO: 40085 - DNA, 297 bp, Glycine max
  Peptide Sequence Number=SeqID_131770
atggtcatagaccaatcccttctctttgaacttactcaattatccaatgacggtgtaccgtttgagggtacacttgatgatgagtggaagttcaatttttctatttttgatgctcgccggatggtttgcaccaaccaagtggatatgaccggaaggcttcttgccggttcattggcattcgaatgccgcatcatgcactacttgattgtgcgcatcctactccctagatcatccaaccttgcacaagtttctgaggaagatttgataattatgtgggttttcttaaccggtcgttaa

SEQ ID NO: 40086 - DNA, 204 bp, Glycine max
  Peptide Sequence Number=SeqID_131771
atggataaatttgacatctttgtccctcatcctctcgtaattacatctttgcttccactggaatgcgggtgcaagccattggtttgtttgctcgagcgacatgcgctcctgagtgttgacttccaagaccattcaatcagaaattactcgtttgcacgttggtgggggtgccgtaaaacaacgagtaaagttcaaaacaaataa

SEQ ID NO: 40087 - DNA, 171 bp, Glycine max
  Peptide Sequence Number=SeqID_131772
atgaacggtagaaaccaatcaaggtacttaaggacggatgcaagtggggatggggtcacggccaaccgatcgttgccccttctctgcgcgaaacgagcagagaatgtcgctgcaaggcagccccgtatcctttgtattttgcagctttcttttactatttgtttgttttaa

SEQ ID NO: 40088 - DNA, 255 bp, Glycine max
  Peptide Sequence Number=SeqID_131773
atgactaaagcacgtcaaaagggggtacgaaaagtaaatgaaatgaaaataaaagtacgcgaaacaagtggggacgaccaagggagagttgaacgtttttgttcttccctcctctccctatttatagggaaaagagggagaagcttgccacccagctcgcccaggcgtgctaggttgcttcctccagaaggcctggaggaacttcttggaaggcccaagtgggcctggttgctatttgcacccccagtttactaa

SEQ ID NO: 40089 - DNA, 219 bp, Glycine max
  Peptide Sequence Number=SeqID_131774
atgcaaaggctgaagtgcttaaataagaaatgctctcgggaatgggagcttcgagcatactccatacatcttcttaaaaatcccaacggtaaaatcgtggacaagtgtcttgtgaagctgcataccaaatttggagaagatccaacggttaacaaaggctgggcagcgtttttaccgaggcagcttcatgtagcttcctcaagaagcttcattaagtga

SEQ ID NO: 40090 - DNA, 399 bp, Glycine max
  Peptide Sequence Number=SeqID_131775
atgaccattcgaggcattgggctcaatggtcccgatgacatctattccccacatggagaaaggccaaggggcagacaagacattcagaggatgcagcggggaattgacattgtccgcgaatgcttgacatttgtggcatttccttacatggacacaacaatcactttccatggtaagccacatgcccgttggcgtgcgttccaaacgagccctcatggacttcctcgatcatgtgattcgcctccttggcatccacgcaccgcaggagtgtcatgtcgtggtttctcttatacagcttaccaaacccttcctcctctacttggcaacaatgtgtgggtttgccacgacaccaaaattcaatgtatggcagatccccgtgcggcgttagctggaacatag

SEQ ID NO: 40091 - DNA, 399 bp, Glycine max
  Peptide Sequence Number=SeqID_131776
atggacgaagatcaatggaggtatgactttgcgatgtcacaagaagttcatatggattatgattatgataatcaagaagaatgtggagtgaatgaaccacatgtcgattgttcaaatgcttttaatacatctcaggtattcgctactcgagatgatgttttgcaatgggctcgaacagttgcccatgaaaatggatttgttgcagtgattatgagatctgacacagagaccggtagcagaggaagaagttcatttgtgttaattgggtgtgaaaggagtggtacgtacaagtgtagaaataaagaattcgttagaaaagacaccgggagtaggaaatgtggttgtccccttcaggcttcgtgggaaacccagtgcgtggaggggaaggttggatggtga

SEQ ID NO: 40092 - DNA, 482 bp, Glycine max
  Peptide Sequence Number=SeqID_131777
ccttcgcttcaaaagccttcgcctttcagcatggcaaggaaagcccggtcgtcgccattttggccatgtatgacacgttcgaccggggatgtgaaaagagcggcgcaagaattgtttgttgtacaccggctctctatgtgtggctggtttcgcacctttttctccaagaaggtaggctcgtctatccgctacaaggaaggaagaatcaggattctatcttcatgcgaaagatttccaaatattcccttaatgggaacaagggaaaggacagagagcttaggggaagcagtaatgggatcatcggcggctatcataagtggctgagagtccggacacaaggattggattggctcccaaatctaaagattgtgagagacgatgaggttaaagcttcgaaagaaagtgatgaggtacaagccctaaaggcagagcttgaaagagcccgggtagtcaaagagaagttcaagtccatagccatcaaa

SEQ ID NO: 40093 - DNA, 451 bp, Glycine max
  Peptide Sequence Number=SeqID_131778
cttggaggggttgatggggacctggtgctgagaggaacgaggataagggctacgtgggggtacgtgagctcagttgaaggtgggcaactggggatggtgggttcatgtttgatttgtggatgtgggagagttgattttgcaccatcgcccgatcgccacctagtaccacatatgacggtggtacctggagatatgtcgcggggggtcaggagacttggggacgtcaggcgagctcctgacagtcaacagataaaaggaacaaagaccacaaagcaaggaggcttgtgtggtggctggccagctgtgaatcttgaggctaagatggtctctggtaatcgattaccaaggcttcaaaaagggaactggaagactatggaggcctctggtaatcgattaccagactgtgtaatcgattacacagaggaatgggtcactggtaatcgattaccag

SEQ ID NO: 40094 - DNA, 826 bp, Glycine max
  Peptide Sequence Number=SeqID_131779
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcccctcaaagatctagaaagaatatctggcgtagctgggtggctcaccaccacacaaccaattcaagatggactattccccttaagagattggcccctgatcctagcgattcagagaatgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40095 - DNA, 306 bp, Glycine max
  Peptide Sequence Number=SeqID_131780
atgccgatctccccctgcggaagtatcagttggtctgtgccgtcccgacatagggatcgcgcctgcaagacacccagtggacccggaggagcccaacagggccctggggtttccggctctggttacgggcctctgttagtcctacagggtgcctgttccccccagcaagggatcgcgcccgcaagacacccagtggacccgaagaagtccaacagggtcttggagttgccagctctgattacaggcctctgtcagttctacagagtgcttgtcacccctagcaaggtcatcaggccccccttataa

SEQ ID NO: 40096 - DNA, 204 bp, Glycine max
  Peptide Sequence Number=SeqID_131781
atgaaggagataggaaaagaaaaactccctaagtcttggtggaaaagaagtaagctgaagtgccttgctaaaatctcttataaagcgcctgtagaatcctacatgaccaagaaaagatcgcacctctcgcacgcaagagggggcattgcacaggccgaaaggcatcctcctataggcaaaagtgccgaaagggcagtgaatgtg

SEQ ID NO: 40097 - DNA, 591 bp, Glycine max
  Peptide Sequence Number=SeqID_131782
atgaggaggccatcgcccagttgctatgtataccgtggcaaggattttgcccggactgctgctggaagacgggtgcagatcatgcgcaccaacatgaccaccctgactcagatctggatgactttgttgtcagcaacatccagcccagcgatcataattctgacctccccctgccgaagtgtatggcgcctaccaggcaccctctggacccagataagtccaacagggccctgggatttcccgcccttgatcacaggactctgccagtcgttcggagtccccgtcgcacctagcaaggccgcagacgcgctgccacctcatcaggctggcccagctggatcatttgatacggagcagtatttgcggcatttggttcgccagcaggcggccaaccaccgggcgcatggttttacttcttttccgtgccctactctagaccagttcagggcagaggtcgcatggcctggagattggcctgaggcccgggcaggagaggcaccagcagaggctcccgacgaggcagatgaggcccgcgaggacgaggagatggccgatttacttgatttcttaggagggagcggagccacatga

SEQ ID NO: 40098 - DNA, 450 bp, Glycine max
  Peptide Sequence Number=SeqID_131783
atgattatgaggggtcaagacatttatagtagccaagaggagactacttcttccccttcctttagtggaagcgaagatgaagtaaggggtgaaaagtctagtgaggaagtctacccccatgaagaaggtgacctcctaatgaaaaagaaggatagtaaggccttgtcttcaaaggccaaggggaaggaaaaagaggaaaaggattcctccaagaagattgttaagaaggacaatcattttgcaacaaaatgtgatatcaaaagagcactccttcttaaacaatctttctaccttctcctatcaagggaaacatcccttagcactgccatacctcttaggcttgagtttattcctcaagtaaaggagttgttggatgagggttttgttcgcaagagcttaaatccttgtgctttgttggtttccaaaatagtgattaaggggttcccatga

SEQ ID NO: 40099 - DNA, 459 bp, Glycine max
  Peptide Sequence Number=SeqID_131784
atggtggtgacgggtgacggagaaattagggttcgattccgggagagggagcctgagaaacggctaccacatccaaggaaggcagcaggcgcgcaaaattacccaatcctgacacggggagttaaaaagctcgtagttggaccttgggttgggtcgatcggtccgcctccggtgtgcaccggtcggctcgtcccttctgccggcgatgcgctcctgtccttaactggccgggtcgtgcctccgcatgggataacaccacaggattctgatcctattgtgttggccttcgggatcggagtaatgattaacagggacagtcgggggcattcgtatttcatagtcagaggtgaaattcttggatttatgaaagacgaacaactgcgaaagcatttgccaaggatgttttcattaatcaagaacgaaagttgggggctcgaagacgatcagataccgtcctag

SEQ ID NO: 40100 - DNA, 354 bp, Glycine max
  Peptide Sequence Number=SeqID_131785
atgggcccttatcctcgttcctctcaacactgggtccccatcaatctctccaagcttccacaacatccaagcaatacaacatccaatcatcctgaactatcaaagccaagaaaacaggacagaggcagaaaactctgcccaaaaacacaaaccaatattgatgaggacatgaccaagagcaagggcaaggatccacttgaaggacttggaggacctatgacaagggctagagcaaggaaagccaaggaagctcttcaacaagtgttgtccatactgtttgaatacaagcccaagtttcaaggagaaaagtccaaggttgtgagttgtatcatggcccaaatggaggaggactaa

SEQ ID NO: 40101 - DNA, 501 bp, Glycine max
  Peptide Sequence Number=SeqID_131786
atgggtcgactgactaaagatgagaagattgttgttgttgatatgacgaagtccatggtgaagccaagaaatattcttttgacgttgaaggatcacaacaccaacagttatacaacagtcaaacaaatttacaatggcagacatgcttaccgttctttcataaggagtaacactgaaatgcaacaactcatgatgttgcttgaccgagatcaatgcaaagtgcaaaaccctggttgttcaaaagaatgcacgggattatgtgatggaggcttggggagtttggttgattgtccatgtgagagttcttttgatgagtaccttaaaaactttgaaatgacttgctctccgtggcctatgtttgtggactatgtgtgtcaaacatgggtgattctgcacaaagaaaaatttgtgaaagcacggaccaacaaagtgatgcatctaggaaacaccactactaacagggttgagagtgctcatcggtcattaaagagactcctataa

SEQ ID NO: 40102 - DNA, 492 bp, Glycine max
  Peptide Sequence Number=SeqID_131787
atggcatacagaggacagctcgcaaggtgcttgactgcggtttctattggcccaccatcttcaaggatgcatggagaatttgtagcacttgtgagccttgtcagagagcaagcggctcacttttatggagacagcaaatgcctcaacaacccatattttatggggcctttccctatctcttttggttttgtttatattccccttgatgttgattatgtttcaaaatgggtggaagccaaacccaccagaactgacgatgctaaggttgttgtggattttccgaacagaaagggttggagcaccagactggatgatgctctttgggcgcataagactgcctacaaagcacccataggattgatggaagcttgcttgtggagctctatggaggctggatctttgagctcaatgaggtcttcaatggtgattttacaccatggagatgcagcagaagacaaaggagaagaggtgagaggaggcgccatccactag

SEQ ID NO: 40103 - DNA, 821 bp, Glycine max
  Peptide Sequence Number=SeqID_131788
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaatctcccaaccatcaataaacttaaacatcgctaaattggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40104 - DNA, 423 bp, Glycine max
  Peptide Sequence Number=SeqID_131789
cagagaccaagtttggtcattctgcacccttgtatcatccagaggtggcgggcccgatgatacgcggagataccttacggttatccgcacccttttgtcatccagaggcggcaggcccgatgacaagcagagaccaagtttggtcattctgcacccttgtatcatccagaggcggcgggcccgatgatacgcgaagataccttacggttatccgcacccttttgtcatccagaggcggcgggcccgatgacaagcagagaccaaaggcggcgggcccgatgacaagcagagaccaaatttggtcattctgcacccttgtatcatccagaggcggcgggcccgatgatacgcggagataccttacggttatccgcacccttttgtcatctagaggcggcgggcccgatgacaagcagagaccaa

SEQ ID NO: 40105 - DNA, 428 bp, Glycine max
  Peptide Sequence Number=SeqID_131790
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcaggcaaggtgggaggggggaggatgagcaacgtgtcgggaagtctattgaatttgggtcttgggcgcttgatcatggacctggggcgtggaagattttgaatgtgtttttgtga

SEQ ID NO: 40106 - DNA, 732 bp, Glycine max
  Peptide Sequence Number=SeqID_131791
gaagtagccgatctggacattggtggagtccacaagtttgatgaagcgcctgatgggtacaacaagatgcagacctatatgggaatgcttcttgacccggttaggaacttgaggaatcgcttaggagttggtggactgactgaaaaggaaaaaatgttagtatacctcattacctacattctcacacctaggtcaagcaatcatgctcaggcaacggatgatgatttacagatagtttatggtctgaaatcaggtatcaagatgaattgggtattgttgattgaagatattatgttgaagtgtcatcttcttttggattatgaatttccttatgttgtgcttgcctcaagattcattgactatttcaaggttgatatctcttatgagattgtgaactttactaaagccttcagtgagattaccgaaaggcatctcaagaagcttggaatgaggtttattgatcatgaatggataatggttggagagcctgaagctggaaacattgacgagatggaagaagatgttgaagttaaagctccacaaaagcatgtacatcaatggagtccttttgagtttcttatgattccaaagatggatgctatgcttcccctccatcaagagcactcagctaaatttcatagttctgcagacaatataattacccgactggaaaactttgagactaggctgacccttagcaaccttcttaatcctaataaggatgaaacttaa

SEQ ID NO: 40107 - DNA, 49 bp, Glycine max
  Peptide Sequence Number=SeqID_131792
atggcgccaaaaacttgttcgctttcggcaagtgcaccggatcgcacaa

SEQ ID NO: 40108 - DNA, 468 bp, Glycine max
  Peptide Sequence Number=SeqID_131793
aactggcgatgcgggatgaaccggaagctgggttacggtgcccaactgcgcgctaacctagaccccacaaagggtgttggtcgattaagacagcaggacggtggtcatggaagtcgaaatccgctaaggagtggcgcggcggtcgctgcaaaacccagggcgcgagcccgggcggagcgggtcgtcggtgcagatcttggtggtagtagcaaatattcaaatgagaactttgaaggccgaagaggggaaaggttccatgtgaacggcacttgcacatggggaatcgggttaaaattcctgaaccgggacgtggcggctgacggcaacgttagggagtccggagacgtcggcgggggccccggaaagagttatctttttctgtttaacagcctgcccaccctggaaacggctcagccgggaggtagggtccagcgggctggaagagcaccgcacgtcgcgtggtgtccg

SEQ ID NO: 40109 - DNA, 831 bp, Glycine max
  Peptide Sequence Number=SeqID_131794
atggaaccaattgcctccctcgcccagtattatgatcagccgttgaggtgcttcatctttagggacttccagctatcaccaatggtggaagaatttgaagagatcctaggatgtcctctagggggaaagaaaccctacctcttctcagggttctatccctcattagctagaatttccaaagatagtccaaatctcggcgcaggaattagacacaggaagcaagtcgaaaatagggtggttggaataccgagaaaatgtttggaggcaagagcaagaatcttggcaggtaaaggcgaatgggccctgttcatagacattctcgcactgttgatctttggaggagtcctctttccaaatgtggatgggttggtggacctagcagtgattgacgcttttcttgcctatcatgaccacaaggaaagcccggtcgttgctatgctagccgacctctatgacacctttgaccgaagacgtgagaagagcagtacaaggattgtctgctgtactcctgctctttatctatggggttgcatcaattacaatcccgttcttgcgataaggcaactgggctacccgatgaaaggggcaccactagaggaagagctcgcacctgtcatttcacgaggtttcaatgagaccaacatggagacacttcagaaggtccgcaaagcatgggaggtgtcataccctaatttcgtccggggattattacttgatgacatgcaacctttgattggccgctttgagatacttggcatcctttgttgcacaatatgtgaagtcccgagacatgccggaaatcaaaaggatgcaggcttacgcgatccgtga

SEQ ID NO: 40110 - DNA, 107 bp, Glycine max
  Peptide Sequence Number=SeqID_131795
atgaggcttcactatcatcaagcgagtcagagacctagcatgaccacagattcacctccacttcttatggctcacatagacccgggcataaggcctaatatctcaat

SEQ ID NO: 40111 - DNA, 397 bp, Glycine max
  Peptide Sequence Number=SeqID_131796
atgaacaaacttgaacaagtttgggaccaaacttggcattggatggctgatgacattgtctataattataaaaaatcatcaacaagtccagcattacagcttgatgatagaactcttcaaaacctggtcttgcttgaaattgaacaactgttgcaagcaaatcaaagatcgcttacagactatccttcaatgccatatccagaagatgcgaattgcccaacctatctagacaatagccttatattagctgaactcaattacaacaatgaagaactcatatcaaagtttgaacatctattttctcagatgacagacgaacagacatcaatttataaccagattattgaagttgttaataaagatgaaggtggtatgtttttcctctatggatatgaag

SEQ ID NO: 40112 - DNA, 919 bp, Glycine max
  Peptide Sequence Number=SeqID_131797
ggctttcccggtatcaacagggacaccaggattatttattctgcgaagtgatcttccgtcacagtggcttctgtttctatcagctgtcccttcctgttcagctactgacggggtggtgcgtaacggcaaaagcaccgtccggacatcagcgctggcaagtgtagcggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgcctgaaaatataccactcaatgtcgtctatgaagatgatgatattatcgtgatcaataaagaagtagggatggttgttcatccaggtgctgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaaggcagttcgctccaagctggactgtatgcacgaaccccccgttcagtccgaccgctgcgccttatccggtaactatcgtcttgagtccaacccggaaaagacatgcaaaagcaccactggcagcaggccactg

SEQ ID NO: 40113 - DNA, 457 bp, Glycine max
  Peptide Sequence Number=SeqID_131798
atgaggagtgagaactctggaaagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacaggaagtgagagggccgcggcaaagccgtttttccatagctccgcccctctgacaagcatcacgaaatctgacgctcaaatcagtg

SEQ ID NO: 40114 - DNA, 356 bp, Glycine max
  Peptide Sequence Number=SeqID_131799
gggcaggatcatcttgagctaccttctggggtgaggacaaaacatgaacagcagaaaccaaccaaggaacggatgcaagtgggaatgaggtcacgaccgactgatcgttgccttttctctgcgctaaacaagcagagaacgtcgctgcaaggcagccccgttagctcgcctgggcgagctgagctcgcctgggcgagccaccctgtcgcaacctacccttcggcgggagggcgacgcgagactcgcgggatgcgtgttccacgaaaggaatccgcgcggagtcgccaccaacgtttatttgaggaaaacgtcggaaaaaccggaaaagacgcggtctacgaactttttagtgaaag

SEQ ID NO: 40115 - DNA, 216 bp, Glycine max
  Peptide Sequence Number=SeqID_131800
atgtcagttaaaaaccttgtcgggcgcctaggagtacatgacaagacaaaccacacaatatcaaggtcacaatattttgcgagaatgctccaaccatatgggatcaacataggcttaaaagagcactcaaatcgtgtgacccctaaggcctacactccgaagagtctgtcagggcctctccctcctgattcaggtccaacccagaaaatattttag

SEQ ID NO: 40116 - DNA, 516 bp, Glycine max
  Peptide Sequence Number=SeqID_131801
atgaccacccttacgtggatgacgttgctatttagcaacattctgcccagcgaccacaatgccaatctccccttgcagatggatcgtgcccacaagacacccagtggacccggagaagtccaacagggccctggggaatggcacccacaagacacccagtggacccggagaagtccaatagagccctggggtttccagctctggttacgggcctctgtacggtgcctgttccccccggcaaggtcatgccatcgtgacataggatcgcacccacaaaggcaccaagtggacccagagaagtccaacagggcccttgggtttccagttctggttacgggcctctgtagtcctacagggtgcccgttccccccggcaagttctacggagttcctgtcacctccatcaagggcatcaggccccatactaatcgagctttcatcaagaagtactgcgtccccaggtaggcgcggggcgaaacaccacagcagcctgaggatggccgacagcgggcaatag

SEQ ID NO: 40117 - DNA, 597 bp, Glycine max
  Peptide Sequence Number=SeqID_131802
atgtcttgcctagtgatcataactctgatctccatctaccgaagtgtcaactggtgtatgccaaccaccaggcaccctctagacccggataagtctaacagggccctggggtttctggcattgatcacgggcctctgccagtcgttcggggttctcgtcactactagtaaggtgatccgaacgccaatcgcccaggccttcattgagaagtattgcacgcctaggcaggcacagggtgatgcacctcaggccgcagacgcaccgctaccacctcatcaggctgatcccgctgggtcactaggcatggagcgttatctacagcacttggttcgccagcaggcggccaaccaccgggggcagttgcagatacatgagtgtctctaccagctcagcctcagtcagcaggggcagggtttcgctccttttgcatgccctactccagagaattttagggctgaagttgcatggcccagagattggcccaaggcccaggcaggggaggcgcctgcaggatcccccgacgatgcagaggagacccatatggatgaagagatgatggacttgatcggtttcttgggaggaagtggagccacgtga

SEQ ID NO: 40118 - DNA, 46 bp, Glycine max
  Peptide Sequence Number=SeqID_131803
atggcacatcaaccagtttttgaaaaaatgtgtatacacctgaagg

SEQ ID NO: 40119 - DNA, 159 bp, Glycine max
  Peptide Sequence Number=SeqID_131804
atgctccaaccatgcggcatcggcacaagcttaaaggagcactcaaaccgggtgacccccaaggcctacactccgaagagtccgtcagggcctctccctcctgattcagacactgctcatgaattatacaatacccaggacctcacactcgtgttttga

SEQ ID NO: 40120 - DNA, 255 bp, Glycine max
  Peptide Sequence Number=SeqID_131805
atggtgagcagtagaacgaagaagaagaacgcgccacaaggtgaagcaccaccaccagtcgaggtcgcgcaggaggaggaagaagaagaatcaacccacgccgccagcagaggtcgcacagaaggaggaagaagaagaagcagtaaggtcgcggaagaagaagaaaagcctcgtggaaaggaagaagaaatggctcgctgggtgcattggttttttttaaaaataacaaggggcatttgtgacttttcgcattaa

SEQ ID NO: 40121 - DNA, 108 bp, Glycine max
  Peptide Sequence Number=SeqID_131806
atggagaaatttaaccagaagatgaatggcagcggaatggagaaggaagagaaagaggagacgccacttcaaggagaagatgagtctagaagaagctcaccaccatag

SEQ ID NO: 40122 - DNA, 1251 bp, Glycine max
  Peptide Sequence Number=SeqID_131807
atggcgggttgttcttcaaattttgctgtggctggttgtgccaatgtgaggaaagagattgttttggggaatcaaaagacaaacttgattaggttgagtttcaggggtgtgttgaatgaggctacatttcaagttctacgtgggagcaagtgcagtagatcatgtgtgcctattcaaaagaaagcaatgttttttgtaatgagtatgtcacaaccgtcggctgaggctgaattggaatctgctgtgagttcaataggattatcagaagggggaggtgatagtgtcctgagaaaggaccaagagactcgggatagtgaatcggactccaaaattgatagagatgatgataatggagttgtattggatggcagtggtggtaatgggagctttggaagtggtggagcgggagatgggagtggagggggtggcagcaatgacgatggtaatgacaatgaagaggaggagtttgggccaatactgaaatatgatgaggtaatgagagagacagaggctcgtggagctacccttcctttggatatgatagaggctgctaagagtgtgggaatccgcaaggtgctgcttcttagatatttggatctgcagggatctttttggcctctaggatttttcatgaaatcgtgctctatgcttcgcaatcgaatgctagctgatccagcatttcttttcaaaattggctcagagatagtcattgatacttgttgtgctacttttgctgaaatacaaaagagaggcaaagatttttgggccgaatttgagttgtatcttgcagatcttctcgttgggcttgttgttaatgttgctttggtaggtatgttggcaccctatgctcgattagggaaaccatcaatatctagtggattccttggtagaatgcagaaagcttatgcagccttgcctagcagtgtatttgaagcagaaaggccaggatgtaggttttctgtacaacagagacttggaacatacttctacaagggtataatgtatggtgctgttggatttgcatgtggtattataggccaaggcattgcaaatatgatcatgactgcaaagcggagcataaagaaatcagaagaggacatacctgtgccacctcttgtgaagagtgctgctctttggggtatgaaagccgccttaattgcggtagtgcctatttgtggcctctttgtggctgccttaattgcaacatcaagggtggtgtttagtcccacatcgactatagatatagcttag

SEQ ID NO: 40123 - DNA, 237 bp, Glycine max
  Peptide Sequence Number=SeqID_131808
atgtcgacgagtcatccttccctcgtagcgatgtgcgcacatggtatcttggtcaccctgggtgttgatgagtgctcgttccctttggggcgtcgcacacgagcctctaagttggttggccttcagttttcggagttcctcctcatggagtcgctcaatctccgcaatacgggattggagctgttgaagagtgtcattgcctgtcatggttgttgggggaggattggatctttatag

SEQ ID NO: 40124 - DNA, 444 bp, Glycine max
  Peptide Sequence Number=SeqID_131809
atgggtgatttgaggattcttccggctcatcctataagtcacttttggcaacattctggaaacataaaagggagtaaggcaaaatcggttgaaccagtcctttacctcgcaagcttgttttcaaccccgacgttgttgccggcagctctaacgtcatcttctacatcgtgggtgacccctccgacgtcctctttgtcccctccatgtaagggtggggcatcacctttgtcttcgtcatgtcctatgatggttaagtgtaaatgtgaggtacctgctattatattcacgtcgcgtagtgtgaaccatctgggagaagttggtggtaataatgttttcgtagaagggtgtgagttgatccactatgttcatgaaaatgaagagctaaagctgaaacttggttcattaatggaggaagctaaagcaaatgcaaaagaaatagcataa

SEQ ID NO: 40125 - DNA, 285 bp, Glycine max
  Peptide Sequence Number=SeqID_131810
atgactcctcaactaaatgagtcttcccacctaaatgtcgagccaactattgatatccatgttgctcagtctcaaagcaatgaaatgtcacatgactatcatgctcaaaatgggttgccggatgaagtagttggtgacttcagtgacgacgaagacaaaattttggtgaacagcaacaacattaacgacaacaacgataatggcatacaattccctttccaaccaacatcaactgaaaatgtctattgtccatatccaaatagcattgatgttggtgacaactaa

SEQ ID NO: 40126 - DNA, 720 bp, Glycine max
  Peptide Sequence Number=SeqID_131811
atgtgggcagagtggcaacaacatgtcattcggttaggtgatgttgtgccaccctgggggagagccaccatgtcctcttgtacatttactatccatcccaatgtagctaccgcttgggcagccactggcagagtatgtaccaagtggagactacatttgctagatagtgctaggcgcaatgcagagcttgttgaacctcaaagctatactagagggcacaagtcatcatcagaccatataacaagctctccaattgctgcaggagggcttcgaagctgggtgcagcttagaaaggcaaaggaagatggctgccaagggcaacaggaagggtggcagaggcaggtgttggagacaccgatattaatagttgcaaagaacggtgtgacagaaatggtagagaaaatcattgactcgtttctagtagctgttcatgatatggatgccaagaaaaaaaatatagtgctattgacagtagagaacagacaaacttacttatataacttcttgctcaacaagaaaaatctaaagaaaagtaatatattcggaaaagtggataacaagggaaacagtgcattgcacttggcagccaaacttggagactataaaccttggctaattcctggcgaagctcttcaaatgcattgggaaatcaagtggtacctggggatacacactcgcgtgatatcagaaatggaagcaatgcagctaatggtgaaataa

SEQ ID NO: 40127 - DNA, 639 bp, Glycine max
  Peptide Sequence Number=SeqID_131812
atggttgtctcaattgcagagaaaccatcagttatagaaggaaggacactttccttaatatctggtcaagcttctgcctccgagcttctgcctttcatctcctccgatcacccctctttctccgacaccatctatgacgtcccctccccctctacccatggtccaactctcccacgcgctgctgcgcggctcgtacctgcttttgttggagagaagaatcacggccccaccaacgcggaaaaggcaattgggtatgagcatggccttgttgttcccgaagtaccaattctgggttatgttcttggtactgacgatgacggcgtaggtgttggggtgaacctaaagcatgtcttttgcgagctcaacggcgatgatgtcggcgctgcagcccatgccgccaaggttgaagcttttgacattaccgcagagcttgtacttgttgacgatcatggaggagagggaaggggtgcggttgaagaggctgcagttgacgacaaggatgccgatgtctttggggttgacaagggggaagctcggaggagagagagagagcaactttcgttgggtgcgaaagtagtttcactttcgtaccctagaattcgcccctttcactggcttacatcatctagggaagtttag

SEQ ID NO: 40128 - DNA, 519 bp, Glycine max
  Peptide Sequence Number=SeqID_131813
atggaggagaaaaagcacacacgaaagttgaagaacaaaggaaagggtagcacactggaggagaagctcaggaatttgggggaggagaagctttgtaactttgaaataaaaagaatgctcaacgttcaaaaacgttcaaaagcaacgttcaaaaatcacatgcaaaccctgcaaaccctagttcctacaacactgaagcctaccctggaacactgcaaccctaaaacgctgggcaaaccctgcaaaccctgtctcgccaatgggataggcgtgaccctccagctcaacacttctcgccaatgcagttggcggatccaacgtggaagattctcgcccgtgccattggcggcaccctctagctcaacagtcttcttgccatcttcaatggtggcacccagccatgtcagcagctttctcgccactggtgatggcggtacgaccttctcgtcagttcttctggcggcatccttgcaagaacagactctctttgcaaattgtttaaaaaaagaccctctttga

SEQ ID NO: 40129 - DNA, 336 bp, Glycine max
  Peptide Sequence Number=SeqID_131814
atgccactaatccttggaaacactggttctggaagcacaagtcaggtcaagaaatggaacatgaatagcacaaggtgggaaggttacattaagcaaaaaggcaacagaaatgaagagaaagaaggagttctgaagcaggcccagcccaacactcgcgctaagcgagcaaagaagacaggcgctaagcgaggcgttgagctcgaagatgtagaatccgttacgtgcgctaagccccagctacgcgctaagcacgcgatccaacagaagcacaggctaagcctgcagggcgcgctaagcgcgcgatccgaacgcgctaagcgcgaggtgtcgcgctaa

SEQ ID NO: 40130 - DNA, 309 bp, Glycine max
  Peptide Sequence Number=SeqID_131815
atggagatactaaccctgtggtatagagctcctgaagtcctcttgggagctacccattactcaacagtcaacaagtggtccgttggctacatatttggtaagaacatgaggattcaaggatcttctgctgaacttgtcaccaaacaaccactctttctaggtgataccgagctgcgacaactccttcgtatattcagcgccatgcccactccgaaagagatgagtgctcatcaattctttaccacttggcaactccaacagtatacccacaaggttgaatatatcaatcttctcgctaactttgagtag

SEQ ID NO: 40131 - DNA, 153 bp, Glycine max
  Peptide Sequence Number=SeqID_131816
atggcttgcccatcagaagttgcagtgtccctcgcccaagctcacccagagacaccaatgaattacaaaaaacgaagtaggaagcgccgtcctccggtcgtcacctccgtcgtgataaagggagtggcgttgttgaagagggaagtcgcgtga

SEQ ID NO: 40132 - DNA, 222 bp, Glycine max
  Peptide Sequence Number=SeqID_131817
atggcggtaaggtgggtaccgctagtaacagttgcgggacatgtgctgaataggagagaggtgagagagggtggtgccgctgatggcatctgcgggacaggttggtgccgccaatgctgtttgcggtacagggtggtgccgccaatactgcttgcgggacaccttcagctagcagtcccgccattagagctggcgggacaggcttctcatgcactgacgtga

SEQ ID NO: 40133 - DNA, 474 bp, Glycine max
  Peptide Sequence Number=SeqID_131818
atgatgcatgtgctggaaacatggtgggaagcatgggtgcatggatatttcgctagtggcattgggggaatcctttgggcgagtctcgctggagggaatggcgaaataagggtttcgccaacaggaatggcggaacaccttcaaacagaccctctcaagaaaatgtttgaaatcatatctcctttggaatacataggtagagaaagagacaaagagaaatttacaaagttagacaaaacaaaatttggtcaaggaaaaggatttaatgtagatttaattaagttgatatcagatgctgtaagtatccctgttattgcaagtagcggtgctggtgctcctcaacacttctctgaggtgttctataaaacaaatgaaacagtagcacttgctgccggcatttttttcacaggaaagcggtattgcttccgttttggtaatttcttaatgctgatgggaatgattttgatttgttaa

SEQ ID NO: 40134 - DNA, 234 bp, Glycine max
  Peptide Sequence Number=SeqID_131819
atggcgccaccaccactggcgccttcgacagggacgagccacgtggctgtggaagcgccattcccactagcgcgtccccttttgctgagtcaaacgcctagccctaggttgcaacgttgtagactggcctgcagagttgctcagggaggcgccattggtggttgcgatttgcaagagggaggcgccattggttcctgcgacttacctgaaaacgccaatgttgatggcgtttga

SEQ ID NO: 40135 - DNA, 753 bp, Glycine max
  Peptide Sequence Number=SeqID_131820
atgctaagaaagaaagactttgctttacggaacctttaccagacacatgccaaggcaaggataatgagtgacatagagcaagtatatgtgcaaatgaaggtcgatatggaggacatgaaggagcatatgacaacgatgatggcagcaatgataagcataaggaaaatgatggaggtcaatgctgctacagttgttgctactagtactgctactgagagggactcagttcacccgtccaggttcaatcaagagaattgtccagtctcagatgtagtagagtctttttttccaccatacggattgcctcccaattatacaccgcctactattgtatacgctattggtgagaatattggtaattctgcacctgtattcattgagaatcaacaaccccaacctgatcatactcatgcccatgtctctcaacctatgggggaaacacatgaagctccccaagaccacactctaactggtttcaaggcttatctgggatataccactaaaagacatgcattttctggtgtccccgtgccagacgctccagaggatcctcaatatcgaccaccaccacaacctgtagaagcaaagcttcattgtgaatcaaagatgatgacaaaggtgatgaacaaaaagctcaaagatcaatcaaagaacaactcaagtgaatcaaagaacatctcaaatgaatcaagaacaagtcaagagttcaagataagaatcaagaagaattcaagactcaacaagaaagtctag

SEQ ID NO: 40136 - DNA, 720 bp, Glycine max
  Peptide Sequence Number=SeqID_131821
atgcaatcacagggactcatattaactcctgagctagaggttggtccttcagttgctcgtgtcaacacaaaggagagttgtgttgatccctcagggaatgacttagacacgggtgactcagagaaatgcgggttgtacgtcgaagaaaatcctccctgcctagttgccctaggaatactttatgaggggtcgacaaccgttcacaacatccctttatgccatgatcaagacaagttagtgttgaggaagttagagatgcagatgctcccattcctgtacccactcaagaggttcagagttgtggaaccgacaaaacctgcacataggccagatcatcatgtcgacgatcccctgtatctgatgacattgaccatcccacaactttttcttaagccgttgcaggttatgtgggatgctactgtgtttggagtgtttaatgacaacttctccttgtacgtaaagcatgaaaatctgtttgacatagcacacggtggtcaatgtctccgcatgtctattatacacttatggatttttgcacactggaaaatggtcgtcattttgcctaaggaaaatgtagtcatctggttttgttcgttgcataatagtccagacaactacctcaaagaaattattaacagacaaaaaggaagtattgagtatggatattacgtcatgcacttgatgttaactacaatcttaggaagtttcaagaataattga

SEQ ID NO: 40137 - DNA, 480 bp, Glycine max
  Peptide Sequence Number=SeqID_131822
atgccgactccgcttcccttttcgactgcgcctccatgtcctgcatccatgcaaccatcccttccaccattgtcgggtttgcttcctaggccttctctgcatcttcccgctttcagtcacgttcacgccgctattcctatttccgacaacctcttcagcgctatccttcattgtgaccctaacacagctcctcacgccaagcagggagaacatcgagacatcgcgctgtttgagcttggacctggattctttgggactatcatggtctcacaaaagtccataccagttgtctttgcacctcatcaccttgaggacaaggtgttgcttgatgggcttgagaatgatacgaatggcaacaagggggctgcaggaagcaaggggtttgcaagaagcaagaagcgtgaggcccaaaaggaaggcaacaacaaggatttgattatgtggagcatggttagctatgacccatgcagcatgcagtga

SEQ ID NO: 40138 - DNA, 1209 bp, Glycine max
  Peptide Sequence Number=SeqID_131823
atggctgagaacttggatgacggcgagttctggctcccgccgcagttcctcgccgacgacgacgttttgccgacaccctttgaagcaaagttcccatctttgcccgacgacactgttttgttcccctccgagtggccgtacggttccccagttgattctaccgttggtggctccagtgagaccgagagcgacgaggaggagcaactcgtcgctgagttaactcgccgcttaactcgctcctctcttcaatctgataccaagtctgcgggtcggtttgtgtctagttctccacaatccacgctttgcgcgttcggaagtgggtgtggttgcggcaaagggtcgagccagggaagccctgatggtgtttgcaagttgtcctctgcgaagaccacttgggatctgctgcatgcggctgcaggggaagttgagaggatgaggttgaagcaagaaggttatgctttcaaccatcaaaatggaaacctcattccccaaagaaaaccttctccagtcatccctttaccctccaaaaccaccacctcaacgccaaaccctgatatgggtggtttctacacgcaacaacactcactttctcaccagcgattgcagatagcacaatttcagatgttgagacagcaacagctggcaaagcagcagaactcggtgtggaatttacagaagcaatgtggtggggtttactctcagaggcaacaacagaacaaccaaatggatcacaatagagggaggaacaatgatgttaacaacagtgttggtggaagaaatgttaggcctttgggtttgtctgcatctgcatggcctcctctgcagcacgcgaagcagcagaaccagaattatggttctggcatgagggctgtgtttctcggaaacccttctgggagaagagaatgtgctggaaccggtgttttcctccctcggcgagttgataccccagagccacgaaagaagcaagcttgttcaactgtgctggttccgaccagagtggcacaggccctaaatctgaatcttgatgacatgatggctggccagccgcaacacttacaacgatttaatgctagttccaacatggaaaatggtgcagctgtttccaggcagaggagtaattatgtcctttctcaacaacagaagcgcaacctcaaatctcagccagcagtgtaccatgagattaggctgccacaggagtggacatactga

SEQ ID NO: 40139 - DNA, 330 bp, Glycine max
  Peptide Sequence Number=SeqID_131824
cgcttcaacacgtttcaactcaacttcaacgttttcaaatcaacttcaacgttttcgtgtgaaaataaaacggagggcaaggggttttatagggaagagggacgtgccagggggccaaccactagtggacgcgcctggcaggctaccactagtggtcgcgcctggggccccaccactactggtcgcgcctggggccctaccactactggtagcgcctggcaggccaccactagtggtcgtgcctgccaagccaccacttccacccctgtctcatcgtcctgtccagtcacgccacgtgtcacgttctggtggaacgcgcccctcaggtag

SEQ ID NO: 40140 - DNA, 798 bp, Glycine max
  Peptide Sequence Number=SeqID_131825
atggtcaatacctgtagcatgtcatgtgcagaggcggattgggaatcctcccattctttactctgtactggtgagagttctgattcaactcgtagagaggcaccccttaaattcatcaaacatgctaatgccatttcttctaccatgttaaagtatcacaacttaaaagcagtcagtcttgaaaagcaaatgaaacatcatacatcctatgtttcaaaccactgtaacttatctattcttttggaagcttggaagcctatattgatgggacacaagagaaggtggtgggactgtattgctttgccaaacgatgttgattcttctgatgaagcttcattcaggctgcaaataaaaatgttggcatttgaggtgagattcttcagaatgcatagaaggtatgatgtgagtggatttcctaccttgaagttcttcccaaaaggcaacaaagctggtgaagagtacggaggtggaacagacttggatgactttgtggcttttatcaatgagaaatctagaacaagtcaagatgtaaaaggacaatttacttcccaagctggtatagtagaaagcttggatgtcttggttaaggagtttgtagctgccagcgatgaagagaagaaatccgtgtttacccgaatggaagaggaagttgagaagctgaagggttctgcctcaaggcacgggaagatttacttgaaagttgccaagaattacttggaaaaaaaaacaaatgaaacttatgctgaattcttatgtcttctgcagaaattcatccataacaggatttatgttaaatag

SEQ ID NO: 40141 - DNA, 612 bp, Glycine max
  Peptide Sequence Number=SeqID_131826
atgggaaaacacagaaagttgaatatcattcagaatgatggtcaatcacaagcaaaagagcaatcaattgaaagctctactgaagtgaaccaaaataacaactctatacttgaagaaaatgcacaatttgaaggagaacaacacatacaagaagatagtcatgttcagtctcatacttctcttgaaagtgcaagtgaaagttcaactaaaggtaaaaagagaaccagaggttatacacatatgttagatgtgtggaacttgccagatggagaatttatacttgttgaagtagatcattggggcaatcctatgggttgggaagggaaaactctactgaatgcaattgggagcttggtaatgagacaccaatgtgctcctatcaattttcttagctggaaagacatgcctaaggactatattactgacatggaattcaggtctagtataaaactttataagtgttgtttcatcttgcttcttaaaataaacaacatcaaccaaaggagccgctcaaaatatgaggacttgcattgcatgggaaccaataatcttccaagacgaattcatgagatgactacaaaggctaagggagtgcaaccttctagggcataa

SEQ ID NO: 40142 - DNA, 525 bp, Glycine max
  Peptide Sequence Number=SeqID_131827
atgccaatattttatgggcttaacttctctgactggaatgagcaagtccaatttcaccttggtgtattggattttgatcttgctatattggaagagaagcatgctactattactgatgctagtagcaatgaagagaaaataactctccctaagaccgatagtgctaaagagtttatggggttagtgggagagcgctttcaaacaattgataagtctcttgctgggacattaatgagtacactaattaccatgaagtttgatggtttatttactatgcataaacatgtcattgagatgacaaacattacagcaagacttaagaccttgggaatgactatgaatgagaacttccttgtctcgtttgatatgttagttaaggaagaaacaaggcttaagaatcaaggaagttacctagttcattatgtaagtcaccaagggaatcaaggagctggaaagaaatttgtgaggaaacatgaaaaaggcaaaaggccattaaagatcaatgatgactctttgcaaatctag

SEQ ID NO: 40143 - DNA, 195 bp, Glycine max
  Peptide Sequence Number=SeqID_131828
atggggagaccagtcagggtcacgctgttttgcaagaatgctccaaccatttgggatcgacatagacttaaaggagcactcaaaccaggtgtatttacccctaaggcctacactccgaagagtccgtcagagcctctccctcctgattcaggtccaacccctaaaataatttttgcatgcagacactactcatga

SEQ ID NO: 40144 - DNA, 381 bp, Glycine max
  Peptide Sequence Number=SeqID_131829
atgtttggggtgtataatgataacttccccttgtacataaagcatgaagatctttctaaaatagcacatggtggtcaatgtttgagcatctctgttatcaaattgtggattatgcatatgattaaggcaagtatgcaagcgggaaatgccaatgtgtatggattccttgagccacagtccatacagagatctgggcaatcgaacatcaatattttaattgtacaatacgcatgcttgtttctattgaacaatgctttgaaaggattcgacgatagtctacaaagtaaattcgagcctgttgctagatggattgtagttaaatattttaatgatccaagaccattggaaccaaagagaattaaggcacttcgtattcagtga

SEQ ID NO: 40145 - DNA, 267 bp, Glycine max
  Peptide Sequence Number=SeqID_131830
atgtcatttgttttgcaggtctcctctcttgtccttttaacaaagatcactcttaaagtcgacatgcaaagtccaggagcccactttggccatgtccaccttgatgtgtctcagcttcaagttttggcaagctgtgggggcagtggcagtggtggtggaatggtggtgatggtggtagctatgacaacgacaattactaaccatttggcaagtgtaccaaatgtccaagtagtaaagactcggaagtccgagtgtcgatttccatag

SEQ ID NO: 40146 - DNA, 348 bp, Glycine max
  Peptide Sequence Number=SeqID_131831
atggatgttattaatatagagcaagatcctggattgcgttcaatgatgtgggagtttccttttgatcaaagagatgaaatacgacgtgtttatctcaaggttggtccatatcaaccaaaggatacatcctttgtggtacaagtagagggtacgtctacttgggttgttgtgactgagaacaagagagggtacatctcttgtggatcagttctagtggagggtacatccactaggttgttcaaagagaacaagggagggtacatcccttgtggatctttgcttgtaaagaactttacaaggttgaaaagaaatctcaaggaccgcaggtcgcttggggactggatgtag

SEQ ID NO: 40147 - DNA, 1053 bp, Glycine max
  Peptide Sequence Number=SeqID_131832
atggctgcctctcatggctgcctctacccctactccggccatgccataacacaccactcgcaaccacccctacaggagccatctcttccgtctcagcacccaccttctctttatgtacatccagctcaatcccttgggattgattttaagagtacccagatccgcttgctagccttgtgcgatacccggatccgccccccgtttccttcttcggtgcacctaccaccaccgcagccagctccgccttgccctcacatgcctcctcctccattcacatcacactcccacgttcctcctcaactttatcctcaggaatggggcaacctaaacttcccaatgctgcccatgataccatactcccacgttcctcctctccttcctatgccgctcgtgattccatgccccgcacctaggcaacaatgccccacacccatcccgactccgcttcccatggctggaaaaggagatagtcttactatcggaatcgattccggcaccacctacttccccgtcagcgtgcaacagcaccatcatgtcaaaatcatcaccactgatcagcgtaacaaaaccacgccgtctcatgttgctttcaccgaacgtttgattggtgacgccaccaaggaccaggtcaccatgaaccccgtcaataccatttttgatgttgatgcctccatacggagtgatatgcaactatggccttctaaggctatccctggccatcctgaaaaacctacgattgtggtaaactacaaaggtaaatccagtgttcttgaatctttggctggtattaatctgccacgtggccaaggcatttgcactaaggtgcccttagatattaggctctggaatcaccttcttccaaccccagagcttgtgcagaacaagacaaaattcactgaattgctcaagtatcaccccactgagagtggtgatgtgatgaccagcctcaaggtctatgttaccagcatccacgaagtaccgaatgacatctactacataactggtgaaagcatgaaccttgttgcgaattttcctatttccattttgtgttga

SEQ ID NO: 40148 - DNA, 381 bp, Glycine max
  Peptide Sequence Number=SeqID_131833
atgcatcaagctagtgacgttaaaagagcgcttactgggagtgatgcgctaagtgtgccatacgaatttcagtttttaaaaatcaaaggcagaggcactttgggtgttacctttgcacccaaacctctgcaccttccaaaccttgagcacttgcgtattttcttcttcttgtgtactgtttctctgcatcttcattgcttcatctcaagaacaatccaactgaaaggggtgaagacccctgtggttctgtctagaaatcgcgatgaacgcgctaagcgcgcctgtgcacttagcctattcatcgcaattgtcaaaattttggatttccagatgaacgcgctaagcggaccatgtcgcgctaagcgcgttcatccctgttga

SEQ ID NO: 40149 - DNA, 621 bp, Glycine max
  Peptide Sequence Number=SeqID_131834
atgaaaacaacctaccggccagagtataagaggattggttgtcttagtagcgggagagtggtcaacatcaggttcagcttgcagaggaaaatgagtagaaaattgattttaggaaacaaagagaagaggtttggtagggactctttgggtggtgcttcttcagccaccgtagtttcatcgctgcttctgctcattgttcaaggggcgacgacagacgatgacatgcataaccccttggtgctggggttgggcagaggtcgagggacctcgcacgatgggttagagaatgctatggcgttgttaggtttctttcacgcttttgaatgccaagagacaccacagtgtgtggataagagcgtgagataccgtcggaggcaagctgaaggaggtgacacaatatggagaacgagatcattgcaatcacagctaaaagagaacatcaaagaccacctcaagagatgcaaccttttaagcacatcggaccgcaaatgggagagcgtatcgatggatttcatcactaccttgccaaggactccggtgtcgtcaagcatcatgtcagatagagatctccgtttcatattgaggttttggaaaagcttattacaaggagctctatcataa

SEQ ID NO: 40150 - DNA, 288 bp, Glycine max
  Peptide Sequence Number=SeqID_131835
atggtgattttgagtgtggggttttgtgtgtggatatcagaaagtgatgcaagctccattggagcttgtaggcctaggatcttcttcatcaatggattcctttgcttcttggaagatgaatggcagcggaatggagaaagggaaagagagaggagacgccacttcaaggagaagatgagtctagaagaagctcaccaccataggagaccatggataagagcttggaggaagaaggagaagaatgaaggaagagggagagaagagcacgaaattttgtgctctaaatga

SEQ ID NO: 40151 - DNA, 1116 bp, Glycine max
  Peptide Sequence Number=SeqID_131836
atgaatttggagagtgaagctaaaccttcaaatgatgtagtggagagagaagctgaaccttcaaatgatgcagtggagagtgaagctgaaccttcacaaggtgcagtagatagtgaagctgaaccttcaaatggtgcagtggagagtgaagctaaaccttcacaaggtgcagtggagagtgaagttgagccttcacaagatgtagtggagagtgaaggtgaactttcaaatggtgcagtgaaccgtgaagctgaaataacaagtggtgcagtggagagtgaagctaaaacttcaagtggtgcagtgaagactgaagttaaaccttcacatggtgtagttgagagtgaagctaaccttcaaatgacgaaaaatgatgtagtgaatagtgaagctgaaacttcaagtggtgccctgcagagtgaaaaagagtcgtgtgttgtgtctgagatgaaaaacaataaagtggagagtgaagctcaaccttctgtcgatgtaaatcacaagaaaactaatgcagttgacagcgaaactgaacttttagttaaaggtgggctttctattgaaagtgaaggtagtaatcaaggagatgaagattcaagacctgcctcagatgctttggatggacataatgtgggtacaaaggccatttgtaaggatttcgaccaaaagtttagggctgcaatagcaacccatagagctgctcgtgacttgctcaaatccaaatgccaggaaatagattcagtccaatccataataaacatattaaacaatgtaatttttgttggggatatagatggcaagataagaagcatggaacacatgatcgagcatgaaactttgcctctaaataaagaaaagcaattgatacgcgagatcaaacaattgaagcagaactgtgaggaattgtcttctaatatgaaaaagcaggatcaatcacaacaatctgtagacaacaaggatgacaatattgaagagcactttaagcttttgaagaaggaaatggaagtgcttagaaataatgtcctgaagtcagatacaaaaactaaagccacaaagaagaaatataatgatgaatgtgatacattgaataagttccccttttactatacacactaa

SEQ ID NO: 40152 - DNA, 501 bp, Glycine max
  Peptide Sequence Number=SeqID_131837
atgtcggacgaagagcaccatttcgagtccaaggccgacgccagtgactctaaaacctaccctcaacaagcaagtaccattcacaagaatgactacatcgtcatcaaaggccgcccctacaagttgtggaagtttcgacttccaaaattggaaagcacgatcacgctaagtgccattttgttggaattgatattttcactaccaagaaacttgaggatattgtgccctcttctcacaactgtgatatcaaaaacaagaaaaacacagcaagtaaacacagcagagcaagaacccaaagatttacgtggttcggcaatgtgcctacgtccacgggaaagtgcagctcctcatcatcacattgatcatgaaattacaagttcaatacaaccactctcaaaaccatcattcactacattacatgatcaagagtatatatacactctaaaaggtagtcttaggaacaaaggctatacattggtgccaaaaccaattcagttataa

SEQ ID NO: 40153 - DNA, 651 bp, Glycine max
  Peptide Sequence Number=SeqID_131838
atggcagaagcatcgaagaagcaaaaaggatcttcctccaccaccaccgctgctggccattgctgccaaggaacctctggagacccatccgcaccggttcttccttctctttcatctcctagatcatccatattgttttcctcggatgatcaacgtcaaaggtactattctcaattctgtaataaggtcattctagaccctaagtaccttcaccttgaattctttgatgaagaaacatttgattgttaccaagtgtttcaaaattatggtttgattgatttcatgtctttgaaactgtcatactttcctgaattagttaaggtgttctataataacttgaaaattcaggatggtattctttactctgaggtgcataatattcctattgtcattgatcagtccttgttcttttccttgactaaactgcccagtcaagtgcggttacctcctttggttaccgaaaggatgttgatggtcagtggattcgcaagtaagacttgcctccgcctatttcttacaagcgtaccccatctcctcaaccacaaaggggtgattccacttctcttctggctgaagtcctcacagaactacgcggacttcgagcttttgtgggtgaacgatttgaagcaatggatactcatcttgatgtga

SEQ ID NO: 40154 - DNA, 132 bp, Glycine max
  Peptide Sequence Number=SeqID_131839
atggagagaggcagaaaagaaaggccaaaggaagtgaaatcttatttctctcattttccaaggaaatcaaagtacaccggagagaagttactatggagaaagatacaagtcttcctatggagaaagcagtaa

SEQ ID NO: 40155 - DNA, 270 bp, Glycine max
  Peptide Sequence Number=SeqID_131840
atggcacatcatcttgtatctgatttttacgctaagaatggatctgaatttgagtctggttctaattttctgggtgctgtacctcttgatgttgattttttagagtcagaatgcactaaccatgttgcaagaagtacatatacttctgacttgctttatgagccaccacccacaccagagttgaagcccttaccagcaaccctcaagtatgtttacatggaggacaaggacaaatttccagtgatcatctctgacctcccttgttgctga

SEQ ID NO: 40156 - DNA, 528 bp, Glycine max
  Peptide Sequence Number=SeqID_131841
atgtgggtccgaaaagaggaaaattttagtcatcctgcttggacgaatgagaaaactggggcaaatgaagagggtgaggatgaaggagatacccatgctgtgactgccattcttatatggccaagtttcccaccaacccaacaatgtcattactcagccaataacaacccatctccttacccaccacccaattatccacaaaggtcatccctaaatcaaccacaaagcctgtctacgacacaaccaatgctaaacaccacctttagcacgaaccgatacaccaaccaaaaaggaattttgcagcaaaaagcctgtaggattcaccccaaattccgatgtcatatgctaaacttgctctcatatctactcgataattcaatggtagccataacccctactaggtttcctcaacctccatttttcagaggatacgacttgtacgcaacatgtgtatatcatggaggatacctggggcattccattgagcactgtatgaccctgaagcataaggtgcaaagtctaaattga

SEQ ID NO: 40157 - DNA, 300 bp, Glycine max
  Peptide Sequence Number=SeqID_131842
atggagaacgcaccctggccacaacaacaagggcctagtctctatgatagaacaacaaagctggaagagactcttgctcagttcattcaagttgcaggttgtgttatatgtggtggggcacatgattctggctactgcattcccacagaagatacaacacatgaagtgaactacatggggaaccagccaagaccaaactttaatgcaggtggatattctggattttcacatggccagcaatataataagcaacagggacaatggagaacacaccctggtaatcagttcaataaagactag

SEQ ID NO: 40158 - DNA, 186 bp, Glycine max
  Peptide Sequence Number=SeqID_131843
atgtcggaagtcgaaaggaagcattgttgcacaatccgtaaagttctgcaacattccagagcaaccaggcccacttgggccttccaaggacttccaacagaaggcggtgccttctggtggaagaaacctagctcgcctgggcgagctgggcgacaaccacctccctcttttttccgtataaaatag

SEQ ID NO: 40159 - DNA, 587 bp, Glycine max
  Peptide Sequence Number=SeqID_131844
atggccgtgttcgcgcaattggggcaggacggcaagctatccctggtcaaccacttgggcatctcgttgggcgaaaccccggaggagatcctgcggcgtctggacgacgggacctatcgtcccgatgacatccgcgacggtgggcgagggtccgaccaggattatgcacggcacgtgcgcgacgtcgacgcggactcgccggcgcgattcaacgcggacccgaaacggttgtacgaggcttcagggagcgccggaaaactgattctctttgccggggcgcctggacacggtttccggcgggagacacagaccgacgttttctatatcgggacggaacggatccctcgggaactgacggatattcgacgataccttttgacggccctgccggcattgcccattgcaggggaatacatgcacagggacgcgttcgatatcgccgacgtctacggcaaggacacctttctggccatccgcaggctgggcaccgcaaggcttccgacctttttcgcattgaaggcacgcgtggacaatttctgcgcgagattctcgttccttcccaggaacatgagcgaccggctattgca

SEQ ID NO: 40160 - DNA, 189 bp, Glycine max
  Peptide Sequence Number=SeqID_131845
atgtcattgtcatcatcaagcaatgcctacaacgtgccatgggtagaaaagtatcgtcccatcaagatgatttgctccatggttgaactcactgttcaacaggtggagaagttgagggaaatgagtccactttatgaatttgtcaaggaaggtatcaacatcaaggacattcaatgggcacagcactga

SEQ ID NO: 40161 - DNA, 467 bp, Glycine max
  Peptide Sequence Number=SeqID_131846
atggggacaaatcaaaatggcaaaaggttttatcaagtcaaggttaaaagtctagatgtcaccagcctcaaggaattgggacgattgatgggacctctccaaaggcaaaccttctgcaaagtgtacgggaagattctggatttgaccgcagcggaggtatttacggaagctgtcgtatccctcgcccaatactatgaccagccgttgaggtgtttcacgtttggggacttccaaatggtaccgactattgaagagtttgaggaaatattaggatgcccttttggggggagaaaaccgtatcttttctccggctttcttccctccttgagcaagattgcagccatggttggagattcggcaaaagagatggatcgcatgaagcaaacttggaacggcgtagtgggcctgcctcggaaatacttggaaggcaaggcaagggatatggcgagccaagagaagtggggccc

SEQ ID NO: 40162 - DNA, 577 bp, Glycine max
  Peptide Sequence Number=SeqID_131847
atgacaagcagagaccaagtttggtcattctgcacccttgtatcatccagaggcggcgggcccgatgatacgcgaagataccttacggttatccgcaccctttttgtcacaagttatccagaactacgtagagctggagcccgcggaatcaccttacggttatccgcacctcgtcattcagtgaccccaggtgatgatgagcagaggccaatgtggtcatctgcgccttttccagagatgttagcattttccgatggagacttttcaagtctcacaagttatccagaactacgtcatgagacatgcacccttgtatcatccagaggcggcgggcccgatgatacgcggagataccttacggttatccgcacccttttgtcatccagaggcggcgggcccgatgacaagcagagaccaaaggcggcgggcccgatgacaagcagagaccaagtttggtcattctgcacccttgtatcatccagaggcggcgggcccgatgatacgcggagataccttacggttattcgcacccttttgtcatccagaggcggcgggcccgatgacaagcagagaccaa

SEQ ID NO: 40163 - DNA, 204 bp, Glycine max
  Peptide Sequence Number=SeqID_131848
atggccccaaggaagctttcctcaaagagatccaggaaagacaaagtggctgaaggaaccagttccgctcccgaatatgacagccatcgttttaggagcgctaagcaccaacagcgcttcgaggccatcaaaggatggtcattcctccgggagagacgcgtccagctcagggcgacgagtatactgacttccaggaagagatag

SEQ ID NO: 40164 - DNA, 920 bp, Glycine max
  Peptide Sequence Number=SeqID_131849
gggttgtattaactacaatcccgcgctcgctataagacaactagggtaccccatgaggggagcaccgatggaagaaagcatgtctcctttccttgtgagggatttcggcgcacaaaatttcaaagctatacaagcaatccataaggcatgggaaaccccgttaaagaaagatcaagaacttaggggcattcgtaatggcatcattggtgggtaccatgaatggctgaaagttcatatacgaggtttagattggctcaccaagttaaaagtagtcagcgaaggaagttttgaagcaccggaagaggacgaagaagtccaagctctcaaaagcgagttaggaaaggcgaaacttgccaaggagaagttcaagttggccgctacacgcattcggaaggagtgtgccggattacgagaggagaatacaactaccgcaagagcccttgaacaagagaccaagagggctcgcaaggaagagtatggccgtaacaaatttcgcggagctctgtggggtagcaatagtgaactcaagctgcgaagggaagagagggaccagtcgcgagcccatagcatggtcttgaaagaggagttagttgcctgttcaaggtccaaaaggagcttgtctcagcgtttatgcgagacggagaccaacatgctagctatcatcgccaagtaccaagaagagttaggtctagccacggctcacgagcgttgggtcgcggacgagtatgcccaagtatacgtggaaaaagaggctagaggaagggtgatcgactctttacaccaagaggcaaccatgtggatggatcggtttgctcttaccttgaacgggagtcaagaacttccccgtttgttagtcaaggccaaggcgatggcgggcacctactccgcccccgaagaaattcatgggcttctaggctatt

SEQ ID NO: 40165 - DNA, 777 bp, Glycine max
  Peptide Sequence Number=SeqID_131850
atgttggtgcgcatgatccacactcgtctctttgcagcggcacaggtgaaatcttgccccggtatgcatagtagctatgtgatagcctccctctctggttgtgctcgcacagttggccctcctccaatatcaggggaggaccttaaattctctcaagtgtggaagtggagcacactgaaaatgaggcatagccctctaaaggtgagggcgtgcaaccctctcaaggcgaggatgtatagtcctctggaggtgagggcgtgtagtcctctcaaggtgagggcgtgcagccctctgttggcgaggacgtgtagtcctctaaaggtgaaggcgtgtagccctctgttggcgaggacgtgtagtcctctaaaggtgagggcgtgtagccctacgaaggtgaggacatgcagtcctctgatggcgagggcgtgtagccctctgaaggtgaggacgtgtggtcctctaaaggtgagggcgtgtagccctacgaaggtgagggcgtgcagccctctgatggtgaggacatgtagtcctctcaaggcgaggacgtgtagtcctctggaggtgagggcgtgcagccctctgatggtgaggacatgtagtcctctcaaggcgaggacgtttagtcctctcaaggtgaggacgtgcagtcctctgaaggcgaggatgtgtagtcctctaaaggtgagggcatgtagccctacgaaggccagggcgggtagccctctaaaggtgaggacgtgtagtcctctggaggtgagggcgtgcagccctctgatg

SEQ ID NO: 40166 - DNA, 1095 bp, Glycine max
  Peptide Sequence Number=SeqID_131851
gtagtcgctgaacaccaggaaggtggcgtcgaacggaatgaagccaccgtgcagggccaggccattggcaatggcggtcatgccgaactcgcgcacgccgtagtacacgtagttggcgttagcgtcgtcgctggcaacggacttgctgcccttccacagggtcaggttggagtgcgccaggtcggccgagccgccgacgatttccggcaacaacggggcataggcttcgatggccagctgcgaggccttgcgcgaggcgatcgtcgggccttcagccgccacctgggcgatgtaggcatcggccttggcaacgaagtcggccggcagttcgccgtgcgaacgacgggtcagttcggcggcctcgcccgggtactggctggcgtacttgtcgaacagctgttcccactcggcctggcgcagggtgccggcgccattggcgcgccagccgtcgtagatcgcctgcgggatctcgaacggaccatactcccagcccagctgcttgcgggtggcttccagttcgtccttgcccaacggtgcgccgtggctggattccttgcccgccttgttcggcgaaccaaaaccaatggtggtgcggcagcagatcagggtcggcttgtcgctctgcgacagcgcggcctcgatgccggccttgatgctttccgggtcgtggccatcgacgtcacggaccacgttccagccataggcttcgaaacgctccggggtgttgtcggtgaaccagccctcgacgttgccgtcgatggagatgtggttgttgtcccagaagcagaccagcttgtgcaggccccaggtaccggccagcgacgccgcttcatgcgacacgccttccatcaggcagccatcgcccatgaacacccaggtgcggtggtcgaccacttccagctccgggcggttgaagcgctgtgccagcagcttctcggccagggcgaagcccacagcgttggcgaaaccctggcccagcgggccggtggtggtttccacgcccggggtctcatggcgttccgggtggccggcggtgtggctgcccagctggcggaacagcttcagctgctcgatcggcaggtcgtaaccgctcag

SEQ ID NO: 40167 - DNA, 633 bp, Glycine max
  Peptide Sequence Number=SeqID_131852
ttaaagctagggaaggcgagactcgccaaggagaagttcaaatcagctgctacacacattcagaaggagtgcaccgagttacaagaggaaaacgcggccactgcaagagctcttgaacaagaaaccaaaagggctcgcaaggaggaacatggccgagagaaattccgaggagcattgtggggtagcaacaatgagctcaagctccgaagagaggagagggatcagtcacgggtacatggcatgatcttaaaagaagagttagttgcttgcgcgaggtccaaaaggagtttggctcaacacttggaagccacggagcaaagcatgttggctatcatagggcaatacaaggaagaattgaaccaatccatggcccatgaacaaaagttagtggaggattttgcacaagtgtatgccgaaaaagaagcaagagggagggtgattgatgcaacagaagcgactatgtggatagataggttcgctttgaccttgaatggaagtcaagacctcccgcgtctgttagccaaagcaaaagccatggccgaagtgtgtactgcccccgaggagattcatgggctaatcaattactgtcagcacatgatagatttgatggcccatataattaggaatcgttag

SEQ ID NO: 40168 - DNA, 279 bp, Glycine max
  Peptide Sequence Number=SeqID_131853
atgggtagtctggcccgggactcatcctctccttcacagggactcggcctctcctttatagggaggacgaaggtctcaccgctcagaagaaagagggtagttgaaacacaagaagttgcagccacttctgagccttcagaaccagtggtagataaagcttcaattcagcaggcagcagacccctccactcctgaggatcagactaccccaatcctatctccgaacacctctcctccaactacccctgtgcttcacttaacacatgaggaggatgtttag

SEQ ID NO: 40169 - DNA, 550 bp, Glycine max
  Peptide Sequence Number=SeqID_131854
cgattctcctcaaatttcagccagcccgcatcaattagaccttgcaccttatgctttagggtcctacaatgctcaatggaatgccccggggcccctccatgataagcacatgttgcattcgagtcgtatcctcagaaacatagaggttgaggaaccttggctggggctttttcactacaaaatttatttcttggttgggatagcctttgtggatgactgggtggtgagtaaggagaaaggtcgatattggctgagcgatgacattgttgggctggtgggaagtttggccatacccgcttcgatccttttgctgacgaagaccaagtctgcaaagcttgaagtccccttgtacttggcaaagtctggcaccttgaacttgggaggggtgatgatattgggtactaggaacaactcttctaggggtgtggttgtgggtgatactaagggccttccaaagtgttttgcaggggtataccaccaactgcttgcccttcagtggcatatccgaagcaaggctggaagtcggctagattatggtggcgcatttcat

SEQ ID NO: 40170 - DNA, 744 bp, Glycine max
  Peptide Sequence Number=SeqID_131855
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggggcgaattggagctccaccgcggtggcggccgctctagaactagtggatcccccgggctgcaggaattcgatccagctggtcggcgatcttgcgcaactcggcggccgcggccaatccgactgcgggatcggcatgcgcggcttgtctcccgagcttgctcacgtcgttcacgtcgtcaagatatcttgacgacgagcgtgccgtcaagagctcttgacggcaacgggctggtcggcgtccgtcagaggagccgggcggatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 40171 - DNA, 271 bp, Glycine max
  Peptide Sequence Number=SeqID_131856
atggcgcctcctctcacctcttctctttgtcttccgctgcatctccatggtggaaaatcaccattaaaggacctcattgaagctcaaagatccagcctccatagaagccccacaagcaagcttccatcagaacctagctatgcttggaatgtgcctcttcctaagggcactcttaagatcattccaatactctactggaggatccccatgaatccttcgttccctaacaagggaagtccaccaatagagggcatacccttgaaagctaagg

SEQ ID NO: 40172 - DNA, 69 bp, Glycine max
  Peptide Sequence Number=SeqID_131857
atgaacgcgcagagacagattctgcgccctttctcatacggggacagttccgctggccggggagattga

SEQ ID NO: 40173 - DNA, 969 bp, Glycine max
  Peptide Sequence Number=SeqID_131858
atggccaagtttgatccagaaatagtccttgagttttatgccaatgcttggccaacagaggagggcgtgcgtgacatgagatcctgggtaaggggtcagtggatcccgtttgatgccgacgctatcggccaactcctaggatatccgttggtgttggaagagggccaggaatgtgagtatgtccagaggaggaaccggtctgacgggttcgatgaggaggccatcgcccagctactatgtataccggggcaggattttgcccggactgctgcagggaggcgactgcgaatcatgcgcaccaacatgaccaccctgacccagatatggatgacgttgctcctcagcaacatcctgcccaccgatcataattccgacctccccatgccgaagtgccagctggtgtacgccatcctgacacggatgagcatccatgtggctcagttgatcgctgatgccatctatatttttgcaggtatggcgcccactaggcaccctttggacccagataagtccaacagggccctgggattccccgcactgatcacaggactctgccagtcgttcggagtccccgttgcacctaccaaggtgattcggccgcccatcacccgagcttttattgagaagtactgtacccagagacaggctcagggtgatgctcacaggtcgcaggcgcgcccccaccccctcatcaggctagccaggctggggcatttgacatggagcagtatttacggcatttggttcgccagcaggcggccaaccaccgagcacatagccagggcttcgcttcttttttcatgccctactccagaccagttcagggcagaggttgcatggcccggagattggcccgaggcccaagcaggagaggcacccccagaagctcccggcgacggagaagaggcccacgaggatgaggagatggccgatttgcttgacttcttgggagggagtggagatacgtga

SEQ ID NO: 40174 - DNA, 162 bp, Glycine max
  Peptide Sequence Number=SeqID_131859
atgcagctggcacgacaggttcccgactggaaagcgggcagtgagcgcaacgcaattaatgaaacagctatgaccatgattacgccaagctcgaaattaaccctcactaaagggaacaaaagctggtaccgggccccccctcgaggtcgacggtatcgataa

SEQ ID NO: 40175 - DNA, 819 bp, Glycine max
  Peptide Sequence Number=SeqID_131860
tggatcccctttgatgcagatgctatcggccagctcctgggatatcctttagtgctggaagagggtcaggagtgcgagtatggccagaggaggaaccggtccaatgggttcgatgaggaggccatcgcccatttgctatgtatactggggcaggattttgcccggactgctgccgggagacaggtgcggatcatgcgcaccaacatgaccaccctgactcagatctggatgaccttgctgctcagcaacatccagcccagcgaccataattccgacctccccctgccgaagtgtcagctggtgtacgccatcctgacgcggatgagcattcacgtggctcagttaattgctgatgtcgtctatctatttgcaggtatggcgcctaccaggcaccctctggacccggataagtccaacagggccctgggatttcccaccttgatcataggactctgccagtcgttcggagtccccgtcgcaccttgcaaggctggtccagccgaatcgtttgatacggagcagtatttgcagcatttggttcgccaacaggcgagcaaccaccgggctcatgtacaaactcatgattgtctttaccatatgagcctcagcctgcagagccagggttttacttcttttccgtgccctaccccggaccagttcagggcagaggtcgcatggcctggagattggcctgaggcccgggcaggagaggcgccagcaaaggcaccagcagaggctcccaacgaggcagatgaggcccgcgaggacgaggagatgaccgatttacttgatttcttaggaggaagcggggccacatga

SEQ ID NO: 40176 - DNA, 372 bp, Glycine max
  Peptide Sequence Number=SeqID_131861
atggtgaaagttggaacctcttacgtgcccgatcaacgtctcattttcgccaaaagttgggcccagggcttccccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 40177 - DNA, 219 bp, Glycine max
  Peptide Sequence Number=SeqID_131862
atgagggatttgcggatgaagcttaggctaaactttatggaatggagaaggaagagagagaggaaacgcgacttcaaggagaagatgagtctagaagaagctcaccaccataagaggccatgggtaagagcttggaggaagaagcagatgaatgaagggagagggagagggagagaagagcatgaaattttgtgctcaaagagagttctaaaatcttaa

SEQ ID NO: 40178 - DNA, 534 bp, Glycine max
  Peptide Sequence Number=SeqID_131863
atggctttgtgttcaatttttctcaatcttcatcttctgctttttgtttgtttgaccatagaagcgttaggtgtggcaaagccttcagtagctagttaccttagccaggagatactggcagagcaagaagttgatagagtgcatggattacctgcgcagcctccggtgaagttcaagaatatggtggttatatcactgtcaatgaaactcaaggaagagcactgttctattggtttttcgaggccactcacaaaccagaacaaaaacccgttctcttatggctcaatggagttatttcacaagctcccttccttcttcctccctctcccccccaagctcctttcctccttcgcctccgcctccgccgctccctttcctttcctctcctttcccttcaaacgaatgtttcttcatgtcggactcaaccaacaagttgtgattgcgaagcataaaggttatgtgagtggtagcttgtcggatgaggggaaggttggacttggaggagattctgaaccaaccagaggatactggtga

SEQ ID NO: 40179 - DNA, 291 bp, Glycine max
  Peptide Sequence Number=SeqID_131864
atggcttctacaagtggagatgctcctccaccatcttcaaacacagcaaggctcatggcgaagatgtttaaacttggtgatcaaatcagaagaatgagttatgaaaatgaagaaaggatggagagaatgaggagaagcgaagaagagaggacggataatctaattcttctcatggagaaaatgaagggtgtgaaaaggatgaaggaggaaggaggaataagaggtaaagggagagaagaaatcatagaagatatggaggtaggcaaagaaaggaagggattgaggcagtga

SEQ ID NO: 40180 - DNA, 773 bp, Glycine max
  Peptide Sequence Number=SeqID_131865
gacgacatggagtccatgaaggaccaaatggccgccatgatggaggccatgttgagtatgaagaaaataatggaaagcaatgcggctgcagtttccactactagcgccacagctgagatggatcctacccatccatctagcataaatcaaatgaatcatccagtcccgaacatggtaggacagggaggagaagcattgagaagtataggtggtccccatgttgtgcaaagtaagaattctttcccactatacggcttgcctcccaactacgcgccacccaatgttgtacatgtgtcggatgagaacaccgaccacttcgctcttgttctctttgaaagccagcaaccccagttggggcatgcacattttgctcagcccatgagggggcacgtgaggaaccccgagatcatgctctggtcgaattcgaaccttaccctggatataccattgaggggcctgcatttggtggcatgccccagcctaacacctctgggaagattgcctcctgccatggaagaaagaaagaaatttgatcttatagaggaaaaactgagggccattgaggggattggagattatccttttgccaacatggcagaactgtgcctagtgcttgacatcgggtgtgcaaatagcaaccagacccacttgggccttccagggggttccaacagaaggcggtgccttccggtggaagcaacccagctcgcttgggctagctgggcggcaaccacctccctcttttcccctataaataggggaaagagggcaga

SEQ ID NO: 40181 - DNA, 165 bp, Glycine max
  Peptide Sequence Number=SeqID_131866
atggcccgcaccaagaaaataggggagatgacgactgcggctgcaaaggaaatcactgagaagatcgattcctttaaggagcaggcgacacaggaatccttcgtcccccgtggacgtcaggatgttctcaccgttgctattgaacgtccagagcaccctagacat

SEQ ID NO: 40182 - DNA, 204 bp, Glycine max
  Peptide Sequence Number=SeqID_131867
atgaggacgtgtagtcctgtgaaggctagggtgtgcagccctttgaaggtgaggaagtgtagtcctctgaaggcgaggacatgtagtcctctgaaggcaagggcatgtaggcctctaaaggtgagggtgtgcatccctctcaaggcgagggcgtgctaccctctcaaggcgacgatactagtacccaatagtccacccttatga

SEQ ID NO: 40183 - DNA, 249 bp, Glycine max
  Peptide Sequence Number=SeqID_131868
atgtctcctccacctctaggaactcataatcgctcacaaactcatctcaagctctcaggacaacttcctcttccagctctggtctctacaaatcttcacacaacaaattctctcaagctctcaggaacttggacctttctctctctagaactctcctattatgcagaagcttcaagaaaaggccaaactcctctcagaagtctgattttagccttaaataggtggctttgttcatgctcgtgcgcttag

SEQ ID NO: 40184 - DNA, 369 bp, Glycine max
  Peptide Sequence Number=SeqID_131869
ggctacacgccctcaccttgggtactagttaccctcaccagtgagaggactacatgtcctcgccatcagagggctgcacgccctcaccttcagaggactacacgtcctcgccttgaaagagggctacatgtcctcaccttgggtactagttaccctcaccgttcagaggatacacgtcctcgccttaaggactacatgtcctcaccttgggacacgttaccctcagagggactacacgctctcgcctttagaggactacgcgtcctcactttcagatgggctccatatcctcaccttaagataatttggtcctcgtccttaaggtatgtccttaaccgagacttgcactcccggttaagggaccagtag

SEQ ID NO: 40185 - DNA, 255 bp, Glycine max
  Peptide Sequence Number=SeqID_131870
atgtgtataatgctacagcagcgggacccagaacttcttgtttcagaaggtgaatctatcaaacttgatcagccattaacaagtaatccaaatgtgggtggatttggtcagggggatgcggaaatagtacttcaagatccgttacgtgtccaaggtctcttgttcttcttcgcatctattattttagcacaaatctttttagttcttaagaagaaacaatttgagaaggttcaattgtccgaaatgaatttctag

SEQ ID NO: 40186 - DNA, 507 bp, Glycine max
  Peptide Sequence Number=SeqID_131871
acccagtccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttatggcctaccatggtgtgacggtgacggagaatagggttcgattccggagagggagcctgagaacggctaccacatccaaggaaggcagcaggcgcgcaaattacccaatcctgacacggggagttaaaaagctcgtagttggaccttgggttgggtcgatcggtcccgcctccggtgtgcaccggtcggctcgtcccttctgccggcgatgcgctcctgtccttaactggccgggtcgtgcctccggtgctgattctgatcctattgtgttggccttcgggatcggagtaatgattaacagggacagtcgggggcattcgtatttcatagtcagag

SEQ ID NO: 40187 - DNA, 299 bp, Glycine max
  Peptide Sequence Number=SeqID_131872
gggctcaaccaggaatcatttgtatgggttggatattgaattcaggttgttcctggtttgaaggtgctttggtggatgatggagatgatggtacagagggtgaaccaggagatgaagtttcttttggtgaggtagccatggagaagcaaagcttttggagtgtagtgaacgtgctattaatgttgagtgagacgtttgagcacgttcagatagaagtagctgctataattcctctagcagacaaatgcccagcttgcccctcagtttttcaaactgatttgcatccaatgcctttgtga

SEQ ID NO: 40188 - DNA, 75 bp, Glycine max
  Peptide Sequence Number=SeqID_131873
cattctgttttgcatttcagtcgcgttccttgtttagcgactgtttcagttttgtgttttgctgtgaatgattag

SEQ ID NO: 40189 - DNA, 222 bp, Glycine max
  Peptide Sequence Number=SeqID_131874
atggcttgtggtatcttcctattatccgtcaagtgtctatttgctaatggagtaaaagacctgacatggcatgcaaatgggagaaactgcgatggaatgctccgtcatactattccagaatggaagaagattgaagttctttgtatccgatttcggaaaagaggtcccaagaaactcttcagtagactagccactgtggaagaatccatatggtcagtttaa

SEQ ID NO: 40190 - DNA, 405 bp, Glycine max
  Peptide Sequence Number=SeqID_131875
atggctactcagttgaaccaagctcagtcccaaaattctgacaaattgccttcacaaactgtgcataatccaaaaaatgttagtgccatcaccttgaggcctagaaaccaaattcaagtgcctccaccagtagcagcacctgaacctatcaagcttcattctacacctgaaaaagatgatgagatagttgaacaaaagagaaagcttcctaacaaaaattttcatgcaggtggaccttcttctagtaattctgacttacagcagcctcctatccctcttccattcccacctagagcaattccaaacaaaaaaatggaagaagcggaaaaggagatcttggagaccttcaggaaagtagaggtgaacatacctctgctagatgccatcaagcagattccaagataa

SEQ ID NO: 40191 - DNA, 564 bp, Glycine max
  Peptide Sequence Number=SeqID_131876
atggataggagtatgattgatgctgccagtggtggagctcttggtgatatgacccctactgaggctaggaatttgattgagaagatggcttccaactcccaacaattcagtgcaagaaatgatgttattgtccttagaggagtccatgaggtggccacagattcatcttcatctactgaaaataaaaagcttgagggaaaacttgatgccttggttaacctagtaactcagcttgccatgaatcagaaatctgcacctgttgcaagagtctatgatctatgttcttctgcagatcaccatacagatctctgtccttctttgcagcaatctggagtcaatgagcaacttgaagctcatgctgcaaacatttataatagaccccctcagcaacaaaaccaacaacaagagaataattatgatctttcaagcaatagatacaattcaggttggagaaatcatccaaatctgagatgggcaagtcctccacaacaacaacaacctgtccctattttccaaaatgctgctggtccaagcaagccatatgttcctcctccaatacattag

SEQ ID NO: 40192 - DNA, 321 bp, Glycine max
  Peptide Sequence Number=SeqID_131877
atgggggaggcacatgaaattccccaccacaatctagctgacttcgagccttgcctcgggtatgccactaaagggcaagcagttgttgatatacccctgcaaaacacattggagggcccgcagtatcacccacaatcacacctcttgcattccacaatgggtaaaaaccctcatgatatggcagaaatgggaaagttggatcatctaaaggaaaggctcaaggccattgaaggaggcgaagattatgcctttgctaacctagaagagttgttcctagtacccgaacatggttattcccaagttcaaggtgtcggactttga

SEQ ID NO: 40193 - DNA, 284 bp, Glycine max
  Peptide Sequence Number=SeqID_131878
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatatcaaagtgtgccacgttgcattgcctccagctttgagacaatag

SEQ ID NO: 40194 - DNA, 537 bp, Glycine max
  Peptide Sequence Number=SeqID_131879
atggccccaaggaagcttgcctcaaagaggtccaggaaggacaaggcagccgaaggaactagttccgctccgaagtatgacagtcaccgctttaggagcgctgtacaccagcagcgcttcgaggccatcaagggatggtcgtttctccgggagcgacccgtccagctcagggacgacgaatatactgatttccaggaggaaatagggcgccggcggtgggcatcactggttactcccatggccaagtttgacccagaaatagttcttgagttttatgccaatgcttggccaacagaggagggtgtgcgtgacatgagatcctgggtaaggggtcagtggatcccgtttgatgccgacgctatcggccaactcctaggatatccgttggtgttggaagagggccaggaatgtgagtatggccagaggaggaaccggtctgatggggaggcgagtgcgaatcatgcgcaccaacatgaccaccctgacccagatatggatgacgttgctcctcagcaacatcctgcccaccgatcataa

SEQ ID NO: 40195 - DNA, 228 bp, Glycine max
  Peptide Sequence Number=SeqID_131880
atggctccgaaaaagctttccacgaagagatctaggagggacgccgcggttgaagggaccagtgtcgcccccgagtttgatagccaccgtttcaggagcgccgagcaccaacagtgcttcgaggccatcaaaggatggttgttccacagagagagacgcatcccaactcaggacaatgaatacacggattttcaggaagagatagctcgccgacattggacgtcgctg

SEQ ID NO: 40196 - DNA, 288 bp, Glycine max
  Peptide Sequence Number=SeqID_131881
atgcatctaaagaggtcaactgcatggccaatccaaatcgccaggggtagcaccactcgggttatcatcagggaggcaatttctctcaaacccaaggtcaaggttaagggttccatcttgggaacaacttcaacaaggaccaaggagatggaccaacttgttaagcaattggttgaaaaatccactaggaacattgtggaaaacacagagaagaaccccaaggaggaatgtaaggtggtcctcacaaagagcaaggggaaggagaggcttaagaaaaaagagagttga

SEQ ID NO: 40197 - DNA, 210 bp, Glycine max
  Peptide Sequence Number=SeqID_131882
atggaggattgccttgagggtcctcacttaggcaatcatgaaacacagctccaaactcgaaaatggaggacacatgaacagcgcttggaaataacattcatggggctccgaaaaaggttgagaatggaggatttccttgaggttcctcaattaggcaatcatgaaacacaactccaatctcgaaagtggagcacacatgaacagttctag

SEQ ID NO: 40198 - DNA, 402 bp, Glycine max
  Peptide Sequence Number=SeqID_131883
atggttgtagttgcgggcgaaactgagggccctccaaagtgttttcaaagggtataccaccaactgcttgcccttcagtggcatatccgagccaaggctcgaagtcagctagattgtggtgtgggaattttatgtgtctcccccatgttgggagcaagccatatgatgggaaggcgtgcttgttttgaattgcacagcatgggtcgtccctacttcctaatctttgcctaccagtatttcgaggttagtaggatgattcatttgcttgaggccggatggggacgtcgggttcaccttgaagcaatcaacgctggtagcggcaatttgcaaccgcattggcttccattatcttcttcacgctcatggcatggcctccatcattgtggccatgtttctctttaa

SEQ ID NO: 40199 - DNA, 97 bp, Glycine max
  Peptide Sequence Number=SeqID_131884
ggtggacctcttggtacttgtacctatcacttttagaggactacatgtcctcaccatcagagggcttcacgccctcacctccagaggagtcatttga

SEQ ID NO: 40200 - DNA, 462 bp, Glycine max
  Peptide Sequence Number=SeqID_131885
aaaactgacttgactccttcatgcatgctccactcggctcggggggatatagctcagttggtagagctccgctcttgcaattgggtcgttgcgattacggaggaccgaaacatgccactgaaagactctactgagacaaagacgggctgtcaagaacgtagaggagaggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccagggggtcgcgggaccgaccatagaaaccctgttcaaaaagcggaacgcattagctatccgctctcaggggggcgggggaagctctccgttcccggttctcctgtagctggatcctccggaaccacaagaatccttagttag

SEQ ID NO: 40201 - DNA, 1043 bp, Glycine max
  Peptide Sequence Number=SeqID_131886
atggcgaccgtgattgccaggaacttcttccagctcgagggagaagcgggactgaccagcctgatcctcacctgggcctcgtttgctatcgcgttcttcttccgtcccctgggtgcggtggtatttggccgcatcggcgacaggattggccggaaaccgacgctgatcattgtgctggtactgatgacgctcgccaccacagccattggtcttgtgcccgtctacgccagcataggcattgccgcaccgctgatcgttacgctgctgcgcattttgcagggattgttcgcaggcggagagtacggtggtgcagtttcgttgatgacagagttcgctccacgcggcaagcgcggtctgtatggcgcgtggcagtcctttaccgtggcgctcgggctgctagcgggcgcggggattgtggcactgctctccgcccttctcacgcctgaggcattacatgactggggctggcgtattccattcttccttgcgctgccgatgggggctgtcgcgctatggctgcgtgtgagtatggaagagacgccgagctttgtgcggcagaaggaaaaaccggttgtggctcaggccagcacctccgccacgctcaaaacgattctgatgggcatttgccgggtcatggtctggtcggcggcagggtatacctacctggtgattatgccgacctatctccagtcggcgctacacaccgggtttaatcaggcactgctgatagcggtgatttcgaatatcggttttgcgctgaccatcatcccctcgggtatcctgagcgacaagattggccgccgcacggtgatgatgattgccaccgccctgctgctgctgctcgccctgccgctgctgaaaatgttgcaggctgagtccgccacgctggccgttaaagcgatggtggtgctaattgcgggcggtctggtggggatgctggcaggaccggggccggcaatgctgtctgaaatgttcccgacgcgcgtgcgttataccggcctgggggctggcgtattccctgtcaaacgcgatcttctcgggct

SEQ ID NO: 40202 - DNA, 161 bp, Glycine max
  Peptide Sequence Number=SeqID_131887
gacgtgctgtgccttgtgtcgcaacctacccattggcgggagggctacgcggggctcgcgggtgcgtcttccaagaaaggaatacgcgcagagttgccaccaaacgtttatttgaggaaaacgtcgaaaaaactggaaaagacgtgatctacaaactttaa

SEQ ID NO: 40203 - DNA, 210 bp, Glycine max
  Peptide Sequence Number=SeqID_131888
atgggcgaggaagagaaaaaaccagaggaaaataaaatggaggagaaaaaagcaaatgaagaagaaaagaaagaagaagagaaaaaaccagaggaatcaaaagatgacaagaaatccaaggaggaatctgcgccgccaaaaatcatgcaaagcacaacctttgcaatgcatggatactttaagaatgatttttggcatcttttaagttag

SEQ ID NO: 40204 - DNA, 222 bp, Glycine max
  Peptide Sequence Number=SeqID_131889
atgttgctaagtagcaacatcatccatatctgtgtaagagtggtcatgttggtgcgcatgacccgcactcgtctctttgcagcggcacgggtgaaatcttgcctcggtatgcatagtagctacgtgatagcctccctctctggttctgctcgcacagttggtctcgctccaatatcagggggtggtccaggaactgataaaaggaaactactagccccataa

SEQ ID NO: 40205 - DNA, 414 bp, Glycine max
  Peptide Sequence Number=SeqID_131890
atgtacaattatcatgagaaaggaagagctcctgatcttgaaagtgtattggcagacttcatgacatatcaagctagctctaaaggtgattgctattcaatgcaacagctgggaactcagtttgaaaaggactattcttttgcagattatcaatgggagtcagaatggaaaccttattatcactatgaagcagaaggattgtctaatctggatgacctgttaatgcaattcaaagttatggtcagaagagaagaagagtatgcggagtttaaaacacatcaagaaagcattcttcaagttaacacaatacaccatcaattgatcaccaaagaagaaaaggatgaagtctccagtattctagaatatccctgtatggcaactactggatatgttgtaggcaaagataaaggttga

SEQ ID NO: 40206 - DNA, 195 bp, Glycine max
  Peptide Sequence Number=SeqID_131891
atggacacttcaaggtattctgttggcaaattggcattcttattagctatgatcttccttatagcttcaggtatgtgcatggaatcaaaaacaataacgggtactctaccgaaagaatgtagcagggacatggattgtcgtccatatggatgtgaaattcttacaccttgtggttgcctaaaaaaaatgtattga

SEQ ID NO: 40207 - DNA, 543 bp, Glycine max
  Peptide Sequence Number=SeqID_131892
atgcataacttgggcaggcctattcctgcaattgatgacatggttgctgggacaggattaagtcctttgatcgcgtgttcgatagacaccagcgatcggggacttatatcctcctttgtcgagaggtggcatcgggagacttctagtttccatcttcctgtgggggaggtttcgatcacgctggacgacgtcatgtctcttctctatttgcctatcgttggcgcattccatgacttccagcctttgcgtaccgacgaggtggtggtgctaggtgaccatggccgagataggcgaatgtggtggaccatatttacgcctgtagtggttgctagacgtataccagtgcagatgtcagacgtagcactggacagctgccgctcgcgcttatcttctacatcttttggagctgctggcctcattcatatgtacgatcaacttaatgatgccaatctcagcaccagccgacagcttgctggttacatcaccttgttacagcactttccgttagttgcagagtgcaatgctaatccggattatgacaag

SEQ ID NO: 40208 - DNA, 399 bp, Glycine max
  Peptide Sequence Number=SeqID_131893
atggtgaaagttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattctccattcaggctgcgcaactgttgggaagggcgatcggtgcgggcctcttcgctattacgccagctggcgaaagggggatgtgttgcaaggcgattaagttgggtaacgccagggttttcccagtcaggacgttggcgaattggagctccaccgcggtggcggccgctctagaactagtggatcccccgggccgcaggaattcgattcagtacacctag

SEQ ID NO: 40209 - DNA, 477 bp, Glycine max
  misc_feature (442)..(442): n is a, c, g, or t
  Peptide Sequence Number=SeqID_131894
atgaaaagaggagaacgaggacagctgactaccgctaaaagtcagactacgagtacactttgtatgattgaaaactgccgctgcgtactacccggtgcttgcagcgagctccggctcgaaaacaacaagcaagggattgagctttcgaaagccctttccccttactctaacaaagctaacgcgctttacttaaccaaggctttctctgataggggctcgttagccgttgtttgggtcgagctcaaacctcctctgattccgataaatcggtcaagcggggggctaccctcgactcacctctctatctataaaaacccctccccggaggagagcagaagctccaggatgagaatgaatccaggacatactcatcctgatccaccgtggaattttcggaatctacaaaaacattctaggagagggctcgtaatgatcttctcanaagatcacaaggtgctgaagtggcaggcaggatag

SEQ ID NO: 40210 - DNA, 450 bp, Glycine max
  Peptide Sequence Number=SeqID_131895
atgtcgcgggggtcaggagaccttggggacgtcaggcgagctcctggcagtcaacagataaaaggaacaaagaccacaaagcgaggaggcttgtggtggctggccagctgtgaatcttgtgtgatatatgggttatggcctctggttgtagaggcctctggtaatcgattaccagtctgtgtaatcgattacacagaggaatgggtcactggtaatcgattaccaggttttcatgtcctgaagctgtgtgattcgagtttggcctctggtaatcgattaccaaggctgtgtaatcgattaccagagatgaaaagcctaaagatacccctcttacttgcatgtaatggttatgagaagtattgtgttgcggcatggttagattcttgtgaaagagtctacccctttcttttcttccttgtagatcgtgatggcggcgcagctaatccatga

SEQ ID NO: 40211 - DNA, 139 bp, Glycine max
  Peptide Sequence Number=SeqID_131896
tctggtaattggaatgagtacaatctaaatccctttaacgaggatccattggagggcaagtctggtgccagcagccgcgttaaaaagctcgtagttggaccttgggttgggtcgatcggtccgcctccggtgtgcaccg

SEQ ID NO: 40212 - DNA, 63 bp, Glycine max
  Peptide Sequence Number=SeqID_131897
atgggcttaaccgcttctgcccagattgtcatattaaaagagcttctagcaagtttcttctag

SEQ ID NO: 40213 - DNA, 67 bp, Glycine max
  Peptide Sequence Number=SeqID_131898
atgaaaaacgaacgggtctgcgtatgggtcgggtttgacccgctaaaggttgaagatgatgaacaat

SEQ ID NO: 40214 - DNA, 603 bp, Glycine max
  Peptide Sequence Number=SeqID_131899
atggatgggttggtggacctggcagcgatcgacgcttttctcgcctatcatgaccacaaggaaagcccggttgtcgctatgctagccgacctatatgacacctttgaccgaagatgtgagaagagcagtacgaggattgtttgttgtacaccagctctttatgtatggttagtttcgcacctttttcgccaagaggtgaggcatgcttgcccgctagaaagccaccgttcatgcacagagaaaggaggggcaaattgggaccaactcttagcgagcaaagaaggagcatctgtcaactggttccctcgatggaaggaaggaagaaccagagttcttatttcatgcgaaggatttccaaatgttcccttgatggggacgaggggttgcatcagctacaatcccattcttgctataagacaacttggctaccctatgagaggggcgccattagaggatgagcttgcgcctgtcatttcacgaggcttcaataagaccaacgtggagacacttcagaaggtccacaaggcatgggaggtgttgcaaaagaaggaaaaggaactcggaggcagtaacaatgggaccatcggtggctaccgtaagtag

SEQ ID NO: 40215 - DNA, 206 bp, Glycine max
  Peptide Sequence Number=SeqID_131900
gtggccttgttggtgcttgtgcgcttagcgcgactctggctcgcttagcgcacattagtgaatttcggcttagcgcgtgtcttctcgctcagcggatggactcaagcggtgcacttagcgggatgatccctcgctcagcgaacatgcacagctcatccttcttccagattcttcctcgtgctcagccaaaggagtggtgcgcttag

SEQ ID NO: 40216 - DNA, 1039 bp, Glycine max
  Peptide Sequence Number=SeqID_131901
atactacaggttgcctacagacttcagagagatagaggctgccttatgcatacctggccgagggttcatcttgaactctgagggccatcctaggaagattctcaagaaggatttgactacactagctcaggtgtggagtgtcctcttatactccaacttggcccccacatcacatacctctgatctgacagtggacagagctaggctgatctttggcctagtctctcacttggatatgaacataggagcactgatctctggccagatgacctctatagcccattctaacacttctagacttgggttccctgctctgatcaccgcattatgtagggccaaaggggttgtctctgacagccttacctttgagcacctgagcccagtcattaacttggcttacatcaggaataactgttggaatcccgacgatctaacagtttctatccggggggctagaagggcgagggcaaggccagctgagcttccttctacttttgcagctcctactccagcatccacctcagcagccccttctgtcctagttcagacagattttcagtgttttgaagctatgcttcagagcattcatcagggacaaatcattttactacaaagtttacagatggtggcacctccagactctatcccttcagtagagcagtttaatgagatggtagcctggcctgggacccaaccatctcttcatagggaagatgaaggtcccacagcccaggtacctcaacatatgaaggatgagtcatctgaggccaccatcccagagccatttgatataggagaagaggcaaacgagacacagatgagacaggtagctgctaccactcctgagcgatcccttgaggctacttcagagccttctgcaccagtggtaaacctaccctcaccccagcctgcagcagacccctccactcttcttctagagatgccagaggacccgactacaccagttctagctgtggacacttctcctccaactactccagtgcttccgctgatagatgagaaggatggtcagacatag

SEQ ID NO: 40217 - DNA, 267 bp, Glycine max
  Peptide Sequence Number=SeqID_131902
atggaatcatcattcacagatgtagatgtgtacttgttatgccaagatgagacagatgtgggccatcaagcttatcgataccgtcgacctcgagggggggcccgggagaaaaaaggctgcaccggtgcgtcagcagaatatgtgatacagggatatattccgcttcctcgctcactgactcgctacgctcggtcgttcgactgcggcgagcggaaatggcttacgaacgggcggagatttcctggaagatgccaggaagatacttaa

SEQ ID NO: 40218 - DNA, 761 bp, Glycine max
  Peptide Sequence Number=SeqID_131903
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40219 - DNA, 678 bp, Glycine max
  Peptide Sequence Number=SeqID_131904
atgcccactgatatcagagagattgaggttgctttgtgtatactcggtcgagggtttgttttaaatgctgaaggccatcctgggaagatcctcaggaaagatctaacaactcttgctcaggtttggagtgttctctcatactccaacctggctccgacttcccacacctcggatttgactctagatagagctaggtccaaaggggttgcttctgacagcctggtcttcaaacacttgagctcggtcattaacttggcctatatcaggaagaactattggaaccttgatgatctgacagttactattagaggggccaggagagtgagtgcaagttcagctgaggctccttccacatctgcagctcctcctccagcacgtaccttagcagctccttctaccctaccttctatagactttcaccttcttgaagccatgcttcgaagcatacatcaagggcagattgttttattacaaagtagcctggcccaggactcagcctccccttcacaaggaagacgaaggtcccaccgctcaggtagcagacccctcactcctaaggatcagactacaccagtcctatctccgaacacctctcctccagctacccctgtgcttcgcttaacagacaaggaggatgttcagacacaggatactcaggatcgatcacaggatttttaa

SEQ ID NO: 40220 - DNA, 672 bp, Glycine max
  Peptide Sequence Number=SeqID_131905
ttggacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccaggacaactttaggagcttccagagattcagtcacctttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40221 - DNA, 477 bp, Glycine max
  Peptide Sequence Number=SeqID_131906
atgaattgcgtttttgttcatgcatcctccacccacgagtttggagtgatgcgtagtgattgcttagtgcaattctccattctcaacccctcttttcggagccccatgaactgcgttttcgttcatgcatcctccacccacgagtttggagacatgcgtagtgattgcttagtgcaattctccattctctactttttttcggagagccccatgaattgtgttttcgttcatgcaccctccacccacgagtttcgagccatgcgtagtgattgcttagtgcaattctcagttctctacttttttttggagccccatgaaattgcgttttttgttgatgcatcctcctcccacgaatttggagacatgcgtagtgattgcttattgcaattctccattatctacccctctattcggagccccatgaaatgcgttttcgtttcatgcgtcctccacccacgagtttggagtcatgcgtag

SEQ ID NO: 40222 - DNA, 808 bp, Glycine max
  Peptide Sequence Number=SeqID_131907
cgccaaccgaagaaagtctctcgcctttccttgtgaggaatttaggcgcgcaaagtctcaaggtaatacaaagagtccacaaggcgtggagaagtccgttgaggaaagacaaggagcttaggggcatccgtaatggcgtcatcggaggttatcatggatggctaagaattcacatgcgaggtttagattgtctctccaagttgaaagttatcgatgaggaaagcttcgaagctccggaggaagatgaagaagtccgagctctaaaattggagctagggaagacaaggctcgccaaggataagttcaaatcagctgctacacacatccggaaggagtgcaccgagttacaagaggaaaacgcggccactgcaaaagcccttgaacaagaaaccaaaagggcccgcaaggaggaatatggccgagagaaattccgaggagcattgtggggtagcaacaatgagctcaagctccgaagagaggagagagatcggtccaaaagaagtttggctcaacacttggaagccacagagcaaagaatgctagctatcatagggcaatacaaggaagagttgaaccagtctgtggcccatgaacaaaagctagtggaggactttgcacaagtgtatgccgagaaagaagcaagagggagggtgattgatgcgttgcatcaagaagcggctatgtggatggataggttcgccttgaccttgaatggaagtcaagacctccagcgtctgttagccaaagcaaaagccatggccgaagtgtgtactgccgccgaggagatttcatgggctaatcaattact

SEQ ID NO: 40223 - DNA, 453 bp, Glycine max
  Peptide Sequence Number=SeqID_131908
atgaagtttgcttctacacaaagcctacagctggtagcgcctccagactccatcccgatggtagagcaatttaatgaatgggtagcctggccaaggactcagcctcctcttcacagggaagacgaagatcccaccgctcaggtaccccatcagccggaggatgagtcatcagagtcttccactcctgagcccttgatcaggaagaggagggtagttgtaacccaggaagctgcaaccacctctgaaaaatctcttgaagccactccagagcctctggcaccagtggcagatatcacttctccgcagcaggtagcaaacccttccacgcctgaggatcaaaccaccccagtccagtctctgaacgcctctcctatagctactcatgttcttcatttgtcggaagaggaggaggttcaaacacaagacacccagaaccaatcacaggacttttaa

SEQ ID NO: 40224 - DNA, 228 bp, Glycine max
  Peptide Sequence Number=SeqID_131909
atgtcgctgcatgggcaggatcaccttgggctaccttctggggtagagacaaaacatgaacagcagaaaccaatcaaggtacttaaggacggatgcaagtggggatggggtcacgaccgaccgatcgttgccccttctctgtgcgaaaacaagcagagaatgtcgctgcaaggcagccccgtatccttttgtattttgcagctttcttttactatttgtttgttttaa

SEQ ID NO: 40225 - DNA, 345 bp, Glycine max
  Peptide Sequence Number=SeqID_131910
atggataagagcttgaaggtaggagaagatgagtggagggagaaggagagaaggaacacgaaattttatgcctcaaatgagttatcattcagcccactaatccaagatcaagtcaaagattctccactaagtgtgcttaggtgtcgtgaggcatataagtgggctcatacctatcccatgggcccaaaatctaccctaaggctcatgagaatcctagggccttctcctacatctctggcccaaccttcttggagtcttctatccaatgcccttgggggggtaggattgcatcattccctcccccttgaaaaggatttgacctcaaatccaaaggttcttgaataa

SEQ ID NO: 40226 - DNA, 437 bp, Glycine max
  Peptide Sequence Number=SeqID_131911
ggccattgaaggaggtgaagattatgcctttgctaacctaaaagagttgttcctagaacccaatatcatcacccctcccaagttcaaggtgctgtactttgacaagtacaaagagactacttgccccaagaaccatctaaagattgtcagtataatgttttcggataggatgcaactacagaacatgtgcaaaaagggggcactaatcgttcaaaagaatacgcccaaaggtggagagacctggcagctcaagtggcacctcaatgacggagaaaaaatgataacaatgatagtagacacattaccagtattctactatgaaaagatggtggactacacaccttcaagctttgatgatatggtcttcactgacgaaaggatcaaaggtgagaatgagggagaagcccatgctgtgactgccattcctatacagccaa

SEQ ID NO: 40227 - DNA, 354 bp, Glycine max
  Peptide Sequence Number=SeqID_131912
atgaggggcatcatgcatgagcctcaagtgaacataggggcagatcaaagaacttgtcgcctttggaggactagacttcctcgccttcagaggactagacttcctaaccttcagaggactagacgtcctcccgttcagaggactacccgtccttgcttcgtagggcgcacgccctcaccttccgaggactacatgtcctcaccttcagaggactacacatcctccatttcaaagaactacacgtcatacccttcggagggcttcacgtccttgcctgcaaggggctgcagctccctcgcctttcgaggattcaacgtctctgtccttcagaggaactacgcgccctcatcttaa

SEQ ID NO: 40228 - DNA, 246 bp, Glycine max
  Peptide Sequence Number=SeqID_131913
atggtgaattccatgttatcctattcgggtttaagtgaaggattttggggtgaggctatgttgacagcctgttacttgttgaaccgaattcctaacaaaaggaataagagattggaacacatcatcgaaagtatcccaaaaggtgcaagaaacaaaatgactacctatataagcatgaagtttagccgcttcaagaagctgggacttggctttgatatgcttatgaaggatagggacacaggctag

SEQ ID NO: 40229 - DNA, 237 bp, Glycine max
  Peptide Sequence Number=SeqID_131914
atgcaggggtaccgcatggttatctgcacctttcgtcaaccagggacaaacaagcccgttgatgtgcagagactaacatcgtcttttgcaccttttgtcatcctaacccatgaagttaggtttttactctcgtcgtccggagacattcaagcacgacgacacacgagattcttctctgctggacgaggggcgatcaagttcgatggcgtggggaaatgtcgtggctgtcccatttaa

SEQ ID NO: 40230 - DNA, 383 bp, Glycine max
  Peptide Sequence Number=SeqID_131915
aatcatcatcatctgattcagtatcctctgctgcatcttcttcttcctcagcagcttcttcttcttcctcagctgcttcttcttcttcctcagcttcttcttcttcctcagctgcttctccttcttcctcagctgcttctccatcatcaatgccactttctgagagccttttgatcagccgttccagctccatcttcttctctgtggtggctttgatggttgcttccagcaccttgcatgtgtccttgagttcagcaatcagagcatccttggacacagcacctgaggcagcagctttccctgatgtcgagacaattgatttccttggcaatttgatgctcagaaacagtaatgtccaccactccatctgttggtctgcccag

SEQ ID NO: 40231 - DNA, 257 bp, Glycine max
  Peptide Sequence Number=SeqID_131916
atgttgcaccatcaacttcaaatgaggatgaccacctattatctcaagatgaacaagctttgaatgaggctgaagaagctgctgctcatgttcaaacagatccggtggagattaatttatctcagcctcatttgtcacatgatagtgacatggagttgatggtccctgcaactattgttccaccaatagcaaggaataagctaaccataacaagacccaaacaaaggaaggttgctgataaagatgatgcagcataa

SEQ ID NO: 40232 - DNA, 159 bp, Glycine max
  Peptide Sequence Number=SeqID_131917
atgaccaagaaaagatcgcacctctcgcacgcaagaggggccgaaaggcatcctcctataggaaaaagtgccgaaggggcaggtgaatgtggtcttttcccgatcctcaggagcaatagtgatttgcatataaccagaaaaaccatcaaggaaacagta

SEQ ID NO: 40233 - DNA, 213 bp, Glycine max
  Peptide Sequence Number=SeqID_131918
atgacgaacaaagaacacctaacaaagaacgttgtagaagttgattacagtcgcgatttggtagcgcctcggcctcgttttctcttctttcttcttcttatttccctctcctctcaatatccttcaatgctgaaccttggaatccttcactcagcctccctcacgcctatttatagccaaaaatggcatttagtgacatggcagctcgcctag

SEQ ID NO: 40234 - DNA, 471 bp, Glycine max
  Peptide Sequence Number=SeqID_131919
atggtcatctgcgccctttccggagatgtcagcatttccgatggagacttttcaagtctcacaagttatctagaactacgtaggtctaagttcctcattggaggatacgtaggagcaagagcttgcttttgtcggccgccccataatctttgtcatactgaccctgaggtcatgagacatgcacccttgtatcatccagagacggcgggcccgatgatacgcggagataccttacggttatccgcacccttttgtcatccagaggcggcgggcccgatgacaagcagagaccaaatttggtcattttgcacccttgtatcatccagaggcggcgggcccgatgatacgcggagataccttacggttatccgcacccttttgtcatccagaggcggcgggcccgatgacaagcagagaccaagtttggtcattctgcacccttatatcatccagaggcggcgggcccgatga

SEQ ID NO: 40235 - DNA, 222 bp, Glycine max
  Peptide Sequence Number=SeqID_131920
atgtcctcaatggcattagcgaacgtgattttttttgccttcgcaggaaatggccccaaggaagcttttatgcgtcaaagaaggctaggaaggacaaggcagccgaaggtgcaactattccgccggagtatgacagttcaccgctttttaaagcgcctagcaccatcagcgctatcgaggccatgctatagggatgtcaatttcctacgcctagatgtttag

SEQ ID NO: 40236 - DNA, 756 bp, Glycine max
  Peptide Sequence Number=SeqID_131921
atggctacctcaccaaaagaaatttcagcctctggttcacccgctgtaccatcatctccgcaccaggaacaacctgaattcaacatccaacccatacagatgattcctggtcaagcccctgttcctgaaaaactggttcccaaacgacaacagggagtgaagattgctgaaaaccctagccctgcaacaagtcctagggaagtagacccggagatggacaagaagatccgcagtattgtgagtaacattctgaaaaatgcgtctgtccctgaagctgatgaagatgtcccaacatcttccaccccaaatgtttctgtgcctgatgttgataaagatgttccaacatcttccgctccaaatgctgaagccctcccttcacccagtgaagaggaatcaacagaagaagatgatcaagccacagaagagacccctgcaccaaaggcaccagaacctgctccaagtggcctcattgacctcgcagatgtagaatctgatgaggaacccattgccaacaggttggcacctggcattgccgaaaggttacaaagcagaaaagggaaaacccccattaagaggtctggacgaatcaagactatggcacagaagaagagcactccaatcactcctacctcatccagacgaaacaaagtcacaattccttccacgcctcggaaagaaatttcctcatctgattctgatgatgatgtcgaactagatgtctcgacatcaaagagggccaagaaatctgggaaaaag

SEQ ID NO: 40237 - DNA, 774 bp, Glycine max
  Peptide Sequence Number=SeqID_131922
ttggaacctcttacgtgccgatcaacgtctcattttcgccaaaaagttggcccagggcttcccggtatcaacagggacaccaggatttatttatttctgcgaagtgatcttccgtcacagtggcttctgtttctatcagctgtccctccctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgttaatctcacagataagagtcaaacccagctcctgtgacataagaattcatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40238 - DNA, 108 bp, Glycine max
  Peptide Sequence Number=SeqID_131923
atgacccaagagctgaggccaatgtggtcatctgcgccctttccggagatgtcagcatcttccggtggagactttttcaagtctcacaagttatctagaactacgtag

SEQ ID NO: 40239 - DNA, 339 bp, Glycine max
  Peptide Sequence Number=SeqID_131924
atgacaaaaaataaccctaatcggggtcaaccggaaagagccccaccaaggtcaaccaaaaatatccctagtcgaggtcaattgaaaatagccttggccaaggtcaatagaaaaaaaccctcactgaggtcagtcaaaaataactcttggccaaggttggccaaaaacaaccctagtcgagttgtaaatgatgtggatggtaatcaaaaggatggtgtaaatgaagagattcctatagttgaggataatataggtgaccttgaaaatcccttagtggtggttgatgaactgtataaaggggattacatgaagccatttgagcttggaaaagtgaaataa

SEQ ID NO: 40240 - DNA, 297 bp, Glycine max
  Peptide Sequence Number=SeqID_131925
atggtgaaggggaccaataaagtactccttcaaggtgctgtgggtgttgatggtctctattctttttataacatcaaactccaggatcacagacctcagctgttaacaacaacatcttctattgctaataaagagtctactgttacatctagttctggtttttcatctcttagcactgttagccattggcatgctaggttaggacaccctaatagtcatatttttgtgcctcttgttgtgtgggaaaatctcataggctgtcttcccatgcttccacttcagtttattctcctttag

SEQ ID NO: 40241 - DNA, 186 bp, Glycine max
  Peptide Sequence Number=SeqID_131926
atgggacaccttagtgatcaaggggttcccaaggaccctaagagaataaagatcattcttgattggcccactccaccaagtgttgagggaaggagcccaaagtatgaagaacctcaggatttgaggtcaaatcctttccaaggtgaaggggatgatgcaatcctaccccgcaagggcattggatag

SEQ ID NO: 40242 - DNA, 384 bp, Glycine max
  Peptide Sequence Number=SeqID_131927
ggttttcccagtcacgacgttgtaaaacgacggccagtgaattgtaatacgactcactatagggcgaattggagctccaccgcggtggcggccgctctagaactagtggatcccccgggctgcaggaattcgatgttcaagcgcattgtctacgtcagctgccacccgggctcgctggcgcgcgatgccggctatctggtcaacgaacaggatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacataccagccggaagcataaagtgtaa

SEQ ID NO: 40243 - DNA, 868 bp, Glycine max
  Peptide Sequence Number=SeqID_131928
ttggaactcttacgtgccgatcaacgtctcatttcgccaaaagttggccagggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatggcgagcctgggagtgcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggcggagatttcctggaagatgccaggaagatacttaa

SEQ ID NO: 40244 - DNA, 393 bp, Glycine max
  Peptide Sequence Number=SeqID_131929
atggcacaacctccaccctgtgataggactctaagggaaatggctacacctgatttcacctacaaaagcttgtgcatccaataccctgatgaggatgtcccatatgttcttaaaactggattgattcatttgcttccaaagtttcatggccttgcaggtgaagacccgcacaaacatttgaggaattttatattgtctgctccaccatgcccccagattccaagaggtgtctattttgggctgaagttgccctcaccatcagatttcaaagcagctgcttctccaatatttttatttttcgaaagactcagtaatatggagaaaagtatgatagatgctgccagtggtggagcccttggagacatgactcctgctgaatgccgaaaaatttaa

SEQ ID NO: 40245 - DNA, 529 bp, Glycine max
  Peptide Sequence Number=SeqID_131930
atgggaatgcgcttcaagcgtctcgtagggctatccgcctcacgagggtcaccaacggcacgtgcctttggggggccgaggccccctactgctgctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataa

SEQ ID NO: 40246 - DNA, 144 bp, Glycine max
  Peptide Sequence Number=SeqID_131931
atgggagatggaccatttcaagtgcttgaaagaatcaatgacaatgcttacaaagttgagctacccggtgaatataatgcccaagtttcaaggagaaaagtccaagttgttagttgtatcatggctcaaatggaggaggactaa

SEQ ID NO: 40247 - DNA, 447 bp, Glycine max
  Peptide Sequence Number=SeqID_131932
atgggtaaagcagaggaggtgcaagagaaggtgaaggccgacatggaggccatgaaagagaaaatggccacaatgatggaggccatgatgagcatgaagaagataatggaagccaatgcggttacaattgcctctaccagcactgttgctaaggtgaacccgatgcccccatctgacctcaaccaaatgaatcatccaacctcagctatggtaggcaagatttgggaagtacgggcggcccccatgatgtgcaaattcaaaacgagtacgccttcccgccatatggcttgcctctcaactatacaccacccaatgtggcgtacactcccaataagaatgtcaataattccactcctatacccattgagagccaacaacctcaaactgatcatgcacatgtctcttaaaccgtgggggagacacatgaaattccccaccacaatctag

SEQ ID NO: 40248 - DNA, 270 bp, Glycine max
  Peptide Sequence Number=SeqID_131933
atgtcaatccttaccctcggaagcaaaaaagatgagaaggaaaatttccaatcaaagagaaagcaaaaaagagagaaggaaaattttcaatcaaaggaaaaaaggaagcaaggaaattcccaatcaaagagtgggagaaagcgaaaagaaaggaaagaaaattccaagtcaaagaaaaaagaatgggagaaagtaaaaaagaagaaagctcctggtcaaagaaaccagaagaaatgcgcagagaggtctttggaccagacaatatcttaa

SEQ ID NO: 40249 - DNA, 289 bp, Glycine max
  Peptide Sequence Number=SeqID_131934
ggctgctcgccctaccgaagtactaaaggctttcgaggcttacacctccctattacacgacaaaaaggggggagccctcttatctatcaatggaaagatctccgtgcgtggcgtgataaggaatcctagaaaagatcgattgagactccctccccggtcccacgaagatctctacgtacttgtccagtccaggacaactgagatcttccggtctgcgtgcgtggggagcagctcaaataaagaagagtctggtctgaaattcaggcccggcccgcccgtctgctgctag

SEQ ID NO: 40250 - DNA, 135 bp, Glycine max
  Peptide Sequence Number=SeqID_131935
atgcgaggagtcgccaccactgtttattcgaggaaaatgatgcaatcctaccccgcaagggcattggatagaaaactccaagtagattgggccagagatgcaagagaaggccctagggttcttatgagccttagg

SEQ ID NO: 40251 - DNA, 381 bp, Glycine max
  Peptide Sequence Number=SeqID_131936
atgactaaccgcctgagatatcttttgtttccccttacaaagattcaaaagactaaccgcctgagaattctttgtcctaacacattggagggtacatcctttgtggcacaagtagagggtacatctacttgggttgttatactgagaacaagagagggaacatctcttgtggatcagttcaagtggagggtgcatccacttggttgttcaaagagaacaagggagggtacatcccttgtggatctttggcttgtaaaggattttacaaggttgaaagaaatctcaagaaccgttggttgcttggggattggatgtaggcacgggttgtggccgaaccagtataaatcttatgtttgtcttcttcttccctacactttttaa

SEQ ID NO: 40252 - DNA, 330 bp, Glycine max
  Peptide Sequence Number=SeqID_131937
atggatcgaagttggatgaaagcaaaacgcatcagtgacgagtatgagaacggggtggaacaatttctacaatttactcaacttaatgctgaaagtttgaggggcaattatttctgcccatgtgttaaatgtcttgatgacagcggagagcgtatagaggaaatgatccatgatcttggacaagagacttttgagcaagcgcatgcacctctgtatgatacaatagaacgttattccaagatgccattgtattcggggtgcacatcttttacgcggttgtcagcagtcttagctttggtaaaacttgaaggcaagatttgggtggagtga

SEQ ID NO: 40253 - DNA, 1038 bp, Glycine max
  Peptide Sequence Number=SeqID_131938
atggtagaagaatttgaagagatcctaggatgtcctctagggggaaggagaccatacctcttctcagggttctatccctcattagctagaatttctaagatagtccaaatctcggcgcaggaagtagaccacaggaagcaagtcgaaaatggggtggttggaataccgagaaaatatttggaggcaaaagcaagaatcttggcaagtaaaggcgaatgggcctcgttcatagacattctcgcactgttgatcttcggaggagtcctctttccgaatgtgggtgggttggtggacatagcaacgatcgactcttttctcgcctatcataaccacaaggaaagcccggtcgtcactatgctagccgacctatatgccaccttcgaccgaagatgtaagaagagcaaggtaaggcatgcttgcccactagaaggtcaccgctcatgcacagagaaaggaggggcaaattgggaccaactcttagcaaacaaagaaggagcgtttgtcaactggttcccttggtggaaagaaggaagaatcagagttcttatttcatgcggagggtttccgaatgttcccttgatggggacgaggggttgcatcagttacaatcccgttcttgctataaggcaacttggctaccctatgagaggggcaccactagaggaggagctcgcgcctgtcatttcacgaggtttcaataagaccaacttggagacacttcagaaggtccgcaaggcatgggaggtagtgcgaaagaaggacaaagaactcaggggtagtaacaatgggcccatcggtggctaccgtaagtggttgagagcccacgtgcaaggtttggattggctcctaagtttgagaaccgctagaagggaggaagttgaggcactggaggaagacgaagaggtgcaggcccttagggcagaactcgagcaagcccaaacagtcaaagaaaagttcaaatcagcagctctgaagattcgaaagaacaatgccgaactgagagatacaaatatagctaccaccaaggccttggaatga

SEQ ID NO: 40254 - DNA, 528 bp, Glycine max
  Peptide Sequence Number=SeqID_131939
atgtcaccacgtgcctgtcggtggcttactacgaaggcttattcgaagggattcccagcatcgacgtaccgaacacgtataaatgcactgacgatccctgatgtatgctggatgccttatggtgagcaccgaggagttagggcgtttgaccttatttcatgctttcaggagagggtggtgcgacaatttggatacgttcagaccattcctccactacctacaggtgccagcttgtcatttgaagatattgacgacaggtggatgcattactccgaccatctagcagttgggggacagatttgtcttgtgcctggccagtatacaccagattacatggactggttcttcaggatttctcatccattcatcacacccacacaagcagctgatccgcccatacatccacctgtcctgcagtatgacacgtatgtgaagccagatatccctgaggtcccagtggcaccagaaactggaccttcacatgcaccttctgatgtggagcagcttaaacatgcagtggtaagatga

SEQ ID NO: 40255 - DNA, 178 bp, Glycine max
  Peptide Sequence Number=SeqID_131940
tactttcacttacctttggctttggacttggtcgcctgctggtcggtcacgtgtcgtaggcaacgctctagcctttgtagatgagctgaggtggactctggaggtggtggcggtgcgtctgttgcccactactggctgtccccaggctgctgtggtgcctcgccctgcgcttgcctag

SEQ ID NO: 40256 - DNA, 186 bp, Glycine max
  Peptide Sequence Number=SeqID_131941
atggtgaaagttggaacctcttacgtgccgatcaacgtctcattttcgccaaaagttggcccagggcttcccggtatcaacagggacaccaggatttatttattctgcgaagtgatcttccgtcacaggtgctccagtggcttctgtttctatcagctgtccctcctgttcagtactgacggggtg

SEQ ID NO: 40257 - DNA, 255 bp, Glycine max
  Peptide Sequence Number=SeqID_131942
gcggccaaccaccgggcgcatgtacagacccatgattgtctttaccagttgagcctcagcctgcagagcctgggttttacttcttttccgtgccctactccggaccagttcagggcagaggttgcatggtctggagattggcctgaggcgccagtagaggcaccagcagaggctcccgacgaggcagatgaggcccacgaggacgaggagatgaccgatttacttgatttcttaggagggagtggcgccacatga

SEQ ID NO: 40258 - DNA, 483 bp, Glycine max
  Peptide Sequence Number=SeqID_131943
atggcgcctaccaggcaccctctggacccggataagtccaacagggccctgggatttcccgccttgatcacaggactctgccagtcgttcggagtccctgtcacacctagcaaggtgattcggccgcccatcacccgagctttcattgagaagtattgcacacagagacaggcccagggggatgcttcgcaggccgcagacgcgccgccacctcatcaggctgccccagctggatcatttgatacggatgtcttaggaggtcgccagcaggcgggcaaccaccgggcgcatagccagggttttacttcttttccgtgccctactccggaccaattcagggcagaggtcgcatggcctagagattggcctgaggcccgggcaggagaggcaccagcagaggctcccgacgaggcaaatgaggcccgcgaggacgaggagatggccgatttacttgatttcttaggagggagcggagccacatga

SEQ ID NO: 40259 - DNA, 138 bp, Glycine max
  Peptide Sequence Number=SeqID_131944
atggagggtgaagaaccttgggtggggttatggctaccattgaaatatcgagtggatatgggatcaagtttagcatatgacaacggaattggggtggtcttcgtcattggaagtgcggtagacaggctttgtggttga

SEQ ID NO: 40260 - DNA, 273 bp, Glycine max
  Peptide Sequence Number=SeqID_131945
atggcacgcagcgtgtccgcttcgtgcccctattcaagggacctatatgggagagagctaactaggcttttagtgataattcccaaggtggtcatatctctcttgatggtctctagagtctctagtggagtcgccaattgtcgcaacctacccttcggcgggaaggcgacgagtgactcacgtgtgcgtgttccaagaaaggaatacgcgcggagtcgccaccaacatttatttgaggaaaacaccggaaaagccatgatctacgaactttaa

SEQ ID NO: 40261 - DNA, 1347 bp, Glycine max
  Peptide Sequence Number=SeqID_131946
atgctgcgtgacgaggtggatatgataagttccgatgtttctggttctacgttgagtcaattaaataagcgcatcatcccgtttatcgtgatctgttattttgtcgctaatctcgataaaaccaatatctctatcgctgcgctgcaaatgaatgccgatctcgggcttaccaccagcatgtacggcctcggtgtcggcatgttctatatttcctacattctgtttgaaattcccagcaatgtcattatgaccaaagtcggcgcccggcgctggatagcgcgcattatgattacctggggtattgtcagtaccggcatggcgctggttcatagcgccaatcagttatatgtgatgcgttttttactcggtatggccgaagccggttttgcgccgggtattatctattatatttcctgctggttccctaaaagtaaccgcgcacgtgcaatgtctttcttttatatgggatcggtgggcgcgtcgattattggtctgcccatttccggtgccattctcaatatgcatggcattgccgatatcgcaggctggcgctggcttttcgcgctggaaggcattcccgcagtggtgcttggttgtctggtgctgtggcgcttacccgataagcccgacgatgctgtctggttaactacaccgcaaaaacactggctgcgtcagcgcctcgaacaggacaatctgggtgttaccctgaataagaaccactcctggctgcaggcattaaaagatcgcacggtgttattgctcagtctggtgtggtttttacaggcgttcggctccatcggcattacgttgttcatgccgttgattattaaaagcatggccgcagagcagagcaattttattatcagcctgttatccgccctgccctttgtgatggtctgcgtatttatgtatttaaacggacgccattccgatcgcagcggtgaacgcgcctggcatatgggcttgccattaattttatcgggcctggcattaaccggcgcgatttattcgggcagcctgctgctcgcctatattttgctggtcttgaccgtcgggcttaactttgccctgacgccaatattctgggccgtgaccacagaaaaattagctggcgtagccgctgcggcatcgattgcctttatcaatacggtggcaaactttgtcggactgggtttaccgccgctgctgggaaaaatgaaagatgcgacgcagagttatcactcaggattgctgattgtggcgatagcgctgattgtcggcggtattctcggtattattatcgcccgtccatcgggcggtgccggtgccagcaaaacccgcgcgcagcatgtcgaaaccgggcactga

SEQ ID NO: 40262 - DNA, 279 bp, Glycine max
  Peptide Sequence Number=SeqID_131947
atgtcggtggtcggtcaggccgccagcgacatgctgcaggatgaagagggcatccgtgtggccgtcagcagctacgtgttctgtaactataaaatcgccacctactcgacgttgctggtggccgcagagcaggcggaagagggggaggatgtcaggattgtgcggcgcattctgcagcaggaaagccagatggccagctggctgctgcagctgctgccacaggcggcagaggaagccattgtgctgcgcacggaacctgagctttccggcacggattaa

SEQ ID NO: 40263 - DNA, 252 bp, Glycine max
  Peptide Sequence Number=SeqID_131948
atgaaggatccaaagaagaaacctgaagaggaagaaaaagtgacgcaacgtcgtgggggttcaggcaacttcgcagccgataaggagcgcgcggctgaagcaggccgcaagggtggtcaggtcagtggcggtaactttaagaacgatccacagcgtgccattgaagccggcaggaagggaggaaagatcagtcgtcggataattgcatctgcgatgcaccttaccggggttaatccgccgctatccacttga

SEQ ID NO: 40264 - DNA, 3764 bp, Glycine max
  Peptide Sequence Number=SeqID_131949
gccgccaagcattcccgatgccaccgctggcccagctgagtgcgcaggtgcagggcggctggcgtgtgcgtgatgtcgccgcgctggcggcggcacaatttctgcggctcggtgctgacagcggtgaaaccggaccgattgttatcgccagcggcgacagcggatttttgcatgccagcggccatgagcagcgtcttcaagcgggcgatgtgctgcacgttgagctgatcccaaaagtgcggcactacagcgcgcgcctgatgcgtccgctgattgtcggtgaaatctctgcggcgcgcgcggcgctggcacaacagctgatcgctattcaggatcgccagctgcgggcgatgaagccgggcgtagcggcctgcacggtggatgccgtcgcgcgcgaggcggtgctcagcgccgggctgcgtgaggattacagcaacatcaccggttatgcgctgggtctgtatacccgcaccccgcgtccgagcgatttcagctgctgttttcatcctcaggcgccgtggttactggaggaaaacatggtgtttcacatgtatatttcagcgcagggcctcgccttcagtgaaaccgacgttgaattaatcgatttggctgccaccttgccgggcctgatgtttgatctgaagtacgccaccgccgataacatcgccgggtatgccatttatcgcgacgcgcaggcgctgctgcatccggatgccgccgccgcgctgcgccgcagcagcgacatcgcccggctggcgggatttcgcctgctggtgctggacgcgtatcgtccgcagcaggcgcagtggcacttgtgggatgcctgtccggacgcggattatgtggtgccaccggcgcggggctcgaatcacagccgcggcgtggcgatcgatgtgacgctgatggatgaggcgggcaacattctggaaatggggaccgggtttgacgacatgtctgctgagtcgcacccgttccatcccaacgtgccgcagcaggcgcagcgccatcgcctgttgctgaacgccatcatgctcggcggcggttttgtcgggatgcccaccgaatggtggcactttgaactgccggatgcgcaaaactatccgctgctcagcgatcgctttgcctgcgtcagccgggctgatcgcgctcctcggggggttctgcgccttcccgccttgacacgccctccgttccgaccccagaatgcagcttgttccaaggggtgccctggatgtggaaccggggtcactgcacgccctcattccctctttgcgcctttctgcgaatcctgcgcatttctcaggccctggctggccgttatgccgcagtccaaagagggcaccttcatgaccgaagcgtcaatcattgccacgctgctggcatttatgcagcgcgaagaaaccaccgaagcggatttcaaccagctggcgctgcagctgttcgcgtggcaattcgaacacaatctcccttacgcccgtttcgcccgccagcgcggccgtacgccgctgacggtcaaacagtggcggcagattccggcggtgccgattacggcgtttaaagatctgacgctgagctgccgtccagtggcggagattccccacatctttatgaccagcggcaccacgggtactgggcgggggcgcagctatcacccgacgctggcggtttacgatctctcgatgctgatcaatttccgccagcgctttatggccggatatccgcgcctgccgatggcgatcctgtttccgcacagcagcgagctgcccaactcttcgctggcccattatctgacgctggcgatgcacgaatgtggcacgccagacagcgaagtgatggtggatgcgcaggggctgaaactgccgcgtctgatcgccgcgctggagcaggcgcaggccagcggccaaccctatgccctgctgggtgccagctacagttttgtccatctgctggacgaactggcgcgtcagcagcggcgtttcaggctgccgccgggcagccgcatcctcgacaccgggggctttaagggccagtcgcgtgaagttgcggcggaggcgttttataacgcgctgcagcagacgttcggcgtgccgcgttcgcactgcatcaatatgtacggcatgactgaactcagcacccagttttacgatttcggcaatgaaatctgcccgccggtgaaatccggaccgcactggatccgcacgcgcgtggtcaatccgctgaccggtgcggacgtgccggaaggggagacaggcgtactggtgcatcacgatctcgcccatttcaattctgtttccgccattctgaccgaagatgccggcgtgatggtgcccggcgggctgctcgctggcgatggaatcgtttctcgctgctgcgcaggcacgggcatgaaagtgtatgccggccatctgccgggcatccgccacagcgaggtggcgtggcacagcctgcactttggccagcaaggcagcacgctggaagtgtgcgtgccggtgctgtccgaggcgcagattgccacgctggcggccagcgtacgcgataacgcgcgccgctacctgcacaccctgagcgtagcgcgcatcaccgcgttgattgatgaagccatcgcgcgcctgcttaaccgttcgcacccgttgcgccagcaggcggagcggttgctgccgctggttaccggctatgacgccgggatgctgcggctcggtttaactggctatctcaaaacctttcgtgaaccgcagctgcggcgttttctggcggaggatttcggcaacgtgcagatgctggacgattttcagccgcggccaaaaggcggctttgcccgcgcgtttggtccgcagctgttgctgcaggtctgggccggcaatgtgccgggtttgccactgtggagcctgattgccggcctgctggtgaaggcgggaagcgtgggcaaagtggcgagcgctgagccgctgatggcgggctggttcgcccagctgctggcggagatcgatccgcagctgggcgactgtctggccgttgtatggtggcagggcggtgatgaacgcactgagcagcagtggttccgcgaggcagacgttgtgatggcttatggcggagaagccgcgctgacggcgatgcagcggcgtctgccgccagccacgcgctttctgccgcacggccacaaaatcagttttggcatggtggcgcggtcggcgctggacgtgcggcgcggtacggcgctggcgcgtcaggtggcttacgatgtgatgcgctatgaccaggccggctgttactcgccgcaggcgctgtttattgagcgcggtggccggatgtcgccgcaggagtttgctgcttatctcgcccatgaacttgccgcgctggcacagcgctatccgcgcgcgacgctgacgctgggtgaaagtcaggctgtggccgcgtggcgcaacgcggaggaaatgcgtgcgctgagcggtgaccgcacgctgtacggcgatgagaacgatgcctgggcggtggtgtacgtcgacaagccggagccgttacaaccgggcgcgctcggacgtacgctgaaggtgattgccgtggatacgctggaggagacggtaaactgggtggccgcgcagcgcgcgtatctgcaaagcgttggcctcgcggccgcgcccgaggtgctgtttcggctggcggcgcagctcggtgcggcgggcgtcacgcgcatcacggcgctgggtaaaatgacttcaccggaggcgggctggcatcacgatggccgttttagcctgctggatctg

SEQ ID NO: 40265 - DNA, 4644 bp, Glycine max
  Peptide Sequence Number=SeqID_131950
caccagcgtttcatgcatggccgcaatgcccttcacccggcgcaggcgtttcaggcgaatcactgcgtcacctgctgcgatctgcaacttatcggcttcgtcggcgctggcgcggctgtgctgatactccagcagtcgcgtctccgactgcagcaaaccgcccgctttgtcatgcagacgaaaatagtgaaagaaatggctgaggttatgcagcggcgcccagccggtcaccaccgtgccggttttgcgccggcgcatcagcatcccttccgtcgtgagcgccgccagcgccttgcgcaccgtaccgaccgagacaccgaacttcgccgccagactgttttcactgggcaaaatggtgcccgccggcagttcgccctgcaggatggattcactgatatggcgcttcactacttcgtacagcggagcgccttcgccttcgttcaggcgactgaattgtggaacgaaaattcatcactacagcgcgctctgacccatatcgccgacgatcaggcgcagattcttgacgatctgcaacgcatgctgcggtggacacctgcttcccgcccggactggcgcgtttcggtgcccgacgcgctgtggcagacgccggacggcagcgcgcagggcgagcgggtgaatctgctggccgcgctggatgccggcgcggctgaaaactgcaatctctactttcacaccgatacggttccggccggcgatggctggcgctttccgccgctggcgctcagcgtggcggaaaacaagctgtttggacgcggcgccgcggatatgaaaggcaccatcgtggccgcgctggctgcggtgcgggccgcgcagcgctatcagctccacctgcgctataacccggtgtttttactctgtaccgatgaagaaggtggcctttatcccggtattcgttatctggcggagcagcagttattccacggtcacctgctcagcttcaacggcggcgcggtgccgcgtatctgggccggttgctttggcagtatcgatatcaaaattatcgtcagcggccgctcggcgcactccggcgatccgctgcagggtatcaatgctattgaggctgcgcttccgctgatgaatgcgctgtatcagctgaaagacgaggtggaacagcgggtttcggcaatgcccgcaccgccgcattatcagggccggccgctcaccgccttactgacgctggccgccgcgcacggcggcagtaaaggctccaccattccggaacgcttcgagctgctggttaatcgccgctatgcgccggaagagccgtttgccgacgtgtggcaggagctgacgcagtgcgtggataaggcgatgcagggcagcgccgccagcgacgtcacgctgcagctgattggccatctggcaccagtcgccgatcccaccggtccgcactggccgcgctggcaggcggcgctcagccagggcttcggcttcccgccagcagaattcaaagcctggggctccgccaccagctcggatatgggctgggtacagcaggccggcattcaggaaattctgctgggcggacttgcccgtcccgataaccgcattcatgccgccgatgaatacaccacgatggcagatgttattgcactttcgcagtcgattctggcgtatctcgccaatgattttcagccaacccaggggttaaaccgcagacagtttatcgccagttcaaccgccctgaccggagcggcgctgctgccctggtcattcagtgcctcggctgccgccgttgccagcgcgaccccgggcggcacgccgcgtaaaggtggcttattgcgcatcagcgttgaccaggcggtcagcgtgctcaatccccatcaggtgcgggttaatccggaatatctggtggcagagctgctgtacagcggcttaacccgcctgacgcaggcgatgaaagcggaaggcgatctggcgcagtcctggcagccgaacgacgacttaacccagtggaccttcacgctgcggcccgatctgcgcttcagcgacggttcgccactcaccgcagcggacgtggtcgccagcctgcaggcactgctggacccgaaaaacgcctcaccggcgctgcacaacatcggcccgattaaaacggtaagcgccaaagacaacaacaccatcctgattgagaccgaggcgccttatgccgatctgccggtgatgctggcctatccggatgccaaaattatcccggcgcatatcgcgcaggggcagtacgacaagctgagtagcgcctcgctcggggccgggccgttccagctggtgtcttacgatccggaacgcaaaatcgtggtgaaacgcaacccgcactattacgacgccacgcggccgtatctggatggcgtggaagtggtggtgtatcccgacgctatcgctgaaagctccgcgctgatcgccggcgataccgatctgatgctgagtgcgcagtcgagcgagtttgcccgcttagccaaatcggcgggcgtgctgccgctgcgcgtggcatccggtcagtttcttaacgtcaacatgggctgcgatcaaaagccgtttaatgatgtgcgcgtccgccaggcgctggcgctgtgcgtggaccgccaggcatcggtagattttgtcgcagacggtctgggatcgccgggtaacgacacgccaatcaacgccgcttatccgtattacgcgcagctgacgcaaaaagcgctggactacagcaaagccaaagcgctgctggcggaggccgacaaaccgtcaacccgcacccagctggggattgccctgcgggagatggcgaaaccgggcggtttccgtatcaacgtgcagaccatggcgcacagtacctatctcgatcaggtgtggaagaagggcaatttctacgtcggcttttacaacatgcagccgacgccggatgcggtgttttctctgctctatacctcaacagcggcgtggaacgaaacgcgctggaacaatgcggctttcgacggtgcggtgatggcggcgcgcgaaaccaatgacgaaacgctgcgcacccagctgtacggcaaagcccagcagctgatgcacgacgaggtgccctcgttaatcccgaccttctttgatttgctggctgccagtcgtgagcacgtggcgggctatcatctgcatccgcgcgctgctgcccgccgatgccgcggtcacgctgctgggacaaaacgccacgccggaagcactggcggcggtgcgggcgcggcttgggctggatgcacccgcctggctgcaatactggcactggctgacgcaggcgttgcagggcaactttggcgtgtcgatgcgcaatggcctggcggtcggaccaacgttgctgacggcgctgtcgcgctcgctgctgctggcgctgtgcgccctgttactgatgctggtgatcgccattccgctcggcatctgggcggccgtgcggcgcgcgtgatctcgtacatgggcatctcgtttccggaattcgtcaccgccacgctggtgctgctgctgtttgccgatgtctggcagattctgcccgccaccggctacgtgccgctcagcgaaaattttatcagcggtattcagcacctgattctgccgtcgatcaccgttgcgctgattctggtggcacacgtttcgcgcatggtgcgctcggaaatggttgacgtgctgcacaccgactacgttcgcgccgcgtggctgaaaggcctgtcgcgccgacgcatcctgtggcgccatgcgatgcgcaatggcctgctgcccaccatcaccattgtggcgctcgacgtcggctatttgctgggcgggattgtggtggtggaggagatttttgccattcccggtattggccgggagctgattgtcgcggtacaggcgcgcgatctgcccactattcaggccggcgtgatgatcctcgcggcaacctatgccgtgggtgcggcgggtgtgctgattctgctgctggcgctgctgatggtggcgggcggcgcgcacgtggcaccgtttgatccggaagcgatctccatcctgacgcgttaccgcccgcccagcgcagaacactggttcggcaccgatcagctggggcgcgacattttcagccgggtgctcgtcggcgcgcgatccaccattttgctgtcgctgctggcgaccgcgctggcgatggttattggctcggtgctgggcaccgccagcgcctaccttggtggcaaagtggatgaattcctgatgcgcaccatggatgcggtgatggcgattcccagcctgctgtttgcactgctgattgtcagcaccctggggcagagcagcatgaacgccgtgctggctatcactatcgccttcgtgccgggtatggtgcgcattgcgcgcagcgtggcgctggcggcgcgtcagcaggactacatcagcgccgccatcgcgcgcggcgaagcgggttactacatcattctgcgcgaaatgctgccgaacattctcgcgccgatcatcgtggaagccaccattcgcgtggcattcgccatcatgctgtttgccacgctgagctttctcggcctcggcgcgcagccgcccgagccggacaccgtggatgatgatgatccccggtctggctatcgcgctggtggcgattggcttcaacctgctgggcgatggcctgcgtga

SEQ ID NO: 40266 - DNA, 2021 bp, Glycine max
  Peptide Sequence Number=SeqID_131951
cgctgggcgtgctgctggcggcactggtggtctgggcgtttgccaccgatctgctctggcccagccagcagcgccggatcgtcgagctggcatcagtccgccatcgcggcattgcgctggcgctgaccagtgccttcatgtttggcggtatcggctttggctcggcggtcgcatcatggatatatcctctggccggcttttacgggctgatcggcatgtcggtggtctttattctgctggcgatgctcagtctgcagctgtcagaaaagcgcaggcaaccgggggaccggctggctgcggaccggcttttacagaacgtccggataaggtcatcgccagtgcgttctggccaaccaaagtgttgccacagctggctgaacagaatgcaaaaatcaaaacactgacggttgaaatccccaccctcgaatccgtgctggcgcaaaatccggacttcgttcctgcccagacgccgctgctgctgggacccgagagcaaggtggcaaaacgcgaagatttaatcacccttggcgtgaacagttatgtgtcgccaggaatgtgcgccaccaaaaaagccgcaggggatatgtatggcagccgccagcagctgtgggatatgacgtacctgtatcaggagattcaggacttcgccaaaattttcaacgtggaagatcgcggccaggcggtgattgccgatttcaaaaaacgtgaagcggcactgcgtcaggagtttggtagcagcaaaaaagatctctcgtttgtgttctggttctcaagctcgtcaccgtctgcggatgcctatgtgggcggtaaaaacagtccatccggattcatcgccagcgtgctgggcgggcacaacgccatcacgtcagagaccgaatggccgacggtcagctgggagagcatcatcgctgccaatccggatgtgatcgtggtctccagtctcgatcgcaatcgctgggcgctggataaagccgaagagaaaatcaaattcctgaaaagcgatcctgccgtcagccagctggatgcggtaaaaaaaggccacatcgtggtgatggatggccaggccatgaacccgaccatccgcactatctacggggccgaacaggcgcgacaggggctgttcctggccgcctcgctggtggctgccgtcgcgttattattgctggtgattgcgaccggtgtcagcgtcggagaactgtcgatcccgctaaaaagcgtcttttatgccatcagcaataaaatggggctcacgcacgttcccctgagccgcatctacgaaagtgtgatctgggactttcgcctcagccgggcgctggtggcggcgtgctgtggcgctggattggcgatttgcggtgccgttttgcaaagcctgctgaagaatgcgctggctgagccttatgtgctcggtgtctctgccggtgcctccactggggcggtttctgtcgtggtgttgggcatcggcagcggggccgtctcgctgtcggcgggagccttcgccggcgccttcactgcctttgcctttgtcgcttttctgacgaaaggggcacgtggcggtaatgaacgcaccatcctggctggcgttgcggcttcccagctgtttaatgccatcaccgcttataccatcagcacctctgccagtgcgcagcaggcgcgcgatgtaatgttctggttgctgggcagcttcagtggcgtgcgctggccggaactccagctggtgctggtggtagtgaccctcggactggccatttgcctctactattcccgggcgctggatgcgttcacctttggtgacgatgcggctgcctcgctgggtattgcggtgcctcaggtgcgccttgcgctctttatcgccaccgcgcttatcaccgccaccatcgtcagcatggccggttcgattggttttattggcctggtggtgccgcatcgcattggccggtgccattctgatggtgctggcagatatcgcgtcgcgcctgctgatcgccccgcaaagcctgccggtaggcgtggtgaccgcgctg

SEQ ID NO: 40267 - DNA, 457 bp, Glycine max
  Peptide Sequence Number=SeqID_131952
atgaggggagcgccaaccgaagaaagtctctcgcctttccttgtgaggaatctaggcgcgcaaagtctcaaggcgatacaaagagtccacaaggcgtggagaagtccgttgaggaaagacaaggagcttaggggcatccgaaatgacgttatcagaggttatcatggatggctaagaattcatgcgcaagggttagattggctctccaaattgaaagttatcaatgaggagaacttcgaagctccggaggaagatgaagaagtccgagccctaaaattggagctagggaaggcaaggctcgccaaggagaagttcaaatcagctgctacacacatccggaaggagtgcaccgagttacaagaggaaaacgcggccactgcaagagcctttgaacaagaaaccaaaagggcccgcaaggaggaatatggccgagagaaattccgaggagcattgtggg

SEQ ID NO: 40268 - DNA, 372 bp, Glycine max
  Peptide Sequence Number=SeqID_131953
atggggatcgcacccacagagacacccagtggacctgaagaagtccaacagggccttggggtttccagctctggttacgggcctctgtcggccctacagggcgcccgttcccccccagcaagttcatgtcgtcgtggcataggtaaggattgtgcctgcaagacacctagtggacccgaagaaggccaacagggtcttggagttgctaactctaaatacgggtctctgtcagttctagggagtgcctgtcgcccccagcaaggtcatcaggcccccctaccaatcgagctttcatcaagaagtactgcgcccccaggcaggcatagggcgaaacaccacatcagcattgggatggccggtagcgggcaatag

SEQ ID NO: 40269 - DNA, 201 bp, Glycine max
  Peptide Sequence Number=SeqID_131954
atgacgaaagacaacgattggtacctcaaagccttacactggggcaatgaggggcatcttaccctcaccgttgagaggactacacgtcctcgccttgagaggactacacgtcctcaccatcagagggctgcatgccctcacctccagaggactacatgtcctcgccttgagagggctacacgccctcaccttgggtactag

SEQ ID NO: 40270 - DNA, 420 bp, Glycine max
  Peptide Sequence Number=SeqID_131955
atggaagggttagtggacctagcagcgattgacgctttcctcgcctttcatcatggcaaggaaagcccggtcgtcgccattttggccatgtatgaacgtccgactggggatgtgaaaagagcgacgcaagaattgtttgttgtgcactggctctctatgtgtggctggtttcacacctttttctccaagaaggtaggcccgtctatccgctacaaggtcaccgctcgatgtccaaatgttcccttgatgggaacaaggggttgtattaattataatcccgtcctcgccataagacagcttggctaccccatgagaggagtgccatcagacgaaagcatcacgcctttcatcgcacggggtttcagtgaccacaacgcgagggtactccaaggagttcgcaaggcatgggatgcggcatga

SEQ ID NO: 40271 - DNA, 438 bp, Glycine max
  Peptide Sequence Number=SeqID_131956
atggtgaaagttggaacctcttacgtgccgatcaacgtctcattttcgccaaaagttggcccagggcttcccggtgctccagtggcttctgtttctatcagctgtccctcctgttcagctactgacgggggtggtggcgtaacggcaaaagcaccgccggacatcagggctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggcgaattggagctccacccgcggtggcggccgctctagaactagtggatcccccgggctgcaggaattcgatccatgtcgccgcgtccccggcccccttgttctggttggcctgtccttcgacggctagcgattga

SEQ ID NO: 40272 - DNA, 534 bp, Glycine max
  Peptide Sequence Number=SeqID_131957
atggcatctaagaagaggaaaacaccttctacacctacccaggctagatttgatagatccaagttcacatcccaagaggcttgggagagatatacagacattgtggtgcctcgtaagctactactagagaggaatgtggtagtttattactcagagtttgacaagttcaaggaggaactcgagaggagacattgggatgagaagctgactgatttttttgacagtatcatagacattgctattggaaaggagttttatgcgaacctctatgaccctgaggataaaccacctaagcaggtgaaggtgaggggtcatttagtgaagtttgatgaggataccttgaacacattcttgaagacccctgtagtgctggaagagggggagaacttgtgtacttattccagatttgcactcctgaggcctgatcctcaggagttggctgctaagctttgtatcccaaggaggggatttgagcttaatgctgatgggcagcctttgaagattttgaggaagaacatgaccactctagcttag

SEQ ID NO: 40273 - DNA, 201 bp, Glycine max
  Peptide Sequence Number=SeqID_131958
atgatgcgtgaagacaagaagtctagtctaatcctgatcaggcatcgcccgctgtcgcaacgtgcccttttgcaggcgagcgaaggcgaggctcacgggtgcgctttccaaaggaggaaagatgcgcggagtcgccaccaaagtttatttgtggaaaatgttgggaaaaccgaaggaaaccggtcaaatgaaaaattctaa

SEQ ID NO: 40274 - DNA, 465 bp, Glycine max
  Peptide Sequence Number=SeqID_131959
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccttgactttctggagggtgatgaggatccacttctcgaggtggattctcccgaggaagtcatgtcggcatctgaggcagactctacggaggatagtggcccgagggagatggcgatcagcggaggctcttcatcctag

SEQ ID NO: 40275 - DNA, 765 bp, Glycine max
  Peptide Sequence Number=SeqID_131960
atggccttcatcatcctcaattcatgtattcagtccatacttcagagattcatgcaaaaatcagtactaaatgatagtcgtttctcttgggctgcagaggcctctccccctccagaaggagaaggttggactcctggccaagccacctgtgcaaggaactcctccacactcatggtcggctgctggacagagctctgcaacctctggatgatgatgatctggcctctgtgcaggctctggagcatggcaaataatttctttgaagtgaatgaggagggccttgtagggggagctggaaatgatggagctggtaagggagtgggagctgaagctggtaactgtggaagatgtggagttgaagcggattgtgctgaagaatctggtaaagtagatgaagaaggagaaaaagtatctggtgctgctgaagtaggaggagcctcagatctcttacccttggccttccttggccctctgaatgtcattgttggatcatctagattccaacagttcttttttatatatgccaagttaatggtagggctaaggctctccaaggatctagaatctgatgtgacccttctagctttacacaaagctgtgattaagtgtgatgtcagaagtgtgggaggtaggaaccaagttggagtaagaaagaacactccaagtctaagcaagtgtggtcatgttcttcctgaggatcttcagaggctgaccatcaatattaagctcaaatcccctccatgggacgcagagagtagcagctaa

SEQ ID NO: 40276 - DNA, 151 bp, Glycine max
  Peptide Sequence Number=SeqID_131961
atggacatagactatgctataaggaaagaagaaccatctgcaatcactgatgaaagtagcccagttgttgttgcactatgtgagcggatggagcgatccaacaagctcagtgtgatgttcattaagaccaaaatctcgactgggatatgtg

SEQ ID NO: 40277 - DNA, 309 bp, Glycine max
  Peptide Sequence Number=SeqID_131962
atgatggtggcccgggtgatgttagggcacgactatgagcccgggatgggtttgggcgagaataacggcggcagggccggcctggctataaacctacacaggctgaacgtaaggaaaaacatctcggaaaggaagaacaaaggccaaggctcgcggtcaggacagcatgccaaagaggttccgccgtgccacatcagtaggagcttcgtgagtgcaggtttaagacgcgaaggacaagtcgccgcgatatgcgatgaggactccccgaggagatcgaatttggtacagccatgccctcccggtttctaa

SEQ ID NO: 40278 - DNA, 735 bp, Glycine max
  Peptide Sequence Number=SeqID_131963
atggagactcccatggcaaggaaaaccaagccgttaactgatacggaaatcaaagccgccaaacctaaagatgccgattaccagctgtatgatggtgacgggcttactctgctaatcaagtccagtggtagtaagctctggcagttccgttactatcgacctctgacaaagcagcgaactaagcagagctttggagcctaccctgccgtctcactttctgatgcgcgtaaactaagagctaaatctcgagttttattagcaaaagatattgatcctcaggagcatcagaaagaacaggtgaggaattctcaagaagctaaaaccaacaccttcttgttagttgccgagcgttggtggaatgtgaagaaaaccagcgtaacagaggactatgccgacgatatctggcgctcgcttgagagagatgttttcccggcaatcggtgatatcagtgtcactgagattaaggctcatactttggttaaagcagttcagccggttcaggccagaggtgcattagagactgttcgccgcctttgtcagcgtattaacgaagtcatgatttatgcgcagaacacaggcttgattgatgcagttcccagcgtaaacatcgggaaagcgttcgagaaaccgcagaagaaaaacatgcctagtatccgcccggatcaactcccacaactaatgcagactatgcgcacggcaacttctcaccattacccgccctgccgaagccgctga

SEQ ID NO: 40279 - DNA, 183 bp, Glycine max
  Peptide Sequence Number=SeqID_131964
atggataaggccgtgcctgcggatgacaattctccaaaaatctcaagcgtttgtaagggacacattcttaaggtactcgaatgggaactggagtggaagtttgaaaggaaacaccactgtcgttgtgaacaatggacctccattggaaaaataaaacctaatgtggagttcacaactgtatga

SEQ ID NO: 40280 - DNA, 511 bp, Glycine max
  Peptide Sequence Number=SeqID_131965
agggctgcacgcccttgccttcagagggctacacgccctctcctttagagggctacatgtcctcgcctttggaggactacacatcctagccttcagaggacttcacgtcctcgcctttagagggctaaacgtcctcgcctttggagggctacacgtccttgccttcagagggctgcacgccctcgtcttcaaaggacttcacatcctcaccttcagagggctacacgtcctcacctttgaagggctacacgtcctcgacttcagagggctacatctcctcgccttaagagggctacacgtcctcacctttagagggctgcacgccctcgtctttacaggactgcacgccctcgccttcagagggctgcacaccctcacctttagaggattgcacgccctcaccttcaaaggactggacgtcctcaccttcagaggactacacatcctcgccttcagaggactgcacgtccttgccttcagagggctacacaccctcaccttcagaggatga

SEQ ID NO: 40281 - DNA, 184 bp, Glycine max
  Peptide Sequence Number=SeqID_131966
aacatccatctcaagagaatcaagaacaagtcaagagttcaagaatcaagaagaattcaagactcaagaagaaagcctacaatcaagaatcaagattcaagattcaagatctcaagaatcaagatcaagattcaagattcaagactcaaaattcaagaatgaagacaagactcaatcaagataa

SEQ ID NO: 40282 - DNA, 576 bp, Glycine max
  Peptide Sequence Number=SeqID_131967
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatactgtcggtttccatcaaagaccatgttgcgccacttcaagccaaagaggtggatatacttcagcaaaaatgcaatcgatttgagatgaaaaaccataatttccgcgaagatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 40283 - DNA, 375 bp, Glycine max
  Peptide Sequence Number=SeqID_131968
atgggagaagtagaggaggtgcaaaagcaaatgaaggccgacatggaggccatgaaaaagcaaatggccacaatgatggaggccatgatgagcatgaagaagataatggaagccaatgcggttgcagtttccgctaccagcgttgttgctaaggtgaacccgatgcccccatttggcctcaaccaaatgaatcatccaacctcagctatggtaggtaaagatttgggaagtacgagcggcccctattatttgcaaattcaaaacaagtacgccttcccaccatatggcttgcctcccaactatacaccacccaatatggcatacactcccagtgaggatgtcaataactccactcccatactcattgagagatga

SEQ ID NO: 40284 - DNA, 360 bp, Glycine max
  Peptide Sequence Number=SeqID_131969
atgggggagacacatgaaattccccaccacaatctagccgacttcgagccttggctcggatataccactgaagggcaagcagttggtggtataccctacaaaaccctttggagggccctcagtatcacccacaactgcacctcttgcattccacagcggttaaaaaccctcatgactatggcaggaatgggaaagttggatcatctagaggaaaggctcaaggccattgaaggaggtgaagattatgcctttgctcacctaaaagagttgttcctagaacccaatatcatcacccctcccaagttcaaggtgctggaccttgacaagtacgaggggactacttgtcccagaaccatctaa

SEQ ID NO: 40285 - DNA, 259 bp, Glycine max
  Peptide Sequence Number=SeqID_131970
atggggatcgcacccacaaagacacccagtggacctgaagaagtccaaaagggccctggggtttccagctctggttacgggcctctgtcggccctacagggcgcccgttcccccccagcaagttcatgtcgtcgtggcatagggattgtgcccgcaagacacctagtggacccgaagaaggccaacagggtcttggagttgccagctctaaatacgggcaggagcagggcgaaacaccacatcagcattgggatggccg

SEQ ID NO: 40286 - DNA, 786 bp, Glycine max
  Peptide Sequence Number=SeqID_131971
tggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaggtgagtttgtaactgataaggatggatcattgtcatacagtgggggagatgcctatgcaatagacattgatcagcagacaagtttgagtgattttaagtatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40287 - DNA, 288 bp, Glycine max
  Peptide Sequence Number=SeqID_131972
atgacggctgatatggtggccttgaaagatcaaacagcttccatgatggaagccatgttaagcatggagagaataatggaaagcaacgcagccgcagttgtcgctgctagtgccgccactgaggcggatcctacccatccatctgcaataaatcaatcacatcaacccgtcccagacatggtgggacaaggaggagaggtgttgggcagcgccagtggtccacacatgggggtcagaaaccccaacctatgggaggtgcccgtgaagaacctcgggagcatgctcaag

SEQ ID NO: 40288 - DNA, 439 bp, Glycine max
  Peptide Sequence Number=SeqID_131973
gtgctccagtggcttctgtttctatcagctgtccctccctgttcagctactgacggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttgaactcactaggggtggggttaagagggggtagggccaggtataggggacttagtgtcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagg

SEQ ID NO: 40289 - DNA, 98 bp, Glycine max
  Peptide Sequence Number=SeqID_131974
atcaccgtctcattttcgccaaaagttgacccagggcttcccggtaccaacagggacaccaggatttatttattcggagaagtgatcttccgtcacag

SEQ ID NO: 40290 - DNA, 279 bp, Glycine max
  Peptide Sequence Number=SeqID_131975
atggcagactcaacggatgactcctcaaccattgaagaaactgagctaaattctaaatttgaagaagtttcaaaagcgtttaatgaaatgcatgaagaagtgcaaaggcttgttgtttcaaacagaaagctaagaagcaatctaaaactgcatatcactaaattggcttcaacacaaagtgagttggataaattgggacaagaaaatgaaaaacttgtttcaagctataaagccactggttgtgtttgtgcatctacctctcttaatatggatgattaa

SEQ ID NO: 40291 - DNA, 297 bp, Glycine max
  Peptide Sequence Number=SeqID_131976
atggcttctgtttctatcagctgtccttcctgttcagctactgaaaggggtggtgttatccgtcaattcgcacaaagctacacgccggaacatcagcgcggcaagtggcgcgtccctttccattcagggactgtcgtccaactgcttaagaatcggcaacgggggatcgagtgcgggcctttcgctattacgccagctggcgaaagggggatgtgctgcaaggcgattaagttgggtaacgccagggttttcccagtgaacgttgtggaaaaaaacgacgggccagctgaattgtga

SEQ ID NO: 40292 - DNA, 132 bp, Glycine max
  Peptide Sequence Number=SeqID_131977
atggccctcggcgttcgcttactcgaatccactcaaggctgccttgcagcggcgttttccgcttgtcccgagctgggaagggatgacgatctgttggtcgtgaccctagcctctatttgtgtccgttcctaa

SEQ ID NO: 40293 - DNA, 210 bp, Glycine max
  Peptide Sequence Number=SeqID_131978
atgggtgatcaagaggagacacaggaacaaatgaaagccgacatgtcggctctgaaagaacaaatggcttccatgatggaagccatgttaggaatgaggcaactcgtggagaaaaacgtggccaccgctgctgctgttagtttggctgccgaagcaaacccaactctcctagctaccgcgcaccatcctcccccaaatgcggtaggatga

SEQ ID NO: 40294 - DNA, 348 bp, Glycine max
  Peptide Sequence Number=SeqID_131979
atggttattgaggggtttcatcagcagactctccttccccgtggagaaaacaccgagactttttcaagtctcacaagttatccagaactatgtaggtctgagttcctcattggaggatacgtaggagcaagagccttgcttttgtcgaccacaccaccttttgctgtcatgacccaagagctggtaacccgcggaggcaccttacggttatccgcacctcgtcattcagtgaccccaagtgtggttgatgagcagagaccaatgtggtcatctgcgccctttctggagatgtcagcatcttccggtagagagtttttcaagtctcacaagttatctagaactacgtag

SEQ ID NO: 40295 - DNA, 168 bp, Glycine max
  Peptide Sequence Number=SeqID_131980
atgtgtcgtaggcaacggtggtggcggtgtgcctgttgcccgctatcagccatccccaggctgatgtggtgtctcgccctgcacctgcctgagggcgcagtacttcttgatgaaagctcggttaatgggggcctaatgaccttgttgggggcgacgggcacttcgtag

SEQ ID NO: 40296 - DNA, 669 bp, Glycine max
  Peptide Sequence Number=SeqID_131981
gggctccagtggcttctgtttctatcagctgtccctcctgttcagctactgacggggtggtgcgtaacggcaaaaagcaccgccggacatcagcgctgggcaagtgtagcggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcatcattgcggcgtgggctagggagcgtcctgacttgcccgtcgaggtaatggagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggcggagatttcctggaagatgccaggaagatacttaa

SEQ ID NO: 40297 - DNA, 462 bp, Glycine max
  Peptide Sequence Number=SeqID_131982
atgctccaacctcgaatcgttggtgaagaacattatgagactgcgcaaagagttaaacaaactttacaacgttacaaagaacttcaagacattatagctatccttggcttggacgaattatccgaagaagatcgcttaaccgtagcaagagcacgaaaaattgagcgtttcttatcacaaccttttttcgtagcagaagtttttaccggttcgccggggaaatatgttagtctagcagaaacaattagagggtttaaattgattctttctggagaattagatggtcttcctgaacaagccttttatttgggtagtgacattgatccacaagaagcacagcaaactcttgaaatagcagaagctaatttgaataaggcggaaggcaagagacaaacaattgaggcaaatctagctcttagacgagctaggacacgagtagaggctatcaatgtgatttcataa

SEQ ID NO: 40298 - DNA, 429 bp, Glycine max
  Peptide Sequence Number=SeqID_131983
aaaacaccgagactttttcaagtctcacaaggtatccagaactacgtaggtctgagttcctcattggaggatacgtaggagcaagagcctcgcttttgtcgaccacaccgccttttgttgccatgactcaagagctggagcccgcggagataccttacgagaccaatgtggtcatctgcgccctttccggagggcatgtcagcagagatactacgtttccgcatggagaccttttcaagtctccagagtgggggatccagaactacgtaggcggcgggcccgatggcaagcagagaccaagtttaggtcattcgtgcacccttgtatcatccagaggcggcgggcccgatgatacgcggagataccttacggttatccgcacccttttgtcatccagaggcggcgggcccgatgacaagcagagaccaa

SEQ ID NO: 40299 - DNA, 386 bp, Glycine max
  Peptide Sequence Number=SeqID_131984
gtgctggaaatgttctgatgcaccattggacaacatctctttccactccattggcaatgttgaaaagtggaaatatgtgtatcaacgcagacttgcggttgaaagagaactgggaagagatgccttggattgcaaggagaccatggacctcatcaaggctgctggactactgaagacagtcaccaagttgggagactgttatgaaggcctaatattgactgtttctgagcatcaaattgccaaggaaatcactgccaaacaagtccagcattggccaaagaaagggaagctttcagcagggaagctaagtgtgaagtatgcaattctgcacaggattggagctgcaaactgggttcccaccaatcatacttccactgttgccacag

SEQ ID NO: 40300 - DNA, 357 bp, Glycine max
  Peptide Sequence Number=SeqID_131985
gccgcgggcgtgccgccacctcatcaggctggcccagccggattgtttgatacagagcagtatttgcggcatttggttcgccaacaggcggccaaccatcgggcacatgtacagactcatggttgtctgtatcagatgagtctcagcctgcagagtcagggctttacttcttttccgtgccctactccggaccagttcagggcagaggtcgcgtggcctggggattggcctgaggcccaggcaggagaggcaccagcgggggcaccagcagaggctcccgatgaggcagaggaggcccgtgaggacgaagacatgaccgatttacttgatttcttaggagggagcggagccacatga

SEQ ID NO: 40301 - DNA, 413 bp, Glycine max
  Peptide Sequence Number=SeqID_131986
atggccccaaggaagcttgcctcaaagaggtccaagaaggataaagcggccgaaggaaccagttccgctcccaagtatgacagccaccgctttaggagcgcggaacaccagcagtgcttcgaggccatcaaggggtggtcatttctccgggagcgacgcgtccagctcaaggacgatgagtatgccgatttccaggaggagatagttcgccggcagtgggcatcactggttacccccatggccaagttcgacccagacatagtcctcgaattttttgccaatgcttggcctacggaggagggcgtgggagatatgagatcctgggtgaggggtcagtggatcccattcgatgcggatgctatcaaccagttcctaggatatcctttagtgctagaagagggccaggagtgcga

SEQ ID NO: 40302 - DNA, 130 bp, Glycine max
  Peptide Sequence Number=SeqID_131987
cagaatttcccaacaaaggattttagccctctattacaagggagtacctttcacaaataggaaaagggtttcagagaaaataccagattacaaagctatggggatgtctcctccacctctaggaacctag

SEQ ID NO: 40303 - DNA, 300 bp, Glycine max
  Peptide Sequence Number=SeqID_131988
atgactacaccacccagctctcctcctcctcctcctaccactgatgcaacatcgcattccctttttaccttgaagcggacaagaaaatcgacacacctaagatcattgacgactagaccaattggggcagagagacccctggtccatgtggatcctgtaacagggaaagccgacggtacccacaaaaagaagtttagaacatatttgggtatcatcgctcgcgataaggtagatgtgacatacgagaattggaaacaagtccctgctgcccagaaggatttgatatgggaggatattcag

SEQ ID NO: 40304 - DNA, 866 bp, Glycine max
  Peptide Sequence Number=SeqID_131989
atggtgaaagttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgagtgcattgttttgggttgtccagacccgtgcccatcgtaaacccagattcagtaagaacatcacctacgaacttggagcaccagtgatcactaatcaagtcgatgtatactgtgagtatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40305 - DNA, 175 bp, Glycine max
  Peptide Sequence Number=SeqID_131990
gtgttttgatgaaaacaaagatgatgaccaaaagcccaagagaatgacttcaagattgagtcaagaacaattcaagaatcaagtttcaagtttcaagaatcaagaatcaagaatcaagaataatcaagatcaggattcaagaatcaagaaaagactcaatcaagataagtgctaa

SEQ ID NO: 40306 - DNA, 436 bp, Glycine max
  Peptide Sequence Number=SeqID_131991
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtttctgtgggaaccttacacagcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 40307 - DNA, 755 bp, Glycine max
  Peptide Sequence Number=SeqID_131992
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcaatagttgtcattgtagtgagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40308 - DNA, 98 bp, Glycine max
  Peptide Sequence Number=SeqID_131993
agcagtcggaggaaaaactggaggaatctcagggaaccgctagagatgccgctatcgatgttggaatacatatgagcccgcttagaggtatgggatga

SEQ ID NO: 40309 - DNA, 237 bp, Glycine max
  Peptide Sequence Number=SeqID_131994
atgactgaagcacgtcaaaagggggtacagaaacaaaataggggaggagcttgccaaccagctcgcccaggcgagcaaggttgcttcctccagaagcaaccgccttctggaggaagaaactggaaggcccaactttcgaagaagttacggaaactcacgcattacgcaaaaacacctcttttcgatttgtgccacattccggaatttcacggatcgcgtaagcctgcttccctttga

SEQ ID NO: 40310 - DNA, 345 bp, Glycine max
  Peptide Sequence Number=SeqID_131995
atggccattgttcaacacctggtgattgacaacaaaaagaggaggcccattatctgcagaaccaagccagacctcaacaaaactttcaaggaagctgccaagtctatagaggtggctcaggtatccatcgcaaacaagaagaacactgatgcttctattaaaaatctagaagttcaagttggacaactggcaaaagaactatctaaacatggaagtggatctttctccgcaaccacacaggataatattggaaaaaagaataaagaaggatctgaagaagaaaacaacaaaaatgatgaagtggtgactagtgaaaaagtggaagaaaaagatccaccaatttag

SEQ ID NO: 40311 - DNA, 723 bp, Glycine max
  Peptide Sequence Number=SeqID_131996
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgagagagagagagagagagagaaaacgagcgagggagagagcgagagggcaagagcgagagagagagaaaacgagcgagggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40312 - DNA, 360 bp, Glycine max
  Peptide Sequence Number=SeqID_131997
atggtagccctaacccttgtcaaggttcctcaacctccattttttcaaagatacaactcgaacacaacatgtgcttaccatggaggagtttcggggaattccattgagcattgcatgaccctgaaacataaggtgcaaaatctgattgatgcagtgacttgcgctcctgagttgatctccaagtctgttcaattagatagtgctcattctatacgtttggtaatgacaaaagacaacaatggatacctcagagccctacactggggcaacgaaaggcactgtcgcaacctacccttcggcgggagggcgacgcggggcttacgggatgcatcttccatgggaggaaaatgtgcggagtag

SEQ ID NO: 40313 - DNA, 540 bp, Glycine max
  Peptide Sequence Number=SeqID_131998
atgacattgctacttagcaacattctgcccaacgaccgcaatgccaatctccccctacaaaagtatcagttggtctgtgtcgtctcgacatggggattgcacccacaaagacacccagtggacctgaagaagtccaacagggccctggggtttccagctctggttacgggcctctatcgaccctatagggcgcccgtccccccagcaagctcatgccatcatgacatagggatcgcgcccgcaagacacctagtggacccgaaagaaggccaacagggtcttggagttgccagctctaaatacgggtctctatcagttcaagggagtgcctgttgcccccagcagggtcatcaggccccctaccaatcgagctttcatctagaagtgttgcgcccccaggaaggcgcagggcgagacactacagcagcattgggatggacggtagcgggcaatagacgcaccgccatcaccactaaagttcacctcagctcatccataaaaaggttagagcgttgcctacgacacatggccgacccatag

SEQ ID NO: 40314 - DNA, 966 bp, Glycine max
  Peptide Sequence Number=SeqID_131999
atgacgtctccacgagcatatcaacagcccgggcttgggccaccatcgcaatccgcgtcggtcaatgtcccgagtcgatcggcggaccggctctcaccgttccacatccgaccgggacacatcgccggcccccatccccttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaaggggtcgtcgatgggtcccagaactgaccggctcgcacgtgattgggtctcgagcgtggctcatccaccattttatcacggcgaaagtcggccatgaacccagatttcaaccaaccacgaggcgggtgctcgcgggaggtcagcatacaccccgcgcagcaacattgttacatgtttgcgttggggaaacgatgtgtgacacccaggcaggcgtgcccgtcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcgtgacgactcccgcgggacaccgtctccgggcccccgggagtcgcacttaa

SEQ ID NO: 40315 - DNA, 351 bp, Glycine max
  Peptide Sequence Number=SeqID_132000
atgcaagaagaaaatgaagaagatgaatcaaaagatgaagaagacttctcactctttgtgaagaagtttcaaaaatttatcaagaagagaagaatcgagaggcgtaagaacttcaacaatggaagaagatcacaagaagactctcaagttcttagatgtaacaaatgcaaccaacttggtcacatcaaagctaattgtccttcaaatgaagaatggcctaagaaaagtgataagaaaaggcaagcaaggcgaggctcacgggtgcgtcttccaaaggaggaaaatgcacggagtcaccaccaacgtttatttgtggaaaacgtcagaaaaaccaaaggaaactggtcatga

SEQ ID NO: 40316 - DNA, 171 bp, Glycine max
  Peptide Sequence Number=SeqID_132001
atgcccttttgcgggcgagcgaaggcgaggctcacgggtgcgctttccaaaggaggaaagatgcgcggagtcgccaccaacgtttatttgtggaaaacgtcggaaaaaccgaaggaaaccggtgatcattttaaggcgttggaccttaaaaatgatccatttactcgataa

SEQ ID NO: 40317 - DNA, 345 bp, Glycine max
  Peptide Sequence Number=SeqID_132002
atggcctctggtaatcgattaccaatggggtgtaatcgattacacagggtgagtagggcactagtaaccgattaccagttaggtgtaatcgattacacagtgctacctgccactgtggagccagttcaagtgatagaggtgtcatcctctgaagaggatcctgaagaggacccagaggagttacctcctgaacctgttgtggatgcccttgacttacttgaggatgatgaagacccactccttgatgttgattttccagaggatatcaggtctgcatctgaggcagactccatagaggagagcggccctggagggacagcgaatagtgatgactcttcattgtag

SEQ ID NO: 40318 - DNA, 426 bp, Glycine max
  Peptide Sequence Number=SeqID_132003
gagcataaacgacaccttcagaaggcttcactgcaatcccttgactcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcgggcgggtgtgggggttacgcgcagcggggaccgctacacttgccagcgctgatgtccggcggtgcttttgccgttacgcaccaccccgtcagtagctga

SEQ ID NO: 40319 - DNA, 810 bp, Glycine max
  Peptide Sequence Number=SeqID_132004
gatcccacatattggagatccagtttggaaatgcaagcactgtaatgctataatgtggtatgatgagaggattaacaaagataagcaccccaaaaacccaaggtttgcattatgttgtggcgatggcaaaatacaacttcctctactagaagatcctccacaaccattgagacaactactttttgacaacaagagtacacaagctaagaacttccagctcaacattcattcatataatctaatgttcgcatacacatcacctggtgccaaagttgacacaagctataatactggtagaggtcctcctaaattttgcaaccatggtcaagggcatcatcttattggaagcctcctacctatggctaataactcacccaaatttgcacatctatatatttatgatactgggagcgaagatattcttgatgaagacattatcattgaaaccaagaatatgctagataaacacaatcagtatgcactaaagttcagaatggcaagggacaaactacaatcttcagctgtttgtgacctaaaactaaaactcataagtgataggcaattagatggaagattatataacttgccaaatactgctgaagttgctgctttgattattggtgacgagcatacagttgatggctacactatgattgagtctgaaaaactcaactatgttagagaacatcaacaggaactcagagtttacaagtacatgaatttgaatgcctacaataatgatcccgaaacacatggcaatgagaaagaaaagagaatcatattgtcgagctcatttgttggtagtcatag

SEQ ID NO: 40320 - DNA, 533 bp, Glycine max
  Peptide Sequence Number=SeqID_132005
atgactagaggcaatccatatgacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattctgattctgagcattctgattttgcacattctgagaacatggcacaacctccacctcgtgagaggactctaagggaaatggctgcacctgatttcacctatgaaagcttgtgcatccaataccctgatgaggatgtcccatatgttcttaagattggactgattcatttgcttccaaagtttcatggccttgcaggtgaagacccgcacaaacatttgaaagaatttcacattgtctgctccaccatgaaacccccagatgtccaagaggatcacatatttctgaaggcttttcctcattcattagagggagtggcaaaggactggctgtattaccttgctccaag

SEQ ID NO: 40321 - DNA, 261 bp, Glycine max
  Peptide Sequence Number=SeqID_132006
atgatgacaaaagtgatgaacaaaaagctcaagagaatcaaagaacatccatctcaagaaaatctagaacaagtcaaagagttcaagaatcaagaagaattcaagactcgagaagaaagcctacaaacaagaatcaagattcaagttctcaagaatcaagatcaagattcaagactcaagagattcaagatctcaagaataatcaagatcaagattcaggactctagattcaagaatgaagaaaaaactcaatcaagataa

SEQ ID NO: 40322 - DNA, 231 bp, Glycine max
  Peptide Sequence Number=SeqID_132007
atgactgcccccatgtactatctcaggggggggggggactcgttagaagagcagacgacacagggtagttttgttccctatggtcgggatgacatcttgaatacggccattgtcaaaccggaacatccaagtcgagttcgtgcagcgggatctggtatgacccttactcaattttatggtagggcaacacgtacctcaagtagttcctcagcaacactaatgcagcaatag

SEQ ID NO: 40323 - DNA, 766 bp, Glycine max
  Peptide Sequence Number=SeqID_132008
atgggggatcccatcagcagactctccttccctgaaaacaccgagactttgtcaagtctcacaagttatccagaactacgtaggtctgagttcctcattggaggatacgtaggagcaagagcctcgcttttgtcgaccacagcgccttttgttgccatgactcaagagctggtagcccgcggagataccttacggttatccgcacccttttgtcatccagaggcggcgggcccgatgacaagcagagaccaagtttggttattctgcacccttgtatcatccagaggcggcgggcccgatgatacgcggagataccttatggttattcgcacccttttgtcatccagaggcggcgggcccgatgacaagcagagaccaaagaccaagtttggtcattctgcacccttgtatcatccagaggcgacgggcccgatgatacgcggagataccttacggttattcgcacccttttgtcatccagaggcggcgggcccgatgacaagcagagaccaagtttggtcattctgcacccttgtatcatccagaggcggcgggcccgatgatacgcggagataccttacggttattcgcaccctttgtcatccagaggcggagggcccgatgacaagcagagaccaagtttggtcattctgcacccttgtatcatccagaggcggtgggcccgatgatacgcggagataccttacggttattcgcaccctattgtcatccagaggcggtgggcccgatgacaagcagagaacaa

SEQ ID NO: 40324 - DNA, 318 bp, Glycine max
  Peptide Sequence Number=SeqID_132009
atgtggtgttatgagtggaaaaagagtgaggctttgagggttggaaggacttatgagaaagcttggactgtgctagagagaaaaacaaatgatcaaagtgaaccaagagccatttctagggaaaaattgggtgttgaggagtcaaactttgattcgcttgggaggattgatggggacccggtgttgagagaaacgaggatatgggctacgtgggagtacgtgagctcagttggaggtgggcaacaggggatggtgggtttatgcgcgctttgtggatgtggaaaacttgttgtgcaccatcgcccgaccgccacctag

SEQ ID NO: 40325 - DNA, 483 bp, Glycine max
  Peptide Sequence Number=SeqID_132010
atgtgggcttttctcaccggttgtcagattgactgggctcatttggttcggtaccgaatgcttaaggcattacgggccaatgcacctctaccttacccacaattgataactttgtttctgcgtcattttcaaattccgtttgatgatgaaccatttgttcaagtcaagcgttcctttgcaattggtgctggtgcagtgacttcctttggttaccgtaaggatcggaatgttcaatggctgaagaaggacgcactccctcctcaagatgagcgtactccttcacctccttctcagcgagaagattcaacactcatgaatgaagtccttacggaattacgaggtcttcgttcttatgttggtgaacgtttcgactcattggatacacgttttgccgtcatggatattcgcctcacacagcttgaagaggatgtaggttacattcgtcagagtttcgatcttccaccaccacctccaccttcttag

SEQ ID NO: 40326 - DNA, 436 bp, Glycine max
  Peptide Sequence Number=SeqID_132011
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttagatgtgaacatcaagcttatcgataccgtcgacctcgagggggggcccggcggtttgcgtattggggcgctagcggagtgtatactggcttactatgttggcactgatgagggtgtcagtgaagtgcttcatgtggcaggagaaaaaaggctgcaccg

SEQ ID NO: 40327 - DNA, 599 bp, Glycine max
  Peptide Sequence Number=SeqID_132012
gactaagttctctgatcgcgtgttcggtaaacaccggcgatcggggacttttgtccgcgtttgtggagtggtggcaccgggaaacgtctagtttccatctcccggtgggagatctcaccatcacattggacgacatctcctctcttctccatcttctcgttattggcgacttatacgcatttcagcccttgcacgtggacgatgcggttcagatgctggtggacttgttggtggtctctccagagtctgctagggctgagacagtccagtgtcgcgaaccgtacgtacgcctgcaatgggtacatgatatatatcagcgccgatgccaggcaggtcattggacagctgcggcttgcgcatatcttcgtcacctactgggttgcactctgtttgctaacaagagtgcaaccaatgtccatgttgtctacttggaggcccttcgtgacctcagtatgacagagaggtacgcctggggagtggctcctttggttcatatgtacgaccagctgaacgatgtatctatgagccacagtcgacagctaggcggttacatcacactgttgcagctaacaaatatgtttttcattcattcaggctaa

SEQ ID NO: 40328 - DNA, 129 bp, Glycine max
  Peptide Sequence Number=SeqID_132013
atgtcggctgaaaaatatcagtttttcggggctttaccgttgaccgatgtcggaaatgttcgatcggcgtcatccggtgatgcttcttttttaacctcgatcgttgatcttacctcatccacgtcgtag

SEQ ID NO: 40329 - DNA, 234 bp, Glycine max
  Peptide Sequence Number=SeqID_132014
atgactcactataatccttaccctcggaagcaaaaaaggaaagaaggaaaatttccaatcaaagagaaagcaaaaagaaaagaaaggaaattcccaatcaaagagtgggagaaagcaaaaagaaaagaaaggaaattcccaatcaaagagtgggagaaagcaaaaagaaaagaaagaaaattcccaaccaaagaatgggagaaagtaaaaaaaggaaggaaagaaagttcttga

SEQ ID NO: 40330 - DNA, 483 bp, Glycine max
  Peptide Sequence Number=SeqID_132015
atgccacctaccaggcacccgctagacccggataagtctaacagggccttggggtttccgacattgatcacgagtttctgccagtcattcggggttcccgtcacacctagtaaggcgcagggtgatgcaccgcaggccgcagatgcaccgccactacctcatcaggctgatccagctgagtcatttggcatggagcggtatttacaacacttggttcgccaacaggcggccaaccacagggggcaggtgcagatccgtgagtgtctctaccagctcagcctcagtcagcagagccagggtttcgctccttttgcgtgccctactccagatcagttcagggcagaggtcgcatggcccagagattggcctgaggcccaggcaggggaggcgcttgcagaggctcccggtgatgcagaggaggcccgcatggatgaggagatgacatatttacatggtttcttaggagggagtggagccacatga

SEQ ID NO: 40331 - DNA, 210 bp, Glycine max
  Peptide Sequence Number=SeqID_132016
atggcacaacctccaccccgtgagaggactctaagggaaatggttgcacctgatttcacctacgaaagcttgtgcatccaataccctgatgaggatgtcccatatgttcttaaaactggactgattcatttgcttccaaagtgcttggcacccatcattaggcaatttgtgaaattctgggacatgccggaaaacaaaagaaaatattga

SEQ ID NO: 40332 - DNA, 615 bp, Glycine max
  Peptide Sequence Number=SeqID_132017
atgcggttgcagttgcccgctaccagcgttgttgctaaggtgaacccgatgcccccatctggcctcaaccaaatgaatcatccaacctcggctatggtaggcaaagatttgggaagtataggcgacccctattatgtgcaaattcaaaacaagtatgccttcccaccatatggcttgcctcccaactatacaccacccaatgtggcgtacactctcggtgaggatgtcaataactccgctcccatactcattgagagccgacaacctcatcatgcacatgtctctcaacccatgggggacacacatgaaatgccctaccacaatctagccgacttcgagccttgcctcggatatgccactgaagggcaagcagttggtggtatacccctgcaaaacactttggaaggccctcagtatcacccacaaccacacccctcacattccacaacggttaaaagccctcatgctatggcagaaatgggaaagttggatcatccagaggaaaggctcagggccattgaaggaggcgaagattatgcctttgttaacctagaagagttgttcctagtacccaatttcatcacccctcccaagtttaaaggtgccggactttga

SEQ ID NO: 40333 - DNA, 183 bp, Glycine max
  Peptide Sequence Number=SeqID_132018
atgcgcggagtcgccaccaacgtttatttgaggaaaacgtcggaaaaaccagaaaagacgtggtctacgaactttaagtgtgaaaggttcaggagttgtatttacgcacggggaagtcgacgagggtgtttcccttgctcctacgtattcctcaattgtgataaagaaatcagatctacgtag

SEQ ID NO: 40334 - DNA, 465 bp, Glycine max
  Peptide Sequence Number=SeqID_132019
gcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccattccgctcgctcgccgacgccgagcgtagcgtcagtgagcgaggaagcacacggaatcgaattcctgcgcaccgatcagccgtttcccgaacagttggaaatggcgaaggcagtgagcgcaacgcaattaaggtgtggtgagttagctcactcattaggcaccccaggctttacacttgccgcgctgatgtccggtcggtatgcttttgccgattacgcggataaccaattccccgtcagtagctga

SEQ ID NO: 40335 - DNA, 408 bp, Glycine max
  Peptide Sequence Number=SeqID_132020
atggctccgagaaagctttccgcaaaaagatctaggaaggacgccgcggctgaagggactagtgccgctcccgagttcgacagccatcgtttcaggagcgctgagcaccaacagcgtttcgaggccatcaagggatgccagttcctgggagacctgctagtgttagaggagggccaggagtgcgagtatagtcagagaaggaaccgggccgatggatttgacgaggaggccattgcccagctgttatgcataccgggtcaggattttgcccggaccgctaccgggagacgggtgcagatcatgggcaccaacatgactaccttgacccagacgtggatgacgttgctgctcagcaacatcctgcccaacgatcataactccaagctccctctgtcgaagtgtcagcag

SEQ ID NO: 40336 - DNA, 408 bp, Glycine max
  Peptide Sequence Number=SeqID_132021
atgtcaggatttacacgcgattctcctcaaatttcagccagcccatatcaattagaccttgcaccttacgcttcagagccctacaatgctcaatggaacgccccggggcttctccgtgacaagcacacgttgcgttcgagtcgtattctcggaaaaatggaggttgatgaaccttggttagggttatggctaccattgaattatcaagtagacatgggagcaaggatggcctttgtggataactgggcggtgggtaaggagaaggtttgttattggctgagtaatgacattgttgggttggtgggaaacttggctgtattggaatggcagtcacagcatgggcttctacttcatcctcaccctcttcatttgcctcagttttctcattcgtccaagcaggatgactaa

SEQ ID NO: 40337 - DNA, 189 bp, Glycine max
  Peptide Sequence Number=SeqID_132022
atgggtctccgaataagagttgagggtggaggagaagcgaacagcactagcaatcaattggcggcactccaacctcgatggataagcgaacagcactgggcaatcaattcgcagagctctatcctcgatggtggaggacacatgaacagtgctaggcaatcaattcatgggtctcggaataagagttga

SEQ ID NO: 40338 - DNA, 48 bp, Glycine max
  Peptide Sequence Number=SeqID_132023
ctctggtcgagtttagtccaacaagaggaatccaaggacgatgcttga

SEQ ID NO: 40339 - DNA, 239 bp, Glycine max
  Peptide Sequence Number=SeqID_132024
cacatccccctttcgccagctggcgtaatagcgaagaggcccgcaccgatagcccttcccaacagttgcgcagcctgaatggcgaatgggacgcgccctgtagcggcgcattaagcgcggcgggtgtggtggttacgcgttccagggtgaccgctacacttgccaggactgatgtccggcggcgcttttgccgttactcaccaccccgttacgtagctgaacagttgacggacagctga

SEQ ID NO: 40340 - DNA, 879 bp, Glycine max
  Peptide Sequence Number=SeqID_132025
atgtccggcgagttagcgacgctctaccgctcacttgaagcctcggttgcggaaaaaacgcggcatttgcatgacgcccaccagcagctcgacatgctgttcaagtgctctcaggcgctgaataccggccagatagacagccactgtttccggcatatcctgcagattgtccatgactatacgcagatgaactatctggaactgcgcaccagcgacgactggcggctgtgcgcagaagcattaccagcagctgctgctgatggaagagcgcgcaccattgcccgcgaactgcatgactcgctggcgcaggtgttgtcgtatctgcgcattcagcttacgctgctgaaacgcgccgtgccggaggagaacaccccggcgcagaccatcattaccgatttctcccgcgagctgaacaacgcctggcagcagttgcgcgagctgctcaccaccttccgcctgacgctgaatcacgcgaatttacccgcggcgttgcaggagtctcttgacgcgctgcagagccagacgcaggcgaagctgcacctcgactgtcgcctctcctcgctggcgctcgacgcgcaaaagcaggttcatctgttacagatcgtgcgtgaggcggtgttgaacgccattaagcacgcgcaggccagcgagatcaccgtgagctgcgtgacggctgtggacggtacgcaccgcgtcagcattcgtgacaacggcatcggaattggcgaagccagcgagccgccgggacactacggtctgaacattatgcgtgaacgcgcgcaacggcttgggggtgcactgcacttttcgcagccacaaaacgggggcacgctggtcagcgtcacgttccccgtgccgcaggcaccggcgggtaaataa

SEQ ID NO: 40341 - DNA, 630 bp, Glycine max
  Peptide Sequence Number=SeqID_132026
atggcctccaggaaatgtaagagcattggggcaaggccaactgctcaatatgatactagacgtttccattcgcttgacgcttggaaccgttatacagataatgtcttggggaggaatatttttccagaaaggaaggttgagatataccacacagagtttgacaacttcagacaaagtggagaggcctttgagggtccttcaccaaagaaagccaaagttagaggccacctggtgaagataaacgcagatagcctcaacacatttttagagacacttgtagtcctagagaagggggattcattacccacctactctaggtactgcaggttgcccacagactacagagagattgaggttgctcaggaaagatttgactacattagccatcctgggaggattctcaggagagatttgactacattagcccaggcatggagtattctctcatactccaacctggtctccacatctcacacctctgacctgatagtggacagagctaggctcatctttggcttagtctcttgcatggacataaacataggagcactcatttctggccagatgacttctatagcccagtctaactcttctagacttggatttcctgctctgatcaccgtcctatga

SEQ ID NO: 40342 - DNA, 159 bp, Glycine max
  Peptide Sequence Number=SeqID_132027
atggcctccctatggtgtggcgtctcctctctctcttccttctccattctgctgccattcatcttccaagaagcaaaggaatccattgatgaagaagatcctaggcctaaagctccaatggagcttacatcatgtggtatcaagagcatcttcatctag

SEQ ID NO: 40343 - DNA, 459 bp, Glycine max
  Peptide Sequence Number=SeqID_132028
atgaaaaccacgtttctcgcagtagatgctttccttgatgaggtaattgcagaacacgagagcagtaacaagaagaatgatgacttcttggggatacttcttcaacttcaagaatgtgggaggcttgactttcagctcgaccgagataacctcaaagcaatcctagtggtttccctctttatctatccaatcgaattcctgcagcccgggggatccactagttctagagcggccgccaccgcggtggagctccaattcgccctatactggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 40344 - DNA, 60 bp, Glycine max
  Peptide Sequence Number=SeqID_132029
tgggataaatggccgatactactggaaggattcctctttggataataggtactgtaactg

SEQ ID NO: 40345 - DNA, 546 bp, Glycine max
  Peptide Sequence Number=SeqID_132030
atggttagaacacgaggtttaggtcgtgtgttaggagctggtagaggtaaaggcattagtgaggatacgcatgaggctgatgttcctctgcgtcgcagacctactgtttcagcacgtaggcaacgggttcgtctgcgtgaggacgtgacagagagacctgaggatgtgcctcagttgcatgaggatgttcctcatgtgtctgatgccaccccagagatgacaagcgctgccgatgctgttcagacagagggaatggctactgatgggagcttggggtcacctgctgcagatgagggtttccccggtggaccacgcgacccatcgattttgaccgattttgctgagcatgaacgacccgatctgaagttggtctcccgcggtagaaaagtagataaaattgggagaccagcgcctgagatcgaagggttggttgctggcaccggattgagtccactgatcaggtgttctgttatcaccactgatcttggactcatatccgtcttcgtcgagagtggcatcgcgagactagcacgttccacctgctag

SEQ ID NO: 40346 - DNA, 309 bp, Glycine max
  Peptide Sequence Number=SeqID_132031
atggcagaagcagtaactcaatttatgtccagacaacaaaaatcctttgtagaggctgcagctcaagagaaaagccctctaaaagagcatgaggaacaagcacaacaacaatgggagaagtactcaacagtaaaaaaccaacaagaaaatattctccaaagcgataaccttcctcatcaactgattgacaagaaaggaaggcaagcagagcatgaggaaaccttaaattatatgaagttcatggaatttctagctaaaaggcgaaacttcaaggaagatgtgttctttgtgactttcatgccaccttga

SEQ ID NO: 40347 - DNA, 1215 bp, Glycine max
  Peptide Sequence Number=SeqID_132032
atgcgtttttatccgaaagcggatgaaaatggtcactttgtttataaatataagagccaagctgctcatattttaatgaaggttgaaactcataaccacccaacagcaatttctccatttgctggtgctgcaactggttcaggcggtgaaatccgtgatgaaggtgcaacaggccgtggtggtaaaccaaaagctggtttaacaggtttcacagtttcgaacttaaacattcctggttttgaacaaccttgggaagaaaactacggtaaaccttcacgtatggcatcgccattacaaatcatgattgaaggtccattgggtggcgcggcatttaacaatgaattcggccgtcctgcattaaatggttatttccgtactttcgaacagaatgtaaatggtgaagtgaaaggcttccacaagccaatcatgatcgctggtggttacggtaatattcgtccagaccatgtagaaaaagatgcgattcaaccaggtgatttactcattgtcttgggtggccctgcaatgttgatcggtcttggtggtggtgctgcatcttcagtagatagcggtacaatgggtgaaagccttgatttcgcatctgtacaacgtgaaaacccagaaatggaacgccgttgtcaagaagtgattgatacttgctggcgtttagaagacttcaacccaatcgtttctgtacacgacgttggtgctggtggtctatcaaatgctatgcctgaacttgtgaatgaccatgagttgggtgcggtacttaatcttcgtaagattccttcattagagccgggcatgagtccaatggagatctggtcaaatgaagcacaagaacgttatgttctcgcaattcgtccagaatctttggatcagtttgaagcaatctgtgcgcgtgaacgttgtccatttgctgtgttaggtgaagcaactgaagcacgtcacttaacagttgaagatccattgttccaaaacgatgctgttgatatcccaatgcaagtaatgcttggtggtacaccacgtatgcaacgttcttatgaaactattgaacgtagtggtgatgatttcgacgcttcaaaagttgatttgaaagatgcgattttccgcgtattgaaaaaccctacagttgcgtctaaatcattcttgattaccattggtgatcgttcaattacaggtatggttgcacgtgaccaaatggttggtcgttggcag

SEQ ID NO: 40348 - DNA, 515 bp, Glycine max
  Peptide Sequence Number=SeqID_132033
atgcaagtgggatcagcaacttccattatcagagtaatcaagcacagcggaaattcttcaagttgcaaatctacaagtcttctccaggatgtcaagacatctctcgtgacatcagctttctgcttctgcttttgctctttttctgctgttttccaggatgtcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40349 - DNA, 92 bp, Glycine max
  Peptide Sequence Number=SeqID_132034
atgagggtatttgtagggaaagggtacgccactgatggcatgttcaaattgaatcttgatattaataaagtttctccttctgcttacatgct

SEQ ID NO: 40350 - DNA, 528 bp, Glycine max
  Peptide Sequence Number=SeqID_132035
atgggtgaagcagagaagttgccgctattaagcgctgtcgctaaggtgaacccaatgctcccatctggcctcaagcaaatgaatcgtccaacctcaaatatggtaggcaaagatttgggaagtacggatgaccccatgatgtgcaaattcaaaacgagcacgccttcccatcatatggcttgcctcccaactatacaccacccaatgtggcatacactctcaatgaaaatctcaataactccactccgatactcattgagaaccaataacctcatcaggcacatatctctcaaaaccatgggaaagacacatgaaattccccaccacaatctagctgacttcgagccttggctcggatatgccactgaagggcaagcagttggtggtataccctttgaaaaccctttggagggccctcagtatcacccacaactgcacctattgcattccacagcggataaaaaccctcatgactatggcaggaatgggaaagttggatcatctaaaggaaaggctcagggccattga

SEQ ID NO: 40351 - DNA, 660 bp, Glycine max
  Peptide Sequence Number=SeqID_132036
atgtcttgtgaatggccccgaggaagcttgcctcaaagaggtccaggaaggacaaggcggccgaaggaactagttcccgctccggagtacgacagtccccgctttaggagcgctgtacaccagcagcgcttcgaggccatcaagggatggtcgtttctccgggagcgacgcgtccagctcagggacgacgagtatactgatttccaggaggaaatagggcgccgacggtgggcatcactggttactcccatggccaagtttgatccagaaatagtccttgagttttatgccaatgcttggccaacagaggagggcgtgcgtgacatgagatcctgggtaaggggtcagtggatcccgtttgatgccgacgctatcggccaactcctaggatatccgttggtgttggaagagggccaggaatgtatggcgcctactaggcaccctttggacccagataagtccaacagggccctgggatttcccgcactgatcacaggactctgccagtcgttcggagtccccgttgcacctaccaaggtgattcggccgcccatcacccaggcttttattgagaagtactgtacccagagacaggctcagggtgatgctccacaggcccgcaggcgcaccaccaccacctcatcaggctggccaggctag

SEQ ID NO: 40352 - DNA, 318 bp, Glycine max
  Peptide Sequence Number=SeqID_132037
atgttagccatcatcaacaagtaccaagaagaactaaatctagccacggcccacgagcataaagtggcggacgagtatgcccaattgtacgccgaaaaggaagctagaggaagggtgatcgactcgttacatcaagaggcaacaatgtggatggaccgatttgctcttaccttgaacgggagtcaagagcttcctcgattgcaagccaaggccaaagcaatggcggacacctactgcacccccgaggagatccatggacttctcagttattgtcagcatatgatagacttaatgacccatataattagaaaccgctag

SEQ ID NO: 40353 - DNA, 1023 bp, Glycine max
  Peptide Sequence Number=SeqID_132038
atgttcagcttagcgggcacttaccagctaagccaattatgcagaggctgtagttctgcaacttccgctaagcggcttcacctgtcgctaagcggaagtgtctattttgtgatgatggcttctaggaaacgtaaaagtatttgttcaagacccatagtgcagtatgacacaaggagattctcttccttagatgcttggacccgatacacaaataatgtcctggggaaaaacattttgccagagaggaaagtagagatatatcacactaagctagatgagttcaaggctgaattggagaggcgtaatttccataaacgtctcaccaatttagtcgatgggagcatagacctggctttggtgaaagagttttatgcaaatttatacagttctgaggaccattcaccaaagaagtctagagttagaggtcatttggtgaaaattgatgctgacagtctcaacacattcctggagacacttgcggtattagcaaagggggagaccttacccggccatcttgggaagattctcaggaaggatctgactacactagctcagatgtggagtgtcctctcatactccaactttgcccccacatcacacacttttgacttgacagtggatagagctaggctgatctttggcctagtctctcgcatggatatgaacataggagcactaatctctggccaaatgacctctatagcccagtctaacacttctagacttgggttccctgctctaatcatcgcattatgtagagccagaggggttgtctctgatagcctcacttttgagcacctgagcccagtcattaacttgacctacattaggatgaactgtttgaaccccaagaatctaacagtttctatccgaggggttaggagggcgagggctaggccagcagagctcccttccacttctacggctcctactccaacatccacgtcagcagctccttctgttccagcccagacagattcccagcgtttggaagccatgcttcagagtatccatcagggatag

SEQ ID NO: 40354 - DNA, 195 bp, Glycine max
  Peptide Sequence Number=SeqID_132039
atgaggcttcatagttatcgagcaagtcggagacccaacaagaccacagatcgacctccactccttatggctcacatagacccgagtatagggcctaatatctcaatgtgtgtgcaaaggatcgacaagggtgttgcccttgctcctatgtatcctcaggtgcgatgtgaaattcagacctacatagttctttag

SEQ ID NO: 40355 - DNA, 353 bp, Glycine max
  Peptide Sequence Number=SeqID_132040
ggaatggagcatctcaatcagctgctcacaaggcaaataatgtcaatttttcttcgggtttgtccgcacccaagttgataattgatggtggtgcaacaaatcacataacttcttctccatctttacttgtcgatagtaaagaaaacacttctttaccaccagttgttatgccaaatggagatcaagctccaattatttctactggaaatttacctttgtgtcctattatttgtttgaagaatgtacttggggtaccatcttgtaaggtggattcgatgtctgtgagtcaagtcataagagaattaaattgttcagtaaccttttccctcaattatgtattttgcgagatttga

SEQ ID NO: 40356 - DNA, 619 bp, Glycine max
  Peptide Sequence Number=SeqID_132041
tggattccctttgacgaagatgccctcagccagttcctgggtgacccgctagttttggaggaaagtcagcagtgtgagttcagcctgaggaggaacagggccgatgggtttgatgaggaagccattgcccagctgttgtgcacaccggggcagaatttcgcccggaccactgtagggaggcgggtgcggatcatgtgcaccagcatgaccactttgacccagacatggatgacattgctgctcagcaatgtcttacctagcgatcacaactccgatctccctcttcctaagtgccagttggtgtatgccatcctgacatggatgagcgtccacgtggcccaggtgattgctgatgccatttatttgtttgcaggtatggcgcctaccaggcaccctcttgacacagataagtccaatagggccctggggtttccggcgctgatcacgggcctttgccagtccttcggagttcccgtcacccccagtaaagtaatccgaccgccgatcactcgggccttcatcgagaagtactgcacgcctcggcaggcgcagggtgatgcacatcaggctgcagacgcaccgccaccaccccggcaggccgatcccgctgggtcactag

SEQ ID NO: 40357 - DNA, 363 bp, Glycine max
  Peptide Sequence Number=SeqID_132042
atgaaagggattgggtttggctccatcttaggaaggatagatttcctactaagaaagtccaaactttgctccaaaggtgatggcccttttcaggtcttggagaggatcgacaacaatgcttgtgtagctaattcagatgatgaggggtctgcagatttgaggacaagtcctcttcaagagggacacgataatgcaatcctcccaaggaggggacccataaccaaagccatggctaggagactcaaggaagattgggtcagggatccaggagaaggccctatggttctcatgagccttagggtagattttgggcccatggtgatgcaatcctccttaggaagggaccagtcactagagccatga

SEQ ID NO: 40358 - DNA, 114 bp, Glycine max
  Peptide Sequence Number=SeqID_132043
atgacgactctacgcatctttcctcctttggaaagtgcacccgtgagcctcgccttcgctcgcccgcaaaaaggcacgttgcgacagttggcgactccactggggactattttt

SEQ ID NO: 40359 - DNA, 288 bp, Glycine max
  Peptide Sequence Number=SeqID_132044
atgtcctcaccttcagagggctacacgccctcaccttgggtactagttaccctcgccatcagaggactgcgtgtcctcaccttcagagggctacacaccctcgccatcagaggactgcatgtcctcaccttcgtagggctacacgccctcaccttcagagggctacacgccctcgccattagaggactgcatgtcctcaccttcagagggctacacgccctcgccatcagaggactgcatgtcctcaccttcgtagggctacacgccctcacctttggaggactacac

SEQ ID NO: 40360 - DNA, 376 bp, Glycine max
  Peptide Sequence Number=SeqID_132045
ttggacctcttacgtgccgatcaacgtctcattttcgccaaaagttggcccagggcttcccggtatcaacagggacaccaggatttatttattctgcgaagtgatcttccgtcacaggtattattcggcgcaaagtgcgtcggctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 40361 - DNA, 416 bp, Glycine max
  Peptide Sequence Number=SeqID_132046
ggcagagcttgaaagagcccgggtagtcgaagagaagttcaagtccatagccatcaaaggcagcatagtgagctcaagctccgaagaggtgaaaggaatcatcacgggtcaaaggcatgatcttgaaggacgagctaaagggaatatgtgggccatcatcgataagtgcaaagagaagctaaatctagcggcgactcacgagcaaaggctagaggatgagtacgccaagatatcagcagaaagggaagcaagggaaagggtaattgattcattgcaccaagaggcaacaatgtggacggaccgatttgctcttactttgaacaggagtcaagaacttcccccattgctagccaaggccaaagcagtggcggacacctactccgcccccgaggagatccacggacttctcagctatt

SEQ ID NO: 40362 - DNA, 651 bp, Glycine max
  Peptide Sequence Number=SeqID_132047
gtcgactctagaggatcccacctcataagggtggaccctcgaggactacacgtcctcaccttcagagggctacacgtcctcgccttcagaggactacacgtcctcccctacagaggactacatgtcctcaccttcagaggactacacgtcctcgccttgagacggctacacaccctcgccttcagaggactacaagtccatgaatttagaggactacacgtcctcgccattagaggacaacacgaactcgccatcagaggcctgcacgccccaaccttcagaggactacacgtcctcgccttcagagggctacatgccctcaccttcaaaggactacacatcctcgccatcagagggctacacgccctcgctattagaggactacataggactacacatcctcgccttcagagggctgcacgccctcgccttcagaggactacacgttctcgccatcagaggactgcatgccctcgccttcagagagctacacgtcctaatctccagagggctacaagccctcgccttccgaggactacacgtcctcgccttcaaagggctacacgtactcacctttacagggctacacgcccttgccttcaaagggctacacgccctagccttcagaggactacatatcctcgcctttag

SEQ ID NO: 40363 - DNA, 380 bp, Glycine max
  Peptide Sequence Number=SeqID_132048
atgggtaagacacatgaaatgccccaccacaatctagctgacttcgagccttgcctcggatatgccactgaagggcaggcaattggtggtatacccctacaaaaccctttggagggtcctcagtatcacccacaactacacctcttgcattccacgacaagtaaaaaccctcatgctatgtcagaaatgggaaagttggatcatctagaggaaaggctcatggccattgaaggaggtgaagattatgcttttgctaacctagaagagttgttcctagtacccaatatcatcacccctccaagttcaagggcatacgcaaaagatgagaaattgttgatacactccttccaagaaagtcttaccggggtagctgttacctg

SEQ ID NO: 40364 - DNA, 249 bp, Glycine max
  Peptide Sequence Number=SeqID_132049
atgcagactcgccagctgttctgcactcttatagggataagctcatccttttcattattgatcactgtgaggcctgtcttcttaggaaccacttggattggactcacccactggctgtcagaaatgggggtagatgggctaataccaggaatgtctgctaaagtccatccaatggcttcttgtgcttcttgggaactagcaacaacttctcctcttgctcagcatcaagggaggcaggatgatcactga

SEQ ID NO: 40365 - DNA, 477 bp, Glycine max
  Peptide Sequence Number=SeqID_132050
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccgcagaaatttgaatgatgcgtcgccggcacaaaggccgtgcgatccgacgagttatggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 40366 - DNA, 372 bp, Glycine max
  Peptide Sequence Number=SeqID_132051
atggggctgaccaactataaaggtgaagaggtgcataagggtgatgtgacggtggcaaaaaattatctcactcaggatgaagtcaatgagcttaaccgcgtagttaacatgtggctggattttgccgaggatcaggcccgtcgtcgtcagcaggtctttttacgcgactggcaggataagctggatcagttcctgcaatttaacgaccgtgaggttttgcaaggcgcaggtaaagtcagtaagaaaatggccgatgaaaaagcgcaggcggaatatagtcagtttgctgagcaacagcggcgcttaaaggaagccgaaggtgaaaaggatatcgccggtttgctacagtggaaaatagagcctaaaaagtag

SEQ ID NO: 40367 - DNA, 71 bp, Glycine max
  Peptide Sequence Number=SeqID_132052
atgaggagtaggtgtccaccattgctttggccttggcttgcaatcggggaagttcttgactcccgttcaag

SEQ ID NO: 40368 - DNA, 453 bp, Glycine max
  Peptide Sequence Number=SeqID_132053
atgggaataaatcaaactggaaaaaggttttatcaagtcaagattaagggcctagatatcaccagcattaaggggctggggtggttgatgggacctctccaaatgcaagccttccgcaaggcatacggaaagattttagatttgaccatagtagagatatccatggaagccattgtatcactcacccaatactatgacccgcctttgagatgcttcacgtttggagacttccaattagtaccgattgttgaagaatttgaggagattctaggatgtcctcttgggggaaggaaaccgtatcttttctccgggtttcttccctccttgagcaagattgtagttgtggtcagggattcggcgagaggattggattgtgtaaagcaaactcgaaatggcgtagtgggcctaccacggaagtacttagatggcaaggcaagggatatggcgaattaa

SEQ ID NO: 40369 - DNA, 62 bp, Glycine max
  Peptide Sequence Number=SeqID_132054
atggcagcaaaatggagaaggaaaagagatgattggagatgccacttcaaggagaagatcag

SEQ ID NO: 40370 - DNA, 234 bp, Glycine max
  Peptide Sequence Number=SeqID_132055
atgggtaggcggaaatacccaagtggttatccgtataaacattcttttgctatctgtttttactctcgtcgtccggaaatagtcaaccccaacgaaacgcgagatttttctctgctggacagggacgatcgagtgcaatggcgaagggatgtgtcgtggttgtccaactttgtcatttttaagacactgaagtttgttgacgcttctgcagcactttcttttctttctgaatga

SEQ ID NO: 40371 - DNA, 801 bp, Glycine max
  Peptide Sequence Number=SeqID_132056
atgcagacccctggttcaccaattgctggtgggaaatctggaggtagagagccaagtaagcggatcatacttatttgtaatggatcaacacaaggaaatacagaggatgtttttccttttggcggtgatcaaccattgaacatgctcggtgtcatacagtcccagaaatctgcagagctacttcttgatttgaaagtgaattccataattagcagtcttaacaaagcttgtatcgggacagccacgatcatctcccaggtacaagaagctgcagattgcttgggtgctgactgtgtgcctcgatatgttgagatgaagcagatggggagctttgatgttgaaactatcttcaaacaaactgaaacggcaaaagaaaattatgaccatctaatataccaagaagtacaactagcaaaaggtttttccaaggctatatccaattttccaccatttcaacctgggtggttaaatagagttgatgatggattgagaacaaaattatgggatcaatctcgaaaagcgtggcaatcgctgttggatgaaatatctgatgaatctaacccagaagttgtagtggcagttggtcatcctgcaatccacatagctttaatggggcactgccttaatttgacgaaagaatggttgggatcatttcatctcgacgctgggagcgttagccttgttgacttccctgatggacctaagggaaaaggtgtcatcaggtgcttaaattatactgcacatttggggagatggtccatacctattacaagatcagcagaggatggtgaagagttctaa

SEQ ID NO: 40372 - DNA, 240 bp, Glycine max
  Peptide Sequence Number=SeqID_132057
atggcttcctcatgccgcggctattccaaagcccaaatgtgcttcttcaagattctccgcataatttcatctaccccaccctccaaacaagaagaagaagaaccctttcccagcaaaggcgttggcatcgatttgaatctcagattctgttccgtcacagagaccccggaatccgaatcttcaagaagcgacgaaaacaacaacgaagaagaagaagggtttccggagaagagcgtggaa

SEQ ID NO: 40373 - DNA, 699 bp, Glycine max
  Peptide Sequence Number=SeqID_132058
atgcctaattcgaagaacaaccgtaacggacacggcgagcctcaccgccgcgagaaattgacaaagaaatcgtcgtccttctacggtcactcatcgccgccttccatgtccggcgaaccgatccggcggccgaagacggtgccggatcttttgtcggagaggcaccgcgcggctttagcgacgccggcgacggatgttgtgccaaaacagccgccaaagttgttgttgaaggttactcccatgggaagcttgggaccggtgcaggttgtgatgacgccggaatcgacggtcggagatttagtggcggtgacggtgaggcaatacgtgaaggaaggtcgccggccaattttaccgtcgaacgacccttcgcacttcgacctccattattctcagttcagcctacaaagtttggatagggaggagaagctgatggatattggatcgagaaacttttttctgtgtccgaggaagtgtggtggtaatggggacgagggtagtggaacgacgccgtttggttcgtgttcaagagaggctgacaaaacgaacaagggtggcgcgtttggccctgtgcctggggatgtcaaggactgcacctcctctgtggaggtgtctctcttttgttacattgtcaagaagaaactacaaggaatagaggcttcctttacaccttcttataagcttaggcaacaacttacttga

SEQ ID NO: 40374 - DNA, 858 bp, Glycine max
  Peptide Sequence Number=SeqID_132059
atgaagctttacgagtttgtaatcatatttggatgcttcatgctgattttggctcaaatcccatctttccactcattgaggcacattaatctagtttccttggttctctgcttagcctatagtgccggtgctactattggttccatatacattggtaaattaaattctcaatctccttttcaattcttttggagagtcatcaaaaggaccagaaaaggatattctttgaaaggtgattcaatgaatcgcttatttggaatcttcaatgtaatagctatcattgccacaacttatggaaatggaatcattccagcaattcagtcacttttctttagcgtatctgtatccggttattgggcatttggtaatgaatctgaaggcctcatcttaagcaacttcgtggacaatgggaagcctctggtgcccaagtggtttatttacatgaccaacattttgattataacacaattatctgcggttggtgtggtttatttgcaaccaacaaatgaagtgctggagcaaacatttggagaccccaaaagccctgagttctctaaacccaatgtaatccctagagtgatttctcggtcattagctactactatttcaaccactatagcagccatgcttccattttttggagacataaactctcttataggagcatttggctttatcccacttgacttcatcttgcctatggttttctacaatttgacatttaagccatctaagagaagccctattttctggttgaatgtgacaatcgttgtggctttctccgcattgggagctatagcagcagttaggcagatagttcttgatgctaaaaattaccaattatttgctaatatatga

SEQ ID NO: 40375 - DNA, 249 bp, Glycine max
  Peptide Sequence Number=SeqID_132060
atgggctctcatctcttgcagagtgggcatgttgtaaatatagacctttgtttcattttgaaagcttttgaactgccagcatttgaatctggttcaagtctttttggtagtgtttgttttaagtgctactctgtgattacaaagggtaggaaagggtggcagatgcttcatgctttgagagtaacagaggttgaactcaatttcttctatgatgctttctataccaaggcattagtcaaaaacacttga

SEQ ID NO: 40376 - DNA, 249 bp, Glycine max
  Peptide Sequence Number=SeqID_132061
atgaggaagagaaaccctaaccttctcggttttgaagcgctttcggatgttgccaagttccttgtcgacgcggagcctcacctgttccttgttctgacaattgcggatgtcgctgacgaagacggagagacctctcattccggacaacgccatcgccggtcagagcctccgccgcgagggagcggagcgccgccctatctctcttctcaggccgcagaaggatccggcaacgcaattcgagttcgatga

SEQ ID NO: 40377 - DNA, 294 bp, Glycine max
  Peptide Sequence Number=SeqID_132062
atggctaacaacgatgaaggagaggagaatgatgatgatatggtggatgactcatcgagttactcaggcttgggggatcgtgagcctgggattgatttggaggcattatcgcctttgtcatcaccactagaattgttgccattgtttggaacccattggtgtagagtgattcaaggtagtaacattggtgggtggagaggagagaaacgagacagtgaaggagttaggaataagaaaaagcatttcccaaatggttatggaatcggcggagagacgaaaaagaaaaggagatga

SEQ ID NO: 40378 - DNA, 903 bp, Glycine max
  Peptide Sequence Number=SeqID_132063
atgttcgtgcgatcattaacggcaaagctgaaacagaaaacgagcaagacatcgaacctcaaccatgttcccttcttgatcgatattctcaaccactctttcacgaactcttcactctctcacgttcacttcccttcagacatttcccaaacgaactccctcatcgcctcttacgttcgccgaggcgaccctgtctccgcattgaccctctttcattctctccgtcgtcgcgcgcattccgatgtcgtcgccgacgcctacaccttcacctccatcttgcgcgcttcttctctcttgcgtgtctccggacaattcgggacgcaagtccacgcccagatgctcaaaaccggcgctgattccggaaccgtggcgaaaaccgcgctgcttgacatgtactcgaaatgtgggtctttggatgaagcaacaaaggtgtttgatgaaatgcgtcacagagatgttgttgcttggaatgccctgctttcgtgttttttgaggtgtgatcgtcccgttgaggcttttggggttctgagagagatggggagggagaatgtggagcttagtgagttcactttgtgttccgcgttgaagtcttgcgcttcgttgaaggcgttggagcttgggaggcaggttcatggtttggtggtgtgtatggggcgtgacttggttgttttgagcactgctcttgttgatttttacaccagtgttgggtgtgttgatgatgctttgaaagtgttttacagtttgaagggttgttggaaggatgatatgatgagtaggaggtatgatgaggcttttagagttatgggttttgtgaggcccaatgctattgcactcactagtgctctggtgggttgctctgagaatttggatttgtgggcagggaagcagattcactgtgttgcg

SEQ ID NO: 40379 - DNA, 423 bp, Glycine max
  Peptide Sequence Number=SeqID_132064
atggatcagcctttcctcagtctcatacttgtgttccctacacacgctccgcctcacttcaccgcaaaagggctagggttcgcaattgcgagtcatcatcgctatcgtggagggtctcgcttgggacgtgctgacggcgatcacgtgagttgtgtgcctccgaggttgatgttctcgtgttttggggagatggcttttactgtggaggttaaccatgggggttattttactcctgaaccctttttgaagtattttggaggagacataactctgttatcagagatagacattgacaaatggagcttttttgaatttgttgggattctgaagcaggatgttaagattaagggagattttaagttatgctgggagggggctaatgctggatttaaagagttggtgttggatagccatgttgctgag

SEQ ID NO: 40380 - DNA, 1470 bp, Glycine max
  Peptide Sequence Number=SeqID_132065
atggaagcggtggccgccgcttttctcttcgccgccgtggttctgtcggcggttgtcgggtctccggtgaccctgacgctggaaagagcgttcccttcgaatgatggggtggaattgagtgagctcagagcgagggacagcctcagacatcgtagaatgttgcagtctacgaactacgtcgtagatttccctgtcaaaggcaccttcgatccctcacaagtcgggctttactatacaaaggtgaaattgggtactccaccaagggaattgtatgtgcagattgacactggcagtgatgttctctgggttagttgtgggtcctgcaacggttgtcctcagacaagtgggctccaaattcagctcaattactttgaccctgggagttcgtcaacatcttcattgatctcttgtttggaccgaaggtgcaggagtggagtacagacctcggatgcaagctgttccggtcggaacaaccagtgcacttacacatttcagtatggagatggtagtgggacatcaggctattatgtctcagacttgatgcattttgctagtatttttgagggaaccttgacaacaaattcttcagcatctgtagtttttggttgtagcatcctgcagactggggacttaacaaagtctgagagagcagttgatgggatatttggatttggacaacaaggcatgtctgtcatttcgcaactctcgtcgcaaggaatagcaccaagagtgttctcccattgcctgaaaggagataatagtggtggtggtgtattggttcttggtgaaattgtggagccaaacatagtttatagtccacttgttccatcacagcctcattacaatttaaatctgcagagcatctctgttaatggccaaattgtgcggattgccccttcagtttttgctacatcaaacaacagaggtaccattgttgattccggaacaactttggcataccttgccgaagaggcttacaatccttttgtcattgcgattgcagctgttattccacaatctgtacgcagtgttctttccaggggaaatcagtgttacttaataaccacctccagcaatgttgacatttttccgcaagtaagtctgaacttcgctggtggtgcatctctggttttacgaccacaggattaccttatgcagcagaattttatcggtgaggggtcagtgtggtgtattggctttcagaaaatttcgggtcaaagtataactattctaggagacctcgtattaaaagacaaaatttttgtctatgatcttgctggtcaacgcattggatgggctaactatgattgttcattgccggttaatgtatctgcatcagctggtaggggcagaagtgagtttgtggacgcaggagagctgagtggcagctcttctttacgtgatgggcctcacatgttgataaagacactcttccttgctctcttcatgcacataacactaattttgtag

SEQ ID NO: 40381 - DNA, 209 bp, Glycine max
  Peptide Sequence Number=SeqID_132066
atggacgaagatcaatggatatatgatagtataatgtctgaaaaaattggtatggatgatgaaaatgaacaagaatgtggtgtgaatgaacaacatgttgattgttcggatgcattcaatacttctcaggtgtttgctacccgagatgatattttgcagtgggctcgatcagttgctcatgaaaacagatttgtggaggtgattatgag

SEQ ID NO: 40382 - DNA, 963 bp, Glycine max
  Peptide Sequence Number=SeqID_132067
atgacgtcacatctctacgctccttttttctcctttgttctgtgttttttgtcacgatgtcgtcatcatcggctttcattgtcaccgttgaggtcatctcaccattatcgtgtcgttcccatcgatgagattatggttagaaccaaaggtttgggtcggattttagaccaagttataggaagagccctatggagagaagatgttcagcacgtggatcacacaactaacgaggtccaagaacaacctaaagaagtagttgttgatgatgaagttgttgatgttgagggttttccaggcgggttgcacgacacatcagttctgactgaacgtcctgaattgaagttatcatcccatggaaggaatgttcaaaaattcggcaagcctgttatagagattgaaggcttagttgctaccacaagattaagtcttctgattgcatgttccttgggtactagtgatcagggacttatatcgacttttgtagagaagtggcataaggaaacttgcagtttccatcttcttgtaggagaggtgactattacccttgatgatgtggcatttttacttcatctgcccatcataggcgccttccataacttcaaggctcttcatattgacgaagcgatgttgctgttagtcgaattacttgaggtgagtgcagatgaatgttggatttatgagcatttttcttttgttgctaaggctattgctgctgaagattatcatgagaggaaaccatgtgcctaccactggaagtctgggaaggcattaccagtgtcgacgtatcggaagcgtctagatagagtgacgtttgatggtgtttgttggatgccttacggtgaccttcatacatatctgacggggcccagttattgtcatacatcgaccagagagggttgtgcggcagtttggatattccttagtacccggtggcaacaacagctatggaggaagcacctgtag

SEQ ID NO: 40383 - DNA, 426 bp, Glycine max
  Peptide Sequence Number=SeqID_132068
atggacgaagatcaatggatctataacagtataatgtctaaagaagttgatatgaatgaacaaaatgaagatgaagctgctataaaatcaaaacatgttgattgttctgatgcgtttaatacttttcaggctcgagttgttgcttatgaaattgattttgtggcagtcattatgaggtcaggcacaaacacaagtatgagaggaatgacttcatttatcttaattggttgtgaaatgagtggtcaatataggtccaggaagaaagattttataagaagaaatactagcagtaggaaacgtgggtatccctttaagctgcgtgaaaaaccagtggttggagaccaaggatggatggggaagttaatgtgccaaagtcacaatcatgaaatgacaaacacattagttggacatccatgcactgattga

SEQ ID NO: 40384 - DNA, 1383 bp, Glycine max
  Peptide Sequence Number=SeqID_132069
atgacattgacgctctcaatacccaagaaatacattacactatgtaaccatgtaaggggggtttattgtaaagtgaaggggatgaatttggtcagagaattggaaaaagacttaagaattgcaaatgtcatctgtatgaatggaagaagacacttgacatcatctatgaatgaggtttcaagagatctgattgtgaattcttattctaaaaagaaacaagctcttctggacatgcttccaaccttgactgaacttcgacgtgcattggacatgccatcaacacttgaatcccttgtagaagaagggaattactggaaggcatttcaagtcctatctgagtatttgcaaatcttagatagtttgtcagagctttcagcaatacaagaaatgagtcgtggtgtggaggtttggctgggaagaactttacagaagctggatgctcttttattgggagtatgccaagaattcaaggaagatggctatataacagtaattgatgcatatgcattaataggggatactgccggtcttgctgaaaagatacagagtttcttcatgcaagaagttatatcagaaacacactctgtattaaaggctattgtgcatgaggatgaggagggactttcgcaaaatagtaggcttacttacagcgacttatgccttcgaatacctgattcaaagttcaggcaatgcttattacgaacattggctgttttgtttgaccttatgtgttcataccatgaaattatggaattccagctagaaagaaaggactcagcagcacaaacttcaaataagtgcaatgaagagatttcctgtagtccaggtgagactcaggaagttgattcagatgtaagagcctgcaataattctatgtccagttccagagatgtaatacatggctcatcttctagggaggaatctgcaacaaagagctcactgactgaaaccagtggttcaccatatagtgattttcatgatacaattaaggaggctggaaaggaggacagtgcaacatcaagcattgagtccccttggtaccatcttcgcaaagaagctacaacatttgtttcacagacccttcaaagaggacgcaggaatctgtggcatctcactgcaagtcgtgtgtcagtattgctttcttctgctgcagtctgtactgctagcattcatcaattcttgaaaaattatgaagacctcggtgtctttattttgactggggaagccttttgtggaattgaagcagttgaatttaggcagaagttaaaggttgtttgtgaaaactatttcatagcttttcatcgacaaaatgtgcatgtgtttgttgggatgtctaacatgttcttatttgtagatctgttaattgggtgcttgtctaattaa

SEQ ID NO: 40385 - DNA, 1202 bp, Glycine max
  misc_feature (1169)..(1169): n is a, c, g, or t
  Peptide Sequence Number=SeqID_132070
atggagcacattgttcaaatgaagggaagattgaagttgaatgttaccacaactagtaatgggggtatgagaaccattagaaacagtgatgtgttggttaccatagaagcattaaaggataggaagctagaactcttaccagccatggttagggaacaagagctagatgtcttactgaaagggttcataaaggctcatagacgttccaatgacaacggcagaagatggctgatggcggaggacggcgtcgaacggcgaccagtggtatgggacttgtgtctcacattggaaggatgtgattttagtgtgggtatacaaggtccaagctctccaactagaatgaatagcttgtgtgttcactcgggactagtcttaggagttaggactactgcacagccagtccatgtgtgtgctggggctgcggatgagcgtggtgggatgttattgatagtttcacattggaagtatgggaatctagaaagatgtgtggctgttgacactatatctcttgttgctcgaatactgaatagatctaaagctcatctccaatcaatgctcttgcaaagtaattcaactatacttgaggatttctatgttcatctggttttctcttatcctttggaaatgagaccaatcctcactaagggtattgaggttgcccctctaagcactttcctgcagttctggccccgtgacattgtggatgctgtaccagatcttacagaacatgttcatcggactacagtgagactactgttgcacattaatggatctcaaaactgtgttgccaagtacaatgaaaggattgtatctggtgacagatatgttgaacgtgttgccaattgtaaatgggaagtaaaagagcttggcatggagcataatggatatgttgatttgatgctgggggagtttaagcactataaaacacgacttgctcatggaggaattcgtaaagaggttcaagacctattattggattatgggcttgaaattgtggcggaaactcttgttgaaggactttcacgggtgaagagatgtagtgatgaaggacgggcccttatgtcattagatctgcagaccttaatagcaatcatgtcatgggttcgaatccggaaacagcctctttgcatatgcaagggtaaggctgcgtacaacatccctcccccatnacttcgcatagcgaagagcctctggacaatggg

SEQ ID NO: 40386 - DNA, 207 bp, Glycine max
  Peptide Sequence Number=SeqID_132071
atggaagatggagaggatacaaatgtgagcatatcacgaaaatccttcaagttcactcggttcagaaacaaattcaagatacaaacgtatttggaaaatgcaaacgttggggaaatggtgtcacaattaatgtgtgaaatgggtcacgtcattggtaccgtatttggtgcatcgacaatggtgctacaattaatgcatgcacattga

SEQ ID NO: 40387 - DNA, 180 bp, Glycine max
  Peptide Sequence Number=SeqID_132072
atggtaactttgaacagaggaaacttcatgaggagtgggatcattaagcatgacattcttgaggtctttaggggcactgtttcagatgatataactagtgccaaagaattccttgctgcaattgagaagcactttgcaaaacgcgatacagcgaaaacaagtactctccttcaaacttga

SEQ ID NO: 40388 - DNA, 442 bp, Glycine max
  Peptide Sequence Number=SeqID_132073
atgccacaaatgcatcatcatcatcctcgccgccacaatcttcatcattccaattccaaagccctctgcaagtgtcgattcgtcccgttttttcttcgagcgtggcctacgtcttcctcatcctcttcaccaccttcttcttcatcggcttcgtcttcctctacttccgccagttcgcctccgacgcggccactttccgccgccgtcatccgccacgccgggaggaggaggaggacgccgcggcggcggcttcagcaaaaaagtgtctgccggtggtggggcaccgcgggggggtgcgcagaagtgcgcaatatgtttttgaggagctgcgagagggggaacgcggtgaaggtgattccgtactgcaagcccgtgttccaccccggcactgcattgacacgtggctcgaaaaagcaagtcacgggccccgggggccggtgca

SEQ ID NO: 40389 - DNA, 447 bp, Glycine max
  Peptide Sequence Number=SeqID_132074
atgcaaatgcaatctgtttgtgatgaaggtggggtaaaaaaggtagatggtgatgcggggggtgcttcaattttaggttgcaacgtgaaacatcagaggaggttaacccaatcaataatgaaaaaagttaaagatggtgttggtaaggaagttgagggttattttgtggtcgttgcttcaactataaggaaaatgtctaaggattttataggaaacaagtttcttagcaatctgaaagaccttttatcttctaggattcttgagggactatgtgcgaattatgttttcaacaagggaaaaattgaaagggttttgggagtgatttttggtagtggagttttgtgttattgtaaagtctgtaaaaagattatgacaatgagacaggatagcgatctcagacaccccaaaaatcttacaaataaaaatgcaattgttaaaccttattag

SEQ ID NO: 40390 - DNA, 237 bp, Glycine max
  Peptide Sequence Number=SeqID_132075
atgggtcagatccagtactccgagaagtacttcgatgacacttacgaatatagacatgtggttcttcctcctgaagtcgcaaaactgcttcccaagaatcgtcttctctccgaaagccgtggctgggttcattatgcaattcatcgccctgagccacacataatgctcttcaggaggcctttgaattatcagcagcagcaggaaaaccaggcccagcaaagcatgcttgtcaaatga

SEQ ID NO: 40391 - DNA, 183 bp, Glycine max
  Peptide Sequence Number=SeqID_132076
atggaagctccagcaattatggccattgctttggccaatggaggaacatatacaagtgccactggcctattttctcaatctactcaattcactaccacatcacgatcaagtcgaaagaatagacttagaaaccttatacccataaccgtgatacttcaagattccactttgctattgtgctag

SEQ ID NO: 40392 - DNA, 1089 bp, Glycine max
  Peptide Sequence Number=SeqID_132077
atgcgttttgacctcataatttcattaaagagtttggtgagccactccagacctctatctccaagagttttccacacttcaatagctgtattgagacagatacattacctggagaatggctcagttgagatttacagtagacatgcagaacggaatactgggaagtttcctgatgttgttgctgctgtttcaaggttaaagaaaccaactgtatcatcattaattcttgattgtgaaattgttgcatatgatcgtcaaacacagacgatccattctttccaggcgcttagtactcgggctcgcaagaatgtagaaatggaagatataaaggttgatgtttgcatatttgcttttgatttgttgtatcttaatggccaagcacttcttcaggaaaacctgagagtccgtagagagcatctctatgcctcttttgaggaagagcctggatttcttcagtttgcaacaacgataacatcaaatgatgttgaggaaatacagaagtttcttgaccaagctgttggtgcaagttgtgaggggttaattattaaaacattaaatgaggatgctacatatgaacctttgaagcgatcactcaactggctaaaactgaagaaagattatatggacaatataggggactcactagatttggtacctattgctgctttccatggtcgtgggaaacgtacaggagtttatggtgccttcctccttgcttgctatgacagtgacaacgaagaatttcaaagtatttgcaagataggaacgggattctctgaagcagtgcttgaagaacgttcttctagtcttcgttctaaagtgattcccaagccaaaggcatactatagatttggagaatcaatcaatcctgatgtctggtttgaagccagtgagctgcatttaacttttttggtggcacttgtacatttttctataaagggcatatctcttcgatttccacgactacttcgagtcaggcctgacaaatctcccgaacaggcctcatcatctgagcaggttgctgaaatgtataacgctcaaaaacaaaatcacacgatcaaccaaaatgacgatgaagatgatgattga

SEQ ID NO: 40393 - DNA, 831 bp, Glycine max
  Peptide Sequence Number=SeqID_132078
atggcaaagaaatccatcggaagcttaatgcgaaagaagctttctgatatcaccaacaacactaatcctaattactctcaacaacttgacacctctctttcctccgataacaattccattcaacaactcctcaaggaaagaacggcattgattcaactcctcacagaaagaaataagataattgaagcgactggctcggagctgcagaggctgagagctgatgtgaagaagctgcaaatccaaaactggaaccttgctcagtccaatacccacatgttagcggagcttaacatggggagggaaaggattaaaacgctgcagcatgaaattttgtggagggctgctttgattaaaggaaagacagtggacgtgcaggaaaaagtggagattgagggcgaaaagaatcctactgcattatcacagttacaggaaggagataaaaaagcaggagtgccatcccctaaagccagcaatgatgaacaacacaaatgtatgaatagaagacgcataaggagtaaatctactggttcttctactgcttccaagaatacaaacaaagacaaggttaaagacaataggagacgtttgaggagacattctactacgttcaaaacccatgaacatgaacctctagagaatttgttcgagttagaggatgctacatatcttgtaactcaatctccaacttcaaaaactgaaagaggaaaaagctctgcttcaaggaatgaagctacaaggtgttctttcgaaagacccttgcgaagagcagttcagaaggttcattcttacaaggagattcccgtaaatgtcaagatgcgaagactagactaa

SEQ ID NO: 40394 - DNA, 1485 bp, Glycine max
  Peptide Sequence Number=SeqID_132079
atggctcagcagaaaagacccccaaatagcaggggctactacgttaagatgaaactccttcaaaaacatggcagacctcatcatcaccatcaccatcaccagcaagaaaaaaactgcttctacagatactacaaatgggttctctggctttctctttctctctatttcttcacttcctacctcatcagcaacaacaacaaccaccacaccaaaaaaccttctcacgtctccagagcactcatccaatcaaaccacaccacaactcctcaacatgctcttaactctccagaatctttgaagaagttgaaggtgtttgtctacgaccttcctccgaagtacaacacggattggttgacgaacgagaggtgcagcaaacatttgtttgcgtcggaggttgcaattcacagggctttgttgaccagcgaggttcgcacgtttgacccatacgacgctgactttttcttcgtccccgtttacgtgtcttgcaacttcagcaccgtgaatggcttccccgcgattggccacgcgcgctccctcatcgcgtccgcggtaaacctcatctcctcggagtaccccttctggaaccgaagcagaggctccgaccacgtcttcgtcgcgtcgcacgatttcggctcgtgtttccacaccctggaggacgtggcgatggctgatggcgtgccagagattgtgaggaactcgatcgtgttgcagacgtttggcgttgtgttcgatcacccgtgccagaaggtcgagcacgtagtgattccaccgtacgtttcgccggaaagtgtaagggacacgatggagaattttccggtggacggacggcgagatatttgggctttcttccgagggaaaatggaagtccatcccaagaacgttagtggacgattttacagcaagaaagtgcggacggtgatatggaggaagttcaacggtgaccggaggttttacctgcagaggcataggtttgccggttaccagtcagagattgcacgttcggtgttttgtttatgtcctctggggtgggccccatggagtccgaggctggtcgagtccgtcgccttgggttgcgtgccagttgtcatagcggacggtattcggttgccgtttgtctccgcggtgaagtggtcggagatatcggtgacggtggcggagaaagacgtggggaggctggctgagatactggagcgcgtggcggcgacaaacctgagcacaattcaaaggaacctgtgggacccagcaacgaggagggccctacttttcaacagccaggtccagctggaatttcttgagagatggaatttaatgactcatgttggggcccaaagtagcagcttcaagactttcttcgagtatattaatggtgacgtggttgtgtgtcaggttggtgacaaaagggttgggaaaacgaaggttgaagagattttggtgtttgtgagtgaaatgattaatgagaatggagatttggatggaggaagatga

SEQ ID NO: 40395 - DNA, 588 bp, Glycine max
  Peptide Sequence Number=SeqID_132080
atgaagcatatttctacttgcaaaaaagaagtttttttattaattggaaaatttgtttcactaggttttgctattggtaatgggttaacaaatcctgcaattcaatacccagaatacccagactttgcattagacaacaaaataattacaaaagctcaacatgatgatatcatcaagtcaatcccaggctgtgaagaagccacaaaaaattgcgaatctaaaggtggacaaagttgcgagactgcattaaatgtttgtcaaggcatattcgatagtatcttgtctatagccggagatattaattactacgacatcagaaagaagtgtgtgggacaattgtgttatgacttcaacaacgtggagaagttgttaaacctgcataaagtgaaaagagctttattagagaaagggattaatgttctagatccaacattttggtatccagagcctaatcgagcctgggatcgggaaacacgagtgaaatcattgagcacaaatggaggaaatgtccctacgcaattgctggttcttgatggaaaaaattgggagcggtggcatattcaaatgaaggcgaatttcaagacgtga

SEQ ID NO: 40396 - DNA, 1185 bp, Glycine max
  Peptide Sequence Number=SeqID_132081
atggcatcgtcaccaaccttctccaaagtctctctgctcttgttggtgtcactttctttctcctatgcaacttctggcttcaaccatgagcatgcttacccaccacaatcacaagcagagatgctcacaagaaaccttaacctattcccaaaggacccagttaacattattaaaggtgattttgatagttttgtaccaggaaagatagtggagaagaagttctcgcttcttggtcattctgggccttctattcaacaccttggtcaccatgctggccactattcccttcctcattccaaagctgcaagaatgttctactttttctttgaatcacggaacaataaggatgatcctgtagtgatatggttgactggaggaccagggtgtggaagtgaattagctttgttttatgagaatggtccttttcatattgccaataacttgtctcttacatggaatgattacggctgggaccaggcatcaaatattttatttgttgaccaacccactgggacagggtttagttactcttctgatgatagtgacattcgtcatgatgaagccagcattagcaacgatttatatgacttcttgcaggagtttttcaaggctcatcctaagttcgttaagaatgacttttatattaccggagaatcatacgctggacactatattccggctcttgcatcccggataatccaaggaaataaagaaaatcaaggaatttatataaatctcaagaaactcaaggtggacaaagttgcgcgatcgcatttaatacttgccaaaaaatattctaccatatcctggactttgctcccggcattaactaaaagagtgcatgaggctatgatgcaagactatatgagaaacatggaagtggagattccttctcttcttgaggacggaatcaagttgcttgtgtatgtaggggaagaagatctcatatgcaattggcttgggaattcaaggtgggtacatgcaatgaagtggtcaggcaaaaaggcctttggaaaatctcctacagtgaaatttgtggttgatggttcaaaagcagggtctcttaatagctatggacctctttctttcctcaaggtacatgaggctggacacttggtccctatggatcaaccaaaagctgcacttcagatgttgcaaagttggatggcagggaaactgacataa

SEQ ID NO: 40397 - DNA, 2280 bp, Glycine max
  Peptide Sequence Number=SeqID_132082
atggcattggcatcatcaccatccctctccaaagtttatctgtttcttgtgttgcttttgttcatgtcagtttcttcttcttatgcaacttctcgcttcacccataagcgtgactacccaacacaatcacaagcagaaaaactcataagaagccttaacctattaccaaaggactcagttaacattgtaaaaggtgaccatgttggttttgtcccaggaaagatcgtggagaagaagttctcgctattttgtgattctgggccttctattgaagaccttggtcaccatgctggctactattcacttcctcattccaaagctgctagaatgttctactttttctttgaatcacggaacaataaggatgatcctgtagtgatatggttgactggaggaccagggtgtggaagtgaattagctttgttttatgagaatggtccttttcatattgccaataacttgtctcttacatggaatgattacggctgggaccaggcatcaaatattttatttgttgaccaacctacgggtacaggtttcagttactcttctgaggaaagtgacattcgtcatgatgaaacaggaattagcaatgacttatatgacttcttgcaggagtttttcaaggcgcatcctgagtttgttaagaatgatttttatattactggagaatcatacgctgggcactatgttccggcacttgcatcccgggttaaccaaggaaataaacaaaatcaaggaatccatataaacctcaagggttttgctattggtaatggattaacaaatcctgcaattcaataccaagcttacccagattttgcattagacaatggaataattacaaatgctgagtacgataacatcagcaagttaatcccagggtgtgaacaagctgctaaaacttgcgtgttggataaaaatggtgaagttcagtttactaattgcactgtgctgatacacaaagtgcagtactatgacatcagaaagaagtgtgtgggagaattgtgctatgacttcggtaacgtggaggagtttttaaaccagaagaaagtgaagagtgctttaggtgtgagggatgacttgcagtatgttttatgcagtacaacagttcatgctgctatgcttcaagattggatgagaaacatggaagtggggattccttctcttcttgaggatggaatcaagttgcttgtgtatgcaggggaagaagatctcatatgcaattggcttgggaattcaaggtgggctcatgccatggagtggtcaggccaaaaggcctttggaacatcttctacagtgaaatttgtggttgatggtgtagaagcagggtctcttaatagctatggacctctctcttttctcaaggtttgtgttattgtgctcagggttgtattcttgagtgtcatggcgtctgacactgatcccaattccaagcacttagggactacagtatgggatgcatcacttgtgtttgccaagtttcttgaacggaattgcagaaagggaaggttttccccagctaaacttaaaggaaaacgtgtaattgaactaggagctggttgtggtgtttctggtattggcatggctttgctggggtgtgatgttatagtgacagaccaaaaggaggttttgccattgttacagagaaatgttgagcgtaatatttcacggatcatgcaaaagaatcctgattcatttggttcgatcaaggtggctgagcttcagtggggagatgagagtcatattaaggcagttggtcctccatttgactacatcattggcactgatgttgtttatgtagagcatctattggagcctctattacagacaattcttgctttatctggaccaaggactacaactatgttggggtatgagatccgctccacgagtgtccatgagaagatgcttcagatgtggaaaagaaactttgacgtcaagactgttgcgaagtccaagatggatgaaacatttcaacatccaagtattcaactcttcattatgggatttaaacaatcagccgagtgcacagagaacccaggtcaggcaactgttgaaaaagttgatgtggaaactgttgtggaggatgaaagcagtgagggaaatgttgtagtagaaggatctggtctcgttgaagaaaatgtgggggatcacagtaagccaatctctcaaaatgcaaagcttagtgagtgggaagccagaaggtatggagcaatggctgctagggttttgaaagatgagacactatatggcggagacagtgttcgcaatttttag

SEQ ID NO: 40398 - DNA, 204 bp, Glycine max
  Peptide Sequence Number=SeqID_132083
atggcagcgcagtgggcaagggagttagggctaaggatcatcgctagtgatagtggtgaggctaaggagcgtcgcgaattattaaagatccattcaaacaagattaaagaattaagaagattcaagagaagactcaagatatgcaagaacctcaagaaaagcatcaagataagtataaaaagaatttttcaaagaaaagattga

SEQ ID NO: 40399 - DNA, 546 bp, Glycine max
  Peptide Sequence Number=SeqID_132084
atgacttgcacgaaaaaatctagtcaaatgatgtctaaggcaacaaaggaaattgcagatagcattggactcacgctacctcctaagcctgaggttggtccttctgttactcgtgtcaacacaaaggaaagttgtgtcaatccctcaggacaggacctagacacgggtgactcaaagaaatgtgggttatatgtcgatgagaatcctctcgatctggtttcccttggaagagtttatgaggggttgacaattgtccacaacatccctttatgcaatgatcaagtgaaggtcggtgttgaggaagttcaagatgctgatgatcgtgttcctgtacccactcaagagtttcaattagtggggcatgcacttaacacctctcttgcttgggcgacacatcttctttttctcaagtcgttgcaagtgtcatgggatgctaccgtgtttgggatgtataatgataactttcccttgtacataaagcctaaagatctttctgaaataacacacggtggtcaatgtcttagcatctctgttatacaattgtag

SEQ ID NO: 40400 - DNA, 1584 bp, Glycine max
  Peptide Sequence Number=SeqID_132085
atgcagaaagcagggtacggtggcgatggaatatacaggtctctaaggccttgtttggttctcccaaatgaccccaacctctccctcgtctcattcctcttccaaagcgtttcctctttcccatccaaaatcgccctcgtcgattcccactcttcccaaacacttaccttggcgcacctcaaatcacaggtcgccaaacttgcccacggtttcctcaaactaggcataaacaaaaacgacgtcgtcctactgctcgctcccaacagcatccactaccctatatgcttcctcgctgccaccgccatcggcgccgtcgtctccaccgccaatcccatttacacagtcaacgaaatctcgaagcaagtcgacgactccaaccccaaactcctcatcaccgtcccagaattatgggacaaagtcaagaacctcaacctccccgccgtaattatcgatacggaaacagctcaaggactcgtgagtttcgaagctggcaacgaggtgtcgagaataacgagtcttgacgcggtgatggagatggctggaccggcgacggagctgccggagagcggcgtgaagcagggggacacggcggcgcttctgtactcctcgggaacgacggggttgagcaagggcgtggttctgacgcaccggaacttcatagcggcgtcggtgatgatcggaatggacgacgacctcgccggggagcaagacgacgtgtacctgtgcgttctgccgatgtttcacgtgttcgggctggcggtggtgacgtacgcggcgctgcggcgagggagcgcggtggtggtgatggagaggttcgagctggaggcgctgctgaaggctattgagaagcagagggtgacgaagctgtgggtggtgcctccgatcctgcttggtctggcgaaacagagcgtggttggaaactacgatctttcctcgttgaggcgtataggttcgggtgctgctcctctcgggaaagacttgatggaagagtgtggcaggcgttttcctcatgttgccatttgtcagggttatggtatgacagaaacttgtggcattgtttctgtggagaatccaagagtaggggttcgtcatactggctcaacgggaacgctagtttcaggagtcgaagctcaaatagtgagtgtggatacacagaagcctctccctcctagacagttgggagagatatgggtgcggggacctaacatgatgcaaggagatcttggatattttgatgaagatggacaactttatgtggttgaccgtatcaaagaactgatcaagtacaaaggtttccaggttgcaccagcagaacttgaagggcttctcgtttctcaccctgaaatactagaggctgttgttgtgccatatcctgatgatgaggctggtgaggttccaattgcctatgttgttcgctcacccaatagttcactgactgaagaagaaattcagaagtttattgctaagcaggttgcacctttcaaaaaattgcgaagggtaacattcatcaacaatgttcctaagacagcttcaggaaaaattctcagaagagagcttactgcaaaagcacgatccaaaatataa

SEQ ID NO: 40401 - DNA, 360 bp, Glycine max
  Peptide Sequence Number=SeqID_132086
atggaaatattcaagataaggaacgaaagcatgtatggtgttatgttgacaaaatctttgatgaagagagaatatagaagaaataaggtaggcaaaaggtacgtgaagcaaaggggcttctcacctcgtaacgctccgaaccttcgtgttctcccacgaaggcatacctgcgaggcaacaaagcctgcaagttggcgcagaagaatcttcccaacgagttttacgagacagagtgggacaccgaaagggtatttggcggaggtgccggggaggatggcggcggtgttctccgccgcggtgatggcgaggaacaggaaaggatcgagtgtgatgcacatgtttttgcatgatgtggattga

SEQ ID NO: 40402 - DNA, 711 bp, Glycine max
  Peptide Sequence Number=SeqID_132087
atggaatttgagatcatcaacgaatctccagctgattccacttcactatcctcctcttcagtctcaccatgcacaccaccaaaccctaatctgttatgtgattctccaaatccacaaccaaatactaataccaatccatctcacaagagaaaagcaggtagaaagaagtttagggagacacgccacccagtgtataggggtgtacggcaaagaaacgggaacaaatgggtgtgtgaaataagggaaccaataaaaaaatcaagggtttgggtagggacataccctactcctgaaatggcagctagggcacatgacgtggctgtcttggcacttagtggcacctcagcgaagttcaatttccccgattcagtttcgcttcttccacttgcaaagtcacactctgctgtagatataagagaagcagcaaaagctgcttctattgaagctttcataccaaacacagccttttcttcctctcataacaattctaattttggtgaaaatgggaatgctgaagacacttgtttgaacattggcatgcacgacgatgagtcagaaacaatgttctttgatgaggaggcagtgtacaatatgccaggtttgttggatagtatggcagagggtttgcttattacccctccttctatgaagagagcaatggattgggacgatattggttgtgtaatagaccttactctgtggacaaattaa

SEQ ID NO: 40403 - DNA, 234 bp, Glycine max
  Peptide Sequence Number=SeqID_132088
atggatgaggaatttagaaaaatcttcaagaaatttattttcactgatgtctctactttggaggatactgaaaagaaggatggttcagaagaaaatgcagctactaataagaaggttgattctgattctaaagaggaagaaaatgataatgagcaaaaagagaaagtcatctcaataagaagaaaaaggggaattgttgaggctatcaccaatcttggacttataggtgtttga

SEQ ID NO: 40404 - DNA, 357 bp, Glycine max
  Peptide Sequence Number=SeqID_132089
atggacgtcaggatgttctcactactgctattggacgtccagagcaccctcgacgtgtccgtgttgttggagtcgatattctgcccgcctggttgccctgggagagtttataagggatccactgttgttcataacactcctttgttgcctggccaagtaaaggtgggtgtggaggaggttacagatgtagatgctccagttcctgtacccactgatgaggtttccttagtggggcaggcaattcacaccttccttgcttggccgacacatctggtcaagtctttatcaaagcagctgtgtctccggcaaaaccacctcaaaagccggatccgtaggtcgatgatccgctttatctga

SEQ ID NO: 40405 - DNA, 330 bp, Glycine max
  Peptide Sequence Number=SeqID_132090
atgaatttattgcctagcgctgttcatgtgtcctccaccttcgagtctggagccccgcgaattgattgcctagcgctgttcgccaattctccattctccacttttatttggagccacatgaattcattgcctagcgctgttcatgcatcctccaccaacgagtctggagccccgcaaatttattgcctagcactgttcgccaattctccattccccagtgtcgcaatgtgcccttttacgggtgggcgacacgtgactcgcgggatgcgtgttccacgaaaggaatacgcgcggagtcgccaccaacgtttatttgaggaaaacgtctga

SEQ ID NO: 40406 - DNA, 192 bp, Glycine max
  Peptide Sequence Number=SeqID_132091
atgactcatgctcctttaggttccttaaattccgtgggtggcgtagctacagagattaatgcagtcaattatgtttcttctagaagttggccatttatggcacgcgggaagagctcgcgcagcttgccgcaggatttgaaaaaggaattgatcgagattttgaaccagttctttcccatgactccctcttaa

SEQ ID NO: 40407 - DNA, 351 bp, Glycine max
  Peptide Sequence Number=SeqID_132092
atggaaaggtttcccctagcactgatttttttctttcctcttaagcaaaggatctttggtttggtaacaagaggtacttgtagtgctgtcaaagttttagcttcgtggagtgtgacagaaaatattgaaggactggatgtggtggtcactgtccaatctttcaagcatgcgtcatataatttaaacagacagtatttcattgctaaactcatgaaaaatgaattagaaaggtcacttacagagctaatactgggttgtctttttgcagcagagatttctggagaattcagaagcagaggatttgtagcagagtatggttctgtcatagcaaacattagattatacaggtaa

SEQ ID NO: 40408 - DNA, 507 bp, Glycine max
  Peptide Sequence Number=SeqID_132093
atgaagaggagtatgattgatgttgccagtggtggagcttttggtgatatgactcctactgaggctaggaatttgattgaaaagatggcttccaactcccaacaatttagtgcaagaaatgatgctattgtccttagaagagtccatgaggtggccacggattcatcttcatctgctgaaaataaaaagcttgagggaaaacttgatgccttggtcaacctagtaaatcaccatatagatatttgtccttctttgcaacaatctggagtcaacgagcaacctgaagcttctgctgcaaacatttataatagacctcctcaacaacaaaaccaacaacaacagaataattatgacctttcaagcaaaagatacaatctaggttggaggaatcatccaaatctgagatggacaagtcctccacaacaacaacagcctgtccctcctttccagaatgttgttggttcaagcaagccatatgttcctcctccaatgcagcaacagcaataa

SEQ ID NO: 40409 - DNA, 579 bp, Glycine max
  Peptide Sequence Number=SeqID_132094
atgaggggcaccgttcatgagcctcaagtgaacataggggccgatcaaaagttctcacccatcgaggatggaccctcgggtactagtaccctggtcttcaggggactacacgtcctcgccaacagagggctgcacgccctcaccttaagaggactgtgtgtcctcgccatcagaggactgcatgtcctcaccttcagagggttacacgccctcgccatcagaggactgcatgtcctcaccttcgtagggctacacgccctcacctttagaggactacacgtcctcgccaacagagggctgcacgccctcaccttgagaggactaaacgtcctcgccttgagaggactacatgtcctcaccatcagagggctgcacgccctcacctccagaggactacacgtcctcgccttgagaggactacatgtcctcaccatcagagggctgcacgccctcacctccagaggactacacgtcctcgccttgagagggctactcgccctcgccttgggtactagttaccctcaccttcagaggactacatgtcctcaccttcgtagggctacacgccctcacctttag

SEQ ID NO: 40410 - DNA, 228 bp, Glycine max
  Peptide Sequence Number=SeqID_132095
atgtcaggactcatacgcgattctcctcaaatttcagccaacccgcatcaattagactttgcaccttacgcttcgaggtcatacagtgctcaatggaatgtctcagaactcttccatgatatgcgcatgttgcattcgagtcatatcctcgaagaaatggaggttgatgaaccttggctggggttatggctaccattgaattatcaagtagatattggagcaagttag

SEQ ID NO: 40411 - DNA, 407 bp, Glycine max
  Peptide Sequence Number=SeqID_132096
atggtgaacagtgctcgggctccctgctttggtgattcgcggtcaaggaggaagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40412 - DNA, 495 bp, Glycine max
  Peptide Sequence Number=SeqID_132097
atggcattgaaagaagctattaaagtagagttgtcacataaaggatccccaaactcactaataattcagctggacatacaacaattaggcgcgcgtgtcagcactaagggaagtaatgctcaaagcaatgcccaaccttcacgggaatctgatggtgatgtgacacgaaagatgggactctatgtgcagcataaggatggtacactaggattggtggccatggggaaaataatggatagggattcagtgatacacactgtggcttatgcagatgatgttgtaagggtaagtgtggatacagttatcgatcctgacgctaagatcccctatgccacctcagaaattaagtatgtgaagcaggcccttcatacatttgtagcttggcccacagaccttgttaaacttgtattcgatgagaaattattctgcacaaagtggatgcacatggagataagccagctaatgtggacacagatgatccaatgtgtgggctga

SEQ ID NO: 40413 - DNA, 52 bp, Glycine max
  Peptide Sequence Number=SeqID_132098
atgccattttcaaaggtccaacgcctcgaaatggtcttttccgctgttattg

SEQ ID NO: 40414 - DNA, 830 bp, Glycine max
  Peptide Sequence Number=SeqID_132099
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcgccacgaggttgattatcagtggtgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40415 - DNA, 225 bp, Glycine max
  Peptide Sequence Number=SeqID_132100
atgaagaaacaacaatggaagagaagcggaagacaaaggagaagaggtgagaggaggcgccatccactagggaataagccatggaagaaggagcttcaccaccaagatgagccttggataagaagcttggagatgatgcttcaatggaggaaaagaaagagggagagaaagagagagggggggggggggcaggaaattgatggaagaaaaagggagagaagttga

SEQ ID NO: 40416 - DNA, 291 bp, Glycine max
  Peptide Sequence Number=SeqID_132101
atggctcaattgatttctgatgtcatctattatttgcaagaatggcacccacaaagacacccagtggacccggagaagtccaacagggccttggggtttccagctctggttacgggcctctgtagtcctacagggtgcccgttccccccggcaaggtcacgtcagcatgacatagggatcgcgcctgcaagacacccagtggacccgaagaagtccaacagggtcttggagttgccaagctctcattactggcctcggtcagttctacggagtgcctgtcgcccccagtaa

SEQ ID NO: 40417 - DNA, 165 bp, Glycine max
  Peptide Sequence Number=SeqID_132102
atgccaccccccccccagggatcagcggatgttgcttttaggactccgctggcaccttatgagaaatcaaagtcttttgggttccgggggggaactggagctcttttcttgattctatggggtggtggtgcatggccgtttctagttggtggagcgatttgtctg

SEQ ID NO: 40418 - DNA, 237 bp, Glycine max
  Peptide Sequence Number=SeqID_132103
atgggaaaatacctcttccatattaagaacataaaaatcaacaggaaaaataagttcaccaacccgaaccagcacatcctctatgagacttccggggtatacagaaagtacctgggtccttacatttctcaagaatgtgaggaacaaattttacctattaatgctgacacatttctggccatgctaatccttttcattgcctttaagcttccttttgtgggtgcacatctcctttag

SEQ ID NO: 40419 - DNA, 1599 bp, Glycine max
  Peptide Sequence Number=SeqID_132104
atgcggcgccacggctatgcgggcacgctgtacccgatcaacccgcaacgcgccgaggtccagggcgaacgcgcctggcccagcctggccgcgttgcccgcggcgccggacctggcgatcgtggcggtggccggcgagcaggcggtgcgggcggtggatgactgcgcggcgctgggcgtggcggcggccatcgtcatctcggccggcttctcggaaaccggcgaagccggccgcgccctgcaggaggcgatgacggcgcgcgcccgcgccgccggcatgcgcatcatcggccccaactcgcagggcctggccaacttcggcaacggcgccatcgccagcttctccaccatgttcctggaggtggcgccgggcgacgggccggtggcggtcatcagccagagcggcggcatgtgcgccatggtctacggcctattgcgccagcgcggcatcggcgtgcgccacgtgcatgccaccggcaacgaggccgacgtgtcggtcgccgaactggcctgcgcgacgctgcgcgatccggaagtcgggctgcgtgctgctgtacctggaatcgctgcgcgaggcagggccgctggccgaggcggcggcgctggcgcgggcgcgcggcgtgccgctgatcgtggtcaagtcgggccgctccgaggccggcgcgcgcgccgcggcctcgcacaccggcgcgctggccaacgaagaccgcgcggtggatgccttcttcgaacaccacggcatcctgcgcgcgcgcgacccgcaggaactggtgcgctacgccgagctggccctgcgcagccccttgccgcaagggccgcgcgtggtggtggtcagcaactccggcgccagctgcgtgctggcctcagacgcggccgccgagcgcggcctggagatcgcgccgctggccgacgccacccagcaggcgctggccgagcgtctgcccggctatgccaccaccgtcaaccccgtggacatcaccgccgcgctgctgtcgaacaacggcctgttcgggcaagtgctgcccgtaatcggcgccgacccggcggccgacatgttcctgctcgatattccagtggcggggcgcggctacgacgtggattcgttcgcaacggacgcggccggctttgcgcgggcggcatccaggccggtggtggtggtggcgtggcaggacaacgtcgccgccacgttccgcgcgcacggcctgcccgtttacgccgacgagatccaggcgatggatgccttgtcggcgctgttgcgcctgcggcggttgcgcgaacgcggccgcatggcgtcgccgccagcatcgcaaggcattgtggcggcggagccggccccgaacgacgccgcgggcttcctgtccgaagcggacagcctggcgctgctggccggcaacggactggcggtgatcgaacacgccgtctgccacacggccgacgaggccattgccgcgtggcgccgcatcggcgcgccggtggcgctgaagttgctcggcaaaattgccgcacaagtccgaacatggactggtcgcgctgggcctggacgatgaaaccgcgctgcgcgccgcgttttcccatcaagcccaaaccttgggtaagctga

SEQ ID NO: 40420 - DNA, 486 bp, Glycine max
  Peptide Sequence Number=SeqID_132105
atgacgttgctacttagcaacattctgcccaacgaccgtaatgccgatctccccctgcagaagggtcacgcccacaagacacccagtggactcggagaagtccaacagggccccggggtctccagctctgattgcgagcctctgtcagtcctacagggtgcccgctacccccagcaagggatcgcgcccgcaagacacccagtggagtcgaagaagtccaacagggtcttggggcttccagctctgattacgggcctctgtgagttttacaaagtgcctgtcacccccaacaaggtcattaggccccacattaaccgtgctttcatcaagaagtactgcgcccccaggcaggcgcagggcgagacaccacaacagcattgggatggccagcaacaggcaacaaatgcaccgccgccacctccaaagcccctaagctcatccatgaaaaggttagagtattgcctacgacacatggtcgaccaatag

SEQ ID NO: 40421 - DNA, 887 bp, Glycine max
  Peptide Sequence Number=SeqID_132106
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgtccccaaacaacatacttgtgccattgataattgtcacaaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40422 - DNA, 483 bp, Glycine max
  Peptide Sequence Number=SeqID_132107
atgtcatcaagcaaaggtccccagacgaaattagggtatgacaatggtgtatcgtttgaaggtacacttgatgatgattggaagtttgatttttctgtttctgatgcccgccggttggcttgcatcaaccaagcggatatgaccggaaggcttcttgccggctcattgacatttgattgtcgcatcctccactatcttattgttcgcattttgcttccgagatcttcaaaccttgcacaggcattgcaatcagacgctcccttaccctatcctcatcttatttctctctttcttcaccatttcgaggtacctcttgattctgagccttctgttcaaatcaagaagtccttttccattggggctgcagtggtcgcctccttcggttatcgcaaagagcatgatggctcttggataaagaaggatgctcaaccacatgatgctaagggttgctcgcccgctcgagaggattcttctcttctgtag

SEQ ID NO: 40423 - DNA, 486 bp, Glycine max
  Peptide Sequence Number=SeqID_132108
atggtgggttacacaccttcaagttttacagatttggtctccgccagcaaaaagatcgaagtggatccgaaaagaggcaaatttgatcatcctactaggacgactgagaaaactggggcaaataaagagggtgaggatgagggagaaacccatgctgtgactgccattcctgtacggccaagtttcccaccaacccaacaatatctttactcagccaataacaaactttctccttacccaccacccagttatccacaaaggccatccctaaatcaaccacaaactacaatgttaaatgaaatggataaagttgatatctttgtccctcatcctctcacgaacgcatgtttgcttattcaactttcaccggaatgtgggtgtaagccattggtctgtttgctcaagcaacctgcgcccctgagtgttgacttccaagaccgttcaatcagagattactcatcttgcacgttggtgggggtgccgtaa

SEQ ID NO: 40424 - DNA, 372 bp, Glycine max
  Peptide Sequence Number=SeqID_132109
atgttggtgcgcatgatccgcactcgtctctttgcagcggcacgggtgaaatcttaccccggtatgcatagtagcagtgtgatagcctccctctctggttgtgctcgcacagttggccctcctccaatatcagggggtggcccaggaactgtgcggatgtggagcacattgaaaatgaggacgcgtagccctctaaaggcgagggcgtgtagccttctgaaggtgaaggcgtgcagccctctgttggcgaggacgtgtagtcctcttcaaggcgataggtacaagtacccaagggtccacccttatgagaaagcaagagatcgactcatcgagagggccggtcatcccaaatccacaagatttggacattag

SEQ ID NO: 40425 - DNA, 260 bp, Glycine max
  Peptide Sequence Number=SeqID_132110
ccgaggcgcttccgaaacgtttccgtaacgttttccgtgaggaatttcgcaaagatttcaaccgttcttcgacgttcttcattcgttcttcatcgttcttcgatcttcaacgggcccacttgggccctccagaatattcctccagaaaggctgttgcttctggaggaagcaacctggctcgcctgggcgagctgagctcgcctgggcgagctgagctcgcctgggcgagctgggcggcaccacctccctatttgctataa

SEQ ID NO: 40426 - DNA, 321 bp, Glycine max
  Peptide Sequence Number=SeqID_132111
atgggtccgaaatctatcctaaggctcatgagaaccctagggccttctcttgcatctttggtccaatcttcttcgagtcttctatccaatgcccttggggggagtaatcaacataaaaatacaaaaaaaggggttcccacggaccctaagagaataaaggtcattcctaagtggcccactccaccaagtaaaatggaaatttggggcttccatgacttaacaaactttcacaaaaggattgtcccatatttttctatacttctagcaccactctttgagttggtgttgatggaagaagctcagagttttaagaacctctag

SEQ ID NO: 40427 - DNA, 312 bp, Glycine max
  Peptide Sequence Number=SeqID_132112
atgctaagtacttactcacgatcatcaggccaccaaactttgacccgtaaaccaacaagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgctccttcccaacagttgcgcagcctgaatggcgaatgggacgcgctctgtag

SEQ ID NO: 40428 - DNA, 510 bp, Glycine max
  Peptide Sequence Number=SeqID_132113
atggcaagggatagattgatagacactgaagtgcataatgtcagactcaaattgattgctggtcgagaaaaagatggtcgtacatataatgtaccaagtgttccagaagttgctgcactcattgcaggtgatattgatgcaaattcaaacaaagatattattgttaaaactcaaaatggtcaattacaaaggatacatgaattacattgtagttatctagctctacaatatcctctattgtttccttatggagaagatggatataggtctgacattgtacatcgtgatacattaagtgggaaaaaaagaaaaagaaatcgtcttacaatgagagagtggtttgcttatagactgcaatgcagacccaatgaaggtcaaactctgctgcattctacaaaactattccaacaatttgttgctgaaggatacacaatgattgaatccgaaagactttcctatgttagaaacaaccaaaagaaacttagagttgacaagttctatagcttatag

SEQ ID NO: 40429 - DNA, 573 bp, Glycine max
  Peptide Sequence Number=SeqID_132114
atgcatgcaggattaaaggtagagccctggggagagaggatcatcatcattcagatgatgttccctagcgaagaagctgttgatgatgctaagggatttccaggtgggccgcatgacccatcagtgttgactgactatggtgaccatgttgtagtcatcgtatggaatggagaggaacatcctgaattgaagctatcctcccatggaaggaaggttcagaaatttgggaggcttgctcctaaagttgaagggccagtcgctgccacaggattaagtcttttgatcgcatgttccgtagacactggcgatcggggacttatatccgcttttgtggagaggtggcataaggaaactagcagtttccatcttcctgttggagagctgaccatcaccctggatgatgtggcctatctgcttcatcttcctattataggcgcattccacagcttcgagactctgcatgtcgacgaagcagtcttgatgttggtggagttacttgaagtctctggagagaaaggtagagctaagacaacacaatatcatggggcatacatacgcctatcatggctgtga

SEQ ID NO: 40430 - DNA, 413 bp, Glycine max
  Peptide Sequence Number=SeqID_132115
atgagcaatttaaatcttcacgaagatgatgatcatgatgatgatgattatcttgtgtctaactcatacgttgaagagtcgttagacaaagatgacagtgttgacggtatatcagataccgacagtgaagtccccgacatgattccaccagtaagaattgttcacccagcagaaggtgtacaaggaattcagaatccattttggaatgatcctttgcattataataatatcaactggagtcatcctgatgaggaggacatttgtggtttggagatgccatccagttttaatgttggccaagaattatatgttggcatggaatttgatagtaaagatgcggtcaagaatgcggtcaaacaatatgttatgaaggtgcatcaaagtttcaaagtggttgaaagcaaatgggacaa

SEQ ID NO: 40431 - DNA, 861 bp, Glycine max
  Peptide Sequence Number=SeqID_132116
agggctgcatgcctcaccattagaggactacacgtccttgccatcagagggctacacgccctcgccttcagaggactacacgttctcgccttcagagggctgcacgtcctcaccttcagaggaccaaacatccgcatcttcggagggctacacgccctcgccttcagaggactacacgtccttatctttagaggactacacatcctcaccttcagagggctacacgccctcacttttagaggaccaaacatcctcatcttcagaggactatacgtcctcatcttcagaggactacacgtcctcaccttcagagggctacacgccctcacctttagaggaccaaacatcctcatccttagaggactacgcatcctcatcttcagaggactacgcatcctcatcttcagaggactacacgtcctcaccttcagagggctacacgccctcaccttcaaaggactacacgtcctcgcctttagagggctacatgtccttgcctttagaggacttcacgtcctcgccattagaggattgcatgtcctcgccttcagaggactgcacgtcctcaccttcagagggctgcacgccctcgccttcagaggagtgcacgtccttgcctctagagggctttacgtcctcaccttcagagggttacacaccctcatcttcagagaactatacgtcctccctttgagaggactacacgtcctcgccttcggagggctacatgccctcgcctttagaggactacacgtcctcaccatcagaggactacacgtcctcgccttcaaagggcttcacgtcctcaccttcagagggttacacaccctcatcttcaaaggactatacgtcctcccctag

SEQ ID NO: 40432 - DNA, 72 bp, Glycine max
  Peptide Sequence Number=SeqID_132117
atgacgcctgatgcttgtggctgtcctttgatgttcttcgacaaatgggtgaagatttgtgataccgggtag

SEQ ID NO: 40433 - DNA, 643 bp, Glycine max
  Peptide Sequence Number=SeqID_132118
attggttggtgtgcctgaggacgcagttagattgagcttcttctcattctctttgtctggagaggctaaaaggtggcttcatttgttcaaaggtaatagtctcaagacttgggatgaagtagttgataaattcttaaagaagtacttcctagagtctaagacagctgaaggcaaagctgccatttcatccttccaccaatttccagacgaatctttgaggggaaagatcaaattgaagaccccggaagaagcgatggaattaatagggaacatggctgctagtgaccatgcaattctgcgtgatagagcccacattcctaccaaaagaagcctgctagagctttcatcacaagatgcattgttggcacaaaacaagttgttgtccaagcaattggaagcattgacagaaacactaaagcacatgagtccgactgctgtattccccaagaagaaacaccacaagaagtcaactgcatggggaacaagccaagacaaaatttcaatgcagggacaatggaggaatcaccctggaaaccagttcaacaaagaccagggtggtccatctaacaggccacaaaacaaagggcctagtctctatgatcgaacaacaaagctggaagagaatcttgctcaattcgtgcaa

SEQ ID NO: 40434 - DNA, 419 bp, Glycine max
  Peptide Sequence Number=SeqID_132119
gaaaagcgaaacttgccaaggagaagttcaagttagccgctacacacatccggaaggagtatgccgaattacgggaagagaatgcaactactacaagagcccttgaacaagagaccaagagggctcgcaaggaagagtatggccgtaacaaatttcgcggagctctgtggggtagcaacagtgaactcaagctgcgaagggaagagagggacgactcgcgagcatatagcatggtcttgaaagaggagttagttgcctgttcaaggtccaaaaggagtttgtctcagcgtttatgcgagacagagaccaacatgctagctatcatcgccaagtacccagaagagttaagtctagccacggcccacgagcatagggtcgcggacgagtatgcccaagtatacgcggaaaaagaaggctag

SEQ ID NO: 40435 - DNA, 270 bp, Glycine max
  Peptide Sequence Number=SeqID_132120
atgatgcatcctactcctcaaggatattggatagaagactccaagaggattgagctagatcttctaaagaagaccctagggaatcttctaaaggaagcttctcaaggaagtttctcaagaaagcttctcaaggaagcttttcaaggagataagcctctagcttctcaaggaagcttcaaaaagaagcttctcaaggaagtttctcaaggaagcttctcaaggatgtttctcaaggaagtttctcaaggaagctacctaggctataaatag

SEQ ID NO: 40436 - DNA, 249 bp, Glycine max
  Peptide Sequence Number=SeqID_132121
atgtgggcatgggaacgatgcacgactttggctccaaagaggactcctcccgtgatacaaaataagccactcggacacaggtggttgcgacgtggaaatcagcatattgggaatgatgatctaattgtatttcgtcgcaagttggatatcatgaaacgacatgagtttctgtgggagccttacacagcaactgttatgttgttgttgcctccgatatgtttggttggtagcgtagtgtggtgcacggtg

SEQ ID NO: 40437 - DNA, 255 bp, Glycine max
  Peptide Sequence Number=SeqID_132122
atgacggagagggagatgatcacaattatggtggatacgttgcctacattctactatgaaaagctgataggctacatgccaactaactttgcggacctcgtcttcgccggagaaagaattgaatcaggactgagaaagggaaagttcgaatatgcctccaacacggccccaataacaacagaagagccccagtggtgggcacgaggagaaaagaaggagatacccacgcggtcaccaccgccccaacatggatga

SEQ ID NO: 40438 - DNA, 233 bp, Glycine max
  Peptide Sequence Number=SeqID_132123
cccatgggctcgaaatctaccctaaggctcatgagaaccctagggccttcccttggatctctagcccaatctacttagagtcttctatccaatgcccttgcggggtaggattgcatcacctccctaggaagggaccagtcactagagccatgagcaagaggctccaagaggattgggctagagctgttgaagaaggccctagggttctcatgaacctcagggtagatttctga

SEQ ID NO: 40439 - DNA, 339 bp, Glycine max
  Peptide Sequence Number=SeqID_132124
atgaagaaaagagatacaggccatcaaagtgtgtcattggagaataagacagaagattcaactgtgctgaagataggagattcggctaaagttgtgataaaacaagacatgaagggaagaaagcataaatatgggtttaacaacaataaacgtgagaagacagagaagaaaagggtgaaaattacattagacgatgttaatcaattctccttcatcatgatcatttcgattagcatgaacgtcgtcagcttcttcttctctgacaatgttacgagtgatttgagcggtcaaagtgatggaagcttgcttgtggagattctatggaggctggatctttga

SEQ ID NO: 40440 - DNA, 243 bp, Glycine max
  Peptide Sequence Number=SeqID_132125
atggcgaggacgtgtagtcctctaaaggtgaggacgtgtagcgctctgatggtgaggacgtgtagtcctctcaaggcgaggacgtgtagtcctctcaacggtgagggtaacgagtacccaagccctctcaaggcgaggacttatagtcctctgttaggtgagggcgtgcagccctctggtggtgaggagtgtagtcctctcaaggcgaggacgtgtagtcctctcaacggtgagggtaactag

SEQ ID NO: 40441 - DNA, 557 bp, Glycine max
  Peptide Sequence Number=SeqID_132126
cggacgatcactaagtggggatgctccctccagcatgagcgaaccttttcgaaactggttaggaatgggcgtcactatcccagccctgatccagccagaagaggaaatcgcaatgcatcttgctcagctggcaaggcgtagcttggagtgggagtgtagcgtgggtgccggaggtcccccagttcctcggcagcacctcgaggtgcatttagttgtcttacatgagactcgggatattcctcactccatggcatggcacctttcgctcatccattccgcccgtccagacgcggcgccctttttcattatcatctaccgccctttctttcctcccggctattcacgcatgaagatcgtcgtatgtatgctcgacttcggttgccggatcagtcacccgggcaaaccaaccctcctccaagaagaattgtgctatgccctcccgatccctatagagcgaaagagctgcctggtgatccctaggttgcagcacgtccggtcgttaactcctcgcgccgctgccgccgtttctaggaccgaccgacgcctcgcctgcacag

SEQ ID NO: 40442 - DNA, 279 bp, Glycine max
  Peptide Sequence Number=SeqID_132127
atggatacaaacttggggtacattatctcaagtcagatttctatgatcgcacagcatgactcctcacggcttggttttcctgccctcatcactaccctgtgcaaggccagaggtgtcacttctgattcgctatcttttgagagcctcagcccagccattaatttggcttatgcgaagaagaatttttggaacctcgatgacctcgcaagttcgctgagccatcctcttctggctgaacacatgatccacaggtcgcagcatgattggctgagcgcatag

SEQ ID NO: 40443 - DNA, 315 bp, Glycine max
  Peptide Sequence Number=SeqID_132128
atgacgttgctatttagtaacattctgcccggcgaccataatgccaatcttcccttcagatgtatcgagttggtcatgtgccgtcatgacatagggatcgcgcccacaagacacccagtggacccgaagaagtccaacagagccctagggtttccagctctggttacgggcctctgtcagtcctacagggtgcccgttcccccagcgaggtcatgccatcgtgacataggaatcaaacccacaaagacacccagtggacccggagaagtccaacagggccctggggtttccagctctgattacgggcctctgtag

SEQ ID NO: 40444 - DNA, 294 bp, Glycine max
  Peptide Sequence Number=SeqID_132129
atggtagccataaccctagccaaggttcatcaacctccatttcttctagaatacgactcgaatgcaacatgtgcttgtcacggagaagccccggggcattccattgagcattgtaaggctctgaagcgtaaggtgcaaggtctaattgatatgggatggctgaaatttgaggagaatcgcgtgattttcaactttcaccggaagtgggtgcaagccattggtctgtttgctcaagcgatctgtgaccattcaatcagagattactcgtcttgcatgttggtggggctgccataa

SEQ ID NO: 40445 - DNA, 204 bp, Glycine max
  Peptide Sequence Number=SeqID_132130
atggaggctggatctttgagcttcaataaggtgaaaaagaggctaagtcatgaagtgctaaaagtgatagttgagcttagctcatctattgggctaagcgtgtatccaccgctaagcgcagcttcagtgctcatagcacgacagaagaatctagcagagcatcaatgtcaaggtcgcgcgctaagcgcgagatcagtgcgctaa

SEQ ID NO: 40446 - DNA, 552 bp, Glycine max
  Peptide Sequence Number=SeqID_132131
atgaacttatcaaaaagaaaaggaaacgctttacggcgcccttaccaaactcgtgctagagctagagtaatgggtgaagcagagaaggtgcaagagaagatgaaggccaaaaatggaggccataaaagagcaaatggccacaatgataaaggccatgatgagcatgaagaagataatggaagccaatgcgctgacttcgagccttggctcggatatgccactgaagggcaagcagttggtggtataccctttgaaaacactttggagggccctcagtttcgcccacaaccacaaccattgcgttttgtggtgggaagagcccctcctgctatggccgaaaagggaaaggcggatcatctaaaggaaaggctcagggccattgaaggaggtgaagattatgcctttgctaacctagaagagttgttcctaatacccaaacatggtcattcccaagttcaaggtgccggactttggcaagtacaaggggactactcgctccaagaaccatctaaagatgtactgtcggaagatgggggcatacgcaaaagatga

SEQ ID NO: 40447 - DNA, 382 bp, Glycine max
  Peptide Sequence Number=SeqID_132132
caaccccttaaggctagtatgcaagagaagactagctccataaagtgctttaaatgtcttggaagaggccacattacttctcaatgccccaccaagaaaaccatgattatgaggggccaagacatttataatagccaagatgaggctacaacttcacctttctccagtgaaagtgaagaagcaaaaggggaagactctagtaaagagatctaccccaaagaagaaggacaacctttaatggttaaggaggagtgtaaggagacacttgttagcattgccacacctcttaggcttgagtttattcctcaagtaaaggaattattggatgagggtttggttcgcaagagcttaaatccttgtgctttgttggtgcccaaaatag

SEQ ID NO: 40448 - DNA, 539 bp, Glycine max
  Peptide Sequence Number=SeqID_132133
atggggacaaatcaaactggcaaaaggttttatcaagtcaagattaagggcctagatatcaccagcattaaggagttggggcggttgatgggacctccccaaatgcaagccttccacaaggcatacggaaagatcttagatttgaccatagcagagatatccacagaagccattgcatcactcacccaatactatgaccagcccttgagatgcttcacgtttcttccttccttgagcaaaattgcaattgtggtcagggatttggcgaaaggattggaccgcgtaaagcaaactcgaaacggtatagtgggcctaccacgaaagtacttagaaggcaaggcgagggatatagcgaatcaagaggagtgggtcctgtttatggatgtattagcattgctaatctttggggttgtcctttttccaaatatggatggtttgatggacctagccgcaattgatgctttccttgcatatcaccatagcaaagaaagcccggtggtagctgtcttggcgaacttatttgacacattttatcgaag

SEQ ID NO: 40449 - DNA, 213 bp, Glycine max
  Peptide Sequence Number=SeqID_132134
atggatgagggtttggttcacaagaacttaaatccttgtgctttgttggtgcccaaaataggtattattaggcaacaaatccctaaaataggtggtatgatgaatgttttgagtgcaccactcattgagttggtgaggaaccatgatccttcattggaacattcccaggtgttgaggaaaaaagcccaaagtttcaagaacctcgggatttga

SEQ ID NO: 40450 - DNA, 830 bp, Glycine max
  Peptide Sequence Number=SeqID_132135
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccgcaaaaaccgcaagacaactaatagctctatcaccaataccacgacgtggtgtgttgataattcgacgcagactcacgtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40451 - DNA, 378 bp, Glycine max
  Peptide Sequence Number=SeqID_132136
atgggagaactaaattacttcctgggattacaaatcaagcaaactaaagaagatgatcaatgtctatggtacacctctcaatttttttctaggatcatcttagaccctaagtacgtagaccctgatttctttaatgatgagacatttgactgttatcaagtgtttcaaaactctggagtggttgattttatgtccttaaaattgccttactatcctgaacttgttaaagtcttttactgcaatttaaaaattcaggatggtattatttcttctaaggtgcatggtatttctatgatcattgatcaatctctgttcttttcattgactagattagccagtcaaggtgcaccttttgagggcaccattgttgatgactag

SEQ ID NO: 40452 - DNA, 96 bp, Glycine max
  Peptide Sequence Number=SeqID_132137
atggagagccatgaggtcaagctacaatttggactacaacaagatatccctgttgatcccatgaatcttgatcgacttcaccaaattgacatgtga

SEQ ID NO: 40453 - DNA, 597 bp, Glycine max
  Peptide Sequence Number=SeqID_132138
atgtcccccattttcaaagggggacatgccctcacctttagaggattgcacgtcctcgccatcataggactacactccctcgccttcaaaaggccaccccctgatgttggaggagggccaactgtgcgagtacaaccagagagggaggctatcacacagctactatgcataccagggcaagatttcacccgtgccgctgcaaagagacgagtgcggatcatgcgcaccaacatgaccactcttacacagatagagatgacattgctacttagcaacattctgcccagcgaccgcaatgccaatctctccctacaaaagtatcagttggtctgtgtcgtcccgacatggggatcgcacccacaaagacacccagtggacctgaagaagtccaacagggccctggggtttccagctctaaagttacgggtctctatcagttcaagggagtgcctgttgcccccagcagggtcatcaggccccctaccaatcgagttttcatctagaagtgctgcgtctccaggcaggcgcagggcgaaacaccacagcagcctggggatggccggcagcgggcaacagacgcaccgccatcacctctag

SEQ ID NO: 40454 - DNA, 204 bp, Glycine max
  Peptide Sequence Number=SeqID_132139
atgatcctttttggtaacctggttcagcctcctatagtcgatgcagactctccaactattctacacccgagtaggaatcagctcctcctttttgtttctgatcacgatgaggccgattttcttcgagactacctggacgggactcacccattggctgtcggttggttacctccttcttcactacgtcaagaatcaccaggttga

SEQ ID NO: 40455 - DNA, 264 bp, Glycine max
  Peptide Sequence Number=SeqID_132140
atgaagtggaagatcaccagcacaaagcggcatggtcaaatgaggaacaagcaacacaggggagttttgttccacatgggcgacaggacatactcaacacgacccttggctgacctgagcatccaggccgtgttcgcgtcgcaaggacaggttgtcagaacatatatgcctcacgctgaggtccctattcctacatcagatgttcattatcttgagcaggccgttggcacattcgtcgcatggccagcacatcttgttaggtaa

SEQ ID NO: 40456 - DNA, 416 bp, Glycine max
  Peptide Sequence Number=SeqID_132141
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaggaactactgctcaatgcaaattagtaggtggagtgtatgatgaggaagtcgtgtccagaactgtttggttcaagcggtttgcgtattgggcgctagcggagtgtatactggcttactatgttggcactgatgagggtgtcagtgaagtgcttcatgtggcaggagaaaaaaaggctgcaccggtgcgtcagcagaatatgtga

SEQ ID NO: 40457 - DNA, 147 bp, Glycine max
  Peptide Sequence Number=SeqID_132142
atggggggtttctgggcaatttcttgcttaaagttgaagcaacctagctcgcctgggctagctgagctcgcctgggcgagcgaggttgccaccacaccccccgttttgttgaaaaatgggattccggggcttccgggacacccgtaa

SEQ ID NO: 40458 - DNA, 300 bp, Glycine max
  Peptide Sequence Number=SeqID_132143
atgcttgagtgcttggcagaacatggtatagttttagggcatatcatttccagtaggggcatagaggtagaccctgctaaaatagatgttatttcacaattgccttacccctcttgcatgcgagaggcgctttatcaagggattttagcaaagtggcccttccactatccaatctattgcaaaaggaggtggagtttgattttgatgatcagtgcaaagaggcttttgattgcctcaagcgtgccggtgactaccacccctatcattcaggcacctgattggacaccccatttgagctaa

SEQ ID NO: 40459 - DNA, 225 bp, Glycine max
  Peptide Sequence Number=SeqID_132144
atgaagtgccaaaagtgtcagttgagcttacctcatcagtgggctaagtgcgcatccaccgctaagcgcagcttcatcgcacttagagcgacagaagaatctggcagggcatcagcatcaaggtcgcgcgctaagcgtgagatcagtgcgctaagtgcagcaggtgtcttcagccaggttaaatgcacgactggcactaagcccgaatccacttatcctcactaa

SEQ ID NO: 40460 - DNA, 579 bp, Glycine max
  Peptide Sequence Number=SeqID_132145
atggtgaaagttggaacctcttacgtgccgatcaacgtctcattttcgccaaaaagttggcccagggcttcccggtatcaacagggacaccaggatttatttattcctgtcgaagtgatctgccctgcctccacagtgtggatttattcaggcataagcatcaagcttatcgataccgtcgcggggggcccgtggcgtaatcatggttctatcagctgttcctcctgttcagctactgacggggattgttatccgcgtccaattcgcacacaagcataccgagccggaagcatcagcgcggcaagtgtagcctgggtgccagacgctgcagctacactcacacccgccggcttaattgcttgccgctacagggctgcccttcgccattcggctgccaactgtcgggaaagggctgatcggtgccagggcctcttgctattaagaatcgccaacgctggcgaaagggggatgtgctgcaagttgcgattaagttgggtaacgccaggagttttcccagtcactggttactatgttgtaaaactgagacggccagtgaattgtaatacgacttcactatag

SEQ ID NO: 40461 - DNA, 198 bp, Glycine max
  Peptide Sequence Number=SeqID_132146
atgccaaagctcatggaagctgatgttcagtttgctgtgtttactggtagggaatcaccaacctgcccttccaatacagcagttgatcctgaattgaatagtgatgatcaggtgctttgttctgtaagcatagctcccttaaggcctacaactgagagtcagcttgtattgcctctttcaacaactgaattaacttga

SEQ ID NO: 40462 - DNA, 495 bp, Glycine max
  Peptide Sequence Number=SeqID_132147
gcagcggaggaagacgaagaggtacaggcccttaggacagaactcaagcaaactcaaacggtcaaagaaagggctcgtagggaagaacacggctggaacaagttccgaggggctctgtggggtagcaacaacaagcttaagctccggagagaggaaatggaccaatctcgaaccaacatgttagccatcatcagcaagtaccaagaagaactaaatctagccacagcccacgagcatagagtggcagacgagtatgcccaagtatatgcggaaaaggaggctagaggaagggtgatcgactcgttacaccaagaggcaacaatgtggatggaccgatttgctcttaccttgaacgggagtcaagaacttccccgattgctagccaaggccaaagctatggcggacacctactccgcccccgaggagatccacagacttctcagctattgccagcatatgataaacttaatggcccatataattagaaaccgctag

SEQ ID NO: 40463 - DNA, 674 bp, Glycine max
  Peptide Sequence Number=SeqID_132148
atggtgaaagttggaacctcttacgtgccgatcaacgtctcattttcgccaaaagttggcccagggcttcccggtatcaacagggacaccaggatttatttattctgcgaagtgatcttccgtccacagtggcttctgtttctatcagctgtccctccctgttcagctactgacggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttgcctgaaatcgctccaaatatccacttgcagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40464 - DNA, 262 bp, Glycine max
  Peptide Sequence Number=SeqID_132149
gtcgactctagaggatccccgtttggattggctcccgagtttgagaaccgccaaaagagaggaagttgaggcaccagaggaagatgaagaggtgcaggcctttagggtggaactcgatcaagcccaaacagttaaagaaaggttcaaatcaacggctctgaaaatccgaaaggagaataccgaactgagagatgtaaatgtggctaccaccaaagccttggaacaagaaaccaagagggctcgtagggaagagcacggctga

SEQ ID NO: 40465 - DNA, 232 bp, Glycine max
  Peptide Sequence Number=SeqID_132150
gacctcattgaagctcaaagatccagcctccacagaagctccacaagcaagcttccatcaggattggtgtcctggctctgctggtgctggatgtactgatagaagctcttgccctgctgatgggaggccggataagcttggtgggagtgaccgacactccatagaattggcacaggcctgtgatcaaagcaggaaatcccagggccctgttggacttctctgggtcaactag

SEQ ID NO: 40466 - DNA, 255 bp, Glycine max
  Peptide Sequence Number=SeqID_132151
atgtttgaacattcgattaaaaggctgccgtaccttgggacggacgtgtggggtgctaacaccttccccgtgcgtaaatacaactcccgaacctttcacttaaaagttcgtagatcacgtcttttccgatttttccgacgttttcctcaaataaacgttggtggcgactccgcgcgtattcctttcgtggaacacgcatcccgcgagtctcgcctcgccctcccgccgaagggatatggggttgaatcaatttag

SEQ ID NO: 40467 - DNA, 485 bp, Glycine max
  Peptide Sequence Number=SeqID_132152
ccgatcaggacggtgtcgaggacactgtttgtgagaaatacggcattagtaaggaaaagtgggcccagttttaccagactcgcagagacccttcttgggaggatgtgcgcatgaaggcacaggccatccagaaccagaatactgccccccacgtttttgtctcgtggggaccaagaagaagatgcaggaagctgcacagtcaggaagcccttgatggcgtcatcgaccctccatccccggtcagacgccacgtgaagtggaagatggcccgcacgaagaagacaggggagatgacgactgaggccgcaaaggaaatcgctgagaagattgattcgtttgaggagcaggccacacagggatcgttcgtcccccatggacgtcaggatgttttggtcgctgctattggacgtccagagcaccctggatgtgtccgtggtattggagccggtgtcaccatcaagcaatactttggatcggctccatga

SEQ ID NO: 40468 - DNA, 477 bp, Glycine max
  misc_feature (475)..(475): n is a, c, g, or t
  Peptide Sequence Number=SeqID_132153
atgggaacaaatcaaactggaaaaaggttctatcaagtcaagattaagggcctagatgtcaccagccttaaggagttggggcggttgatgagatctctccaaatgcaagcctttcgcaaggcgtacggaaagattttagatttgaccatagcagagatattcacagaagccattgtatcactcacccaatactatgaccagcctttgagatgcttcacttttggagactttcaattagtaccgactgttgaagaatttgaggagattctaggatgtcctcttgggggaagaaaaccgtatcttttctccgggtttcttccctccttgagcaagattgcaattgtggtcggggattcggcaagagagttggatcgtgtaaagcaaactcgaaatggcgtagtgggcctcccatgccagtacttagaaggaaaggcaagggatatggcgaatcaagaggagtgggtcccatttatgnac

SEQ ID NO: 40469 - DNA, 495 bp, Glycine max
  Peptide Sequence Number=SeqID_132154
atgaagcacttcactgacaccctcatcagtgccaacataggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgggaccgctacacttgccagcgctgatgtccggcggtgctttttgccgttacgcaccaccccgtcagtagctgaacaggagggacagctgatagaaacagaagccactggagcacctcaaaaacaccatcatacactaaatcagtaa

SEQ ID NO: 40470 - DNA, 433 bp, Glycine max
  Peptide Sequence Number=SeqID_132155
ttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgagaattgatcaagcttatcgataccgtcgacctcgagggggggcccggtaccagcttttgttccctttagtgagggttaatttcgagcttggcgtaatcatggtcatagctgttttcct

SEQ ID NO: 40471 - DNA, 342 bp, Glycine max
  Peptide Sequence Number=SeqID_132156
atggaaaacttcttcccgccgctgccggtgtactcgtgctgctccgtccgcaggccgatgttgctgagcaggatcgaattcctgcagcccgggggatccactagttctagagcggccgccaccgcggtggagctccaattcgccctatactggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 40472 - DNA, 786 bp, Glycine max
  Peptide Sequence Number=SeqID_132157
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgaaccaatcctcttagcgcagattctgatggtgatggaccttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagattcctggaagatgccaggaagatacttaa

SEQ ID NO: 40473 - DNA, 456 bp, Glycine max
  Peptide Sequence Number=SeqID_132158
atggtgaaagttggaacctcttacgtgccgatcaacgtctcattttcgccaaaagttggcccagggcttcccggtatcaacagggacaccaggatttatttattctgcgaagtgatcttccgtcacagtcggcttctgttttatcagcttatccataccgtcagctcgacgggggggcgtaacggcaaaagcaccgccggacatcagcttttgcttggcaagtgtagggttaatttcacgcttggcgtaatcatggtcatagctgtttcctgtgtgaaattgttatccgctcacaattccattcagcaacatacgagccggaagcataaaggtaaagcctggggtcttcgctatgcagtgagcgtaaagggggatgtgctcaagcgattaattggtgtaacgctcatgccggttttccagtcacgacggaaacctgacggccagctgttaatgtaa

SEQ ID NO: 40474 - DNA, 507 bp, Glycine max
  Peptide Sequence Number=SeqID_132159
atggaccctcggaggactgcatgtccttaccttcagagggctacacgccctcgccatcagaggactgcgtgtcctcaccttcagagggctacacgccctcgccatcagaggactgcatggctacacgccctcacctttagaggactacacgtcctcgccaacagagggctgcacgccctcaccttgagaggactacacgtcctcgccaacgtagggctacacgccctcacctttagaggactacacgtcctcgccaacagagggttgcacgccctcacctttagaggactacacatcctcgccttcagaggactccacgtcctcaccttgagaggactacacgtcctcgccttgagaggactacacgtcctcgccttgagaggactacacgtcctcgccttgagaggactacatgtcctcaccatcagaggggctgcacgccctcacctccagaggactacatgtcctcgccttgagagggctacacgccctcaccttgggtactag

SEQ ID NO: 40475 - DNA, 842 bp, Glycine max
  Peptide Sequence Number=SeqID_132160
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcaaacagaccatcgtcgatagaagcaatggattcaagtagcgccttgaaactttttcgaagatctgcaaacaaagcttccgattcacctgcgtctggaccaaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40476 - DNA, 189 bp, Glycine max
  Peptide Sequence Number=SeqID_132161
atgactgagacaatgaacattgacaaatgcttgttatatgtcctaaagacaaggttgtcatctggttttgttccttgcacaataagccttgacaactacttgaaaggaattatttacagtgctttgaagggattcaacgatagtcaagaaagtaaattcaaggttgttgctagatggattgtagttaaa

SEQ ID NO: 40477 - DNA, 371 bp, Glycine max
  Peptide Sequence Number=SeqID_132162
aagcacaactgaagaaggtcattgcagatctggaggctgagaaggaggcacatgaagaggagatctctgagcttaaaggagaagttggtgctgctgcttggaaagaatgcgtggaaccagagaggacttgggatttaatcctaagtcctgagaaaccactcatgaaggaatttgttcctccaaaacgtgaagagccagattgtccaacattggtctacatcaaattcgaaaatctgaagagaaaggaggaagaacgaaaagctgatgtgagttcaaagatcctcagatcttttgctcttaagagatttgacatgaaagtcactgcaatagataggaggctgttccaagacatttgcaatatgacggagtag

SEQ ID NO: 40478 - DNA, 234 bp, Glycine max
  Peptide Sequence Number=SeqID_132163
atgcctttgcgggcacgcgaggcgaggctctcgggtgtgctttccaaaggaggaaatatgcgcggagtcccccccccccgtttatttgtggaaaacgtcggaaaacccgaaggaacccggtccaaaagaaaaattctaagttcgggagttgtatttacgcttgaggaaggtcgacaaaagtggggcttttgctactacgtaccctcctttggagaggaaatcagacctacgtag

SEQ ID NO: 40479 - DNA, 570 bp, Glycine max
  Peptide Sequence Number=SeqID_132164
atgactcaagagctggtagcccgcggagacaccttacggttatccgcacctcgtcattcagtgaccccaagtgtgattgacgagcagaggccaatatggtcatctgcgccctttccggagatgtcagcattttccgatggagacttttcaagtctcacaagttatccagaactacgtaggtctgagttcctcattggaggatacgtaggagcaagagcctcgcttttgtcgaccacaccgccttttgtcgccatgactcaagagctggtagcccgcggagacaccttacggttatccgcacctcgtcattcagtgaccccaagtgtgattcacgagcagagaccaaagtttggtcattctgcacccatgatacgcggagataccttatggttattcgcacctttttgtcatccagaggcggcgggcccgatgacaagcagagaccaagtttggtcattctgcacccatgatacgcggagataccttacggttatccgcacctttttgtcatccagaggcggcgggcccgatgacaagcagagaccaagtttggtcattctgcacccatga

SEQ ID NO: 40480 - DNA, 252 bp, Glycine max
  Peptide Sequence Number=SeqID_132165
atgtctggaaaagctataagagaaatcttagttaggtggttggatgaccttgtagaacaacaaggaggaggtgaagcaaaagctaaggagaatgaaacccgagacgtcgctgaagatcaaggacgaggtgaaaaagcaattcgacgtcggatttcttggcggtggctcgataccccgagtgagtggccaacattgtgtcgatcccttagaaagatgggatggtatgaatgtgtgcggacaatcgggacctga

SEQ ID NO: 40481 - DNA, 225 bp, Glycine max
  Peptide Sequence Number=SeqID_132166
atggcctttgctttggctactagcatgctttgctccgtggcttctaagtgttgggccaaactcctcttggatcttgagcaagcagctaactcttcctttaagaccatgccatgtactcgtgactggtgtcgcaacctacccttcggcgggagggcgacgcgtgactcgcgggatgcgggttccacgaaaggaatacgcgcggagtcgccaccaacgtttatttga

SEQ ID NO: 40482 - DNA, 474 bp, Glycine max
  Peptide Sequence Number=SeqID_132167
atgcaatcacaaggactcgcactgcctcctaagcctgcggttggtccttcagctgctcgtgttagcacaaaggaaagttgtgttgatcccttaaggaacgatatagacacgggtgactcagagaaatgcgggttgtacatcaaagaaaatcctccccgcctggatgccctaggaaaactttatgagggttcaacaaccgttcacaacatccctttgcgccatgataaagtcaaggttggtgttgaagaagttagagatgcagatgctctcattcctatacccactgaagaggttcaattagtggggcagacacttaacaccttcgttgcttggctgacacattttgtgaagcgtttatcagaacaaggagctgtgggatcggcgaaacctacagataggccagatcatgatgtcgatgatcccctatatctgatgatattgactatcccacaactttttcttaagccgttgtag

SEQ ID NO: 40483 - DNA, 450 bp, Glycine max
  Peptide Sequence Number=SeqID_132168
atgttctctgctcaatcccgcttgcgtcatgcggtagcagacacctttgcaatggtggtctactgcaccgttgtcaatatgatgatcgaaattttcctctccggaatgacctttgagcagtcgttatcttcacgcctggtcgcgatcccggtcaacattattattgcggtgccttatggcttctatcgcgacttcgccatgcgccaggcgcgccgaatcagcacctcgggatggatgaaaaacattgctgacgtcgtcgcatatgtgactttccagtcaccggtgtatgtattgattctgctgtcggtaggcgcagactggcatcaaattgccgccgcggtcagttcaaacattctggtatcaatgatgatgggcgcagtgtacggctactttctcgacttctgccgtcgcctgttccgcgtcagcccttatcagcaagctaaagcctga

SEQ ID NO: 40484 - DNA, 414 bp, Glycine max
  Peptide Sequence Number=SeqID_132169
atgctttgcaagaatctggagtggtgtattctgctcatttatggacagctatgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 40485 - DNA, 366 bp, Glycine max
  Peptide Sequence Number=SeqID_132170
atggattcactcggtgggagttgtcccttcaacgctccaccaaaaactaaaattcatggtggaggggcacttagtcattgtttcgagggaggaggatgttctgaatccctctcgatgcggccccgcatgtctggcgtggcaatgatggtggcctgtgtgatgttagggcataactatgagtctggaatgggcttgggaaagaataatgatgacatgaccagcttagtggacatcaaggaaaaccgcggaaagtttgggctaggctataagcccacgcggactgatgtgagaagaagcatcgtagaaaggaggaacaggggcgcaggcccgcaactaaggccacaagcgagggaggaccctccttga

SEQ ID NO: 40486 - DNA, 399 bp, Glycine max
  Peptide Sequence Number=SeqID_132171
atgggtgacctagaggaagttcaagaacaggtgaaggccgacatgtcggctgtgaaagatcaaatggcttccatgatggaagccatgctagcccaatatcgcggaagtctctcaaccccgcccgatgcaaccactgctcttctctgtaggggtccgcctttggcagtggaaggaagagaaaagctcaatctcatcgaagagagattgaaagcggttgaacggttcggtgattatccctttgctgacatggccaacctatgcttagtgtcggatgtcgtcatccccacaaaattcaagcgagcttctgctaagtgcaacactcatgggctaagcgcgaggaagaccctggaagaagatgagttgtacaggttcgctaagagcaccacttcatctcactaa

SEQ ID NO: 40487 - DNA, 177 bp, Glycine max
  Peptide Sequence Number=SeqID_132172
atgcatgatgcgatcaaggaacaagccaaagtgagtttgctatgtgtaggtttcattccagaatcccaacttaaaagcaaaattagtcattccttaatccacatgggctttattgggcttgtagcgtggtcagggaaaacaaacatgctttggctcgaagggggtagcaagggataa

SEQ ID NO: 40488 - DNA, 606 bp, Glycine max
  Peptide Sequence Number=SeqID_132173
atgcaagtacaaccagaggaggaggctatcgtgcaactactatgcataccggggcaagatttcacccgtgctgctgcaaagagacgagtgcggatcatgtgcaccaatatgaccactcttacacagatatggatgacattgctacttaggaacattccgcccagcgaccgcaataccgatctccccctgcggaagtatcagttgggatcgtgcccacaaggcacccagtggacccggaggagtctgacagggccttggggttttcagctctggttacgggcctctaccagtcctattgggtgcccatccccccagcaaggatcatgcccacaaggcacccagtggacccggaggagtccgacagggccctggggttttcagctctggttacgggcctctgccaatcctatagggtgctcgtgcccccagcaagggatcgcgcccgcaagacacccaatggacccggagaagtccaacagggtcctggggtatccagctatgattacgagcctctgtcagttttacagagtgtctgtcacccccaacaaggtcattaggccccacattaaccgggctttcatcaagaagtattgcgcccccaggcag

SEQ ID NO: 40489 - DNA, 198 bp, Glycine max
  misc_feature (30)..(30): n is a, c, g, or t
  misc_feature (100)..(100): n is a, c, g, or t
  Peptide Sequence Number=SeqID_132174
atgggcaaagatttgggaagtatgggcggnccccatgatgtgcaaattcaaaacgagcacgctttcccgccatatggcttgcctctcaagtatacgccanccaatgtggcgtacactcccaatgagaatgtcaataacgccactcctatactcgttgagagccaacaagctcgatctgatcatgcacatgtctcttaa

SEQ ID NO: 40490 - DNA, 936 bp, Glycine max
  Peptide Sequence Number=SeqID_132175
atgagatcttgggtaaggggtcagtggatcccttttgatgcgaatgccctcagccagttcctgggataccctttagtgttggaggagggccaggagtgtgagtatggccagaggaggaaccagtccgatgggtttgatgaggaggccatcgcccagttgctatgtataccggggcaggacttttcccggactgctgctgggagacgggtgcagatcatgcgcaccaacatgaccaccctgacccagatatggatgatgttgttgctcagcaacatccagcccaacgatcataattccggcctccccctaccgaagtgtcagctggtgtacgtcgtcctgaaacggatgagcattcacgtggctcagttgattgctgatgccatttatctatttgcaggtatcgcgctaaccaggcaccctttggacccggataagtccaacagggccctgggatttcccgtattgatcacaggactttgtcaatcgttcggagtccccgtcgcacctagcaaggtgattcggccacccatcacctgggcttttattgagaagtattgcacgcagaggccggcccaggatgatgcaccacaagccgcagacacgccgccacctcatcaggctggcccagctgggtcatttgattcggagcagtatttacggcatttggttcgccagcaggctgccaaccaccgggcgcatgtacagactcatgactgtctttaccagctaagccttagcttgcagagccagggttttacttcttttccatgctctacttcggatcggttcagggcagaggtcgcatggcccggagattggcctgaggcccaggcaggaaaggcacccgcagaggctcccggcgaggcagatgaggcccgcgaggacgaggagatgaccgatttgcttgatttcttgggagggagcagagccacatga

SEQ ID NO: 40491 - DNA, 445 bp, Glycine max
  Peptide Sequence Number=SeqID_132176
atgcctctgctagatgccatcaagcagataccaagatatgccaggtttctaaaggagctgtgcacccacaaaaggaagctcaaaggcaatgaaaggattagcatgggcaaaaatgtgtcagcattgataggtaaatcttttcctcacattcttgagaaatgtaaggacccagatgtggtgattcatttggcaaatagaagtgttgcttaccctgcaggttttcatagaggatgtgctggttcaggcaggccatttatgaaaacagcccgaaccaagatagatgtttatgctggcacattgtctatggaatttggtgatattgttgttcattttaacattcttgatgccatgaaacatccatctgaggatcattctgtttttcgtgctgagataattgatcagattgttgatgattatatgtttgattttgattctgttgttcatg

SEQ ID NO: 40492 - DNA, 219 bp, Glycine max
  Peptide Sequence Number=SeqID_132177
atggtgagcaaaggttggagctttgatagagcttcaatggtggaggagaaagggagaaaaaagcaactcacaagaagagaaaaatctgacctttttgaaatgctaaaatcccgcctcggtttgcgtaccatttctctggttccagtccctcgcgtttctctgcacccgtcggggcccgttttcgaaagtaagcaatatatatcaaaacgctcagaatga

SEQ ID NO: 40493 - DNA, 201 bp, Glycine max
  Peptide Sequence Number=SeqID_132178
atgaagaaacaacaatggaagagaagatgcagcggaagacaaaggagaagaggtaagaggcggcgccatccactagggaataagccatggaagaaggagcttcaccaccaagatgagccttggataagaagcttggagaggatgcttcaatggaggaaaagaaagagggagagaaagagagaggggggagcacgaaattga

SEQ ID NO: 40494 - DNA, 562 bp, Glycine max
  Peptide Sequence Number=SeqID_132179
ctttgcggatctggtgtttgccggggaaagaatcgaggttggattgaagagaggaaagtttgattacgtttcctccacaaacgtgaacgccaaaagaatcggggcaacaggggcaaaaaggaaggaaggagatgcccatgccgtctcttcaacacccacgtgggtcaaaccccagcaaacacctcatggtacccatcagtacgcgcaacatcacccaagcttctcggctcatgctgggaacgcctctagttcaacacccgtgcagcctaaagcacccacccagagggaagctccccaagttccaactccgaacacaactcgaccggccggtaattccaacacgacaaggaacttccctccgaggccattgccggaattcaccccgctcccaatgacgtacgaagatcttctaccatccctcatcgccaatcatttggccgtggtaactcccggaaggggtccctcgaaccccctttcccgaagtggtatgaccctaatgcaacttgcaagtaccatgggggtgtcccaggggcattccgtcgaaaaaatgcttggcccttaa

SEQ ID NO: 40495 - DNA, 246 bp, Glycine max
  Peptide Sequence Number=SeqID_132180
atgctgtttctgcagtgcaggctcaaaggccctattgccaagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 40496 - DNA, 399 bp, Glycine max
  Peptide Sequence Number=SeqID_132181
atggctgagtatgaggtcaaatcaaaggaaagggtgggcccttttgctccaattaaactaggacatgtggcttttgcttttgaaaagaaaatgaaaaagaaaagaaaaatcattttttataaaaagccaaatcttttctctctttcttcagaaaatttcagcagctctctttcctccctccacgttgcttttcttccctcttcttctccaccattgtttccttccttgaagctccaaattcctcttcatttctaccccaaattgcaaggaaaagctattttcggagtcttggagcctacctgtacttcgtggggctttaaatttcaggtggaaaagtgtgagattttgagggttagaaaagctaaatttggggttaatggaaattggagtctaaagtga

SEQ ID NO: 40497 - DNA, 979 bp, Glycine max
  Peptide Sequence Number=SeqID_132182
atggggtcaagtcaaacgtcttcgcttaaaaagaggttctatcaagtcaaggtcaagagcctagggatcaccagtctaagagagttagggcaattgatgggtcagctccagcgacaagtgtttcgcaaagcttacggtaaaatctgggacctagccatggcagaagtctccacggaggccattgcatcactcgcccagtattatgaccagccgttgaggtgcttcacctttggggacttccagctatcacccatggtggaagaatttgaagagatcctaggatgtcctctaggggaaggaaaccatacctcttctcagggtagaggcgaatgggcctcgttcatagacatcctcacacttttgatcttcggaggggtcctctttccaaatgtggatgggttggtggacctggcagcgatcgacgcttttctcgctatactagccaatctatatgacaccttcgaccgaagatgtgagaagagcaatacaaggattgtttgttgtactccagccctctatgtatggttggtttcgcacctttttcgccaagaggtgaggcatgcttgcccgctagaaagccaccgttcatgcacagagaaaagaggggcaaattgggacggactcttagcaagcaaagaaggagcatctgtcaactggttccctcgatggaaagaaggaagaaccgggattcttatttcatgcggaggattttcaaatgttcccttgatggggacaaggggttgcattagttacaatctcgttcttgctataagacaacttggctaccctatgagaggggcaccacaagaggaaaagctcgcacctattattgcacgaggtttcaataagaccaacgtggagccacttcagaaggttcgcaaggcatgggagatggtgcaaaagaaggacaaagaactcagaggcagtaacaacgggcccatcggcgactaccgtaagtggttgaaagtccacatgcaag

SEQ ID NO: 40498 - DNA, 210 bp, Glycine max
  Peptide Sequence Number=SeqID_132183
atggtagcccgcggagacaccttacggttatccgcacctcgtcattcaatgaccccaagtgtgattgacgagcagaggccgacgagcagaggccaatgtggtcatctacgccctttccggaggtgtcagcattttccggtggagactttttcaagtctcacaagttatctagaactacgtaggtctgagttcctcattgaggatgcgtag

SEQ ID NO: 40499 - DNA, 300 bp, Glycine max
  Peptide Sequence Number=SeqID_132184
atgcagagttcacaacgcgatgtctatcttggagcctacctaaatgggttccactgtagcggacactggcagatggtggtcatcctgcccaaggaacacctagttgtctggttttgttcattgcataacaggccagacaactaccttaaggggattattaatagtgcgttaaaaggtattgatgatgctccacagcctaaatcaaaggcttctgctaggtggattgtcgtcaagaccattggagcccgagagattaaaggcattgcggatccagtgggcatagtttcatctccgagttag

SEQ ID NO: 40500 - DNA, 204 bp, Glycine max
  Peptide Sequence Number=SeqID_132185
atggtttttcacttaaggcttgtaataagcttcaaaacaaagaaaggagaacataggctcaaaggggctatcaaaggaattgattcaagagaaaaacaaggatttcaatatacagaatgccaagaaactcctatttcaaaaacaattacccattacctgtacataacctataattcaaagagaaacatgcaatgttgtacataa

SEQ ID NO: 40501 - DNA, 519 bp, Glycine max
  Peptide Sequence Number=SeqID_132186
atggagtcgtctactatcgccgctatcctgctcggctccgtcgcgggcggtgtactggccgactggcatgtcctggcggcgctgggcgtttgtccgttggtgtatgccggtgcggtcgtggctaacctgttcattccgaagctgccggtagcccgtccgggacaatcctggcgcttcaaaccgatgaccggcagtttctttaatgcctgccgcgtgctgtggcgtaacggtgaaacacgtttctctctgatgggcaccagtatgttctggggtgcaggcgtcacgctgcgcttcctgctggtgctgtgggtgccggtggcgctgggcattaccgacaatgcgacgccgacctatcttaacgcgatggtggcgattggtattgttgttggtgcgggcgcggcggcgaagctggtgacgctcgaaacggtggcacgctgcatgcctgcggggatcctgatggcgtcgtggtgctccttttctcgctacagcatgcgttattgcctgcttatgttctgctga

SEQ ID NO: 40502 - DNA, 457 bp, Glycine max
  Peptide Sequence Number=SeqID_132187
ggaacaaaagctggtaccgggccccccctcgaggtcgacggtatcgataagcttgatcgctgtgttgctattgtagcatctgcgtcgttaagagagatgataaaacctggtgctttggcaatcatttcacctattgtagttggtggcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggggacgcgccctcgtgaccgctacacttgccagcgctgatgtccggcggtgcttttgccgttacgcaccacccc

SEQ ID NO: 40503 - DNA, 539 bp, Glycine max
  Peptide Sequence Number=SeqID_132188
gtatggcctcgatcaacgtgctacgtgtcttgctgcgctaagcgagctcatcgcttctgttgaagattctggatttccagatgcacgcgctaagcgcaactgtcgcgctaagcatatggcttcccaattatatgctaacctctatgaccctaaagacaaatcgcctaagcaggtgagggtgcgagggcacctaattaaatttgatgttgacgccctcatcaccttcttgaagacaccagtggtcatagaggaaggggagagcttgcccgcctactccaagtttgctaatatgaggcttgttcctcaagagcttgcagcccgtctatgtatccctgggaggggatttgagctctatgcaaacgggctgcctctgaagattttgaggaagaatctgactactctggtccagacttggagtgttctatccttttcaaacttagctccagcatcccacacttctgacattactctggatagggctaagttgatatacgggctcgttatgaagatggatatgaacttggggtccctcatctcag

SEQ ID NO: 40504 - DNA, 911 bp, Glycine max
  Peptide Sequence Number=SeqID_132189
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgtgcgttcattcacagagtataacctttcttttgatggacgagtttggagacactgtctttgtaaagtctgcaagtggatatttggacctctttgaggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40505 - DNA, 246 bp, Glycine max
  Peptide Sequence Number=SeqID_132190
atgactaaagcacgtcaaaagggggaaaagagggagaagcttgcacctagctcgcccaggcaagcaaggttgcttcctctagaaggcaccgccttctggaggaacttcctggaaggcccaagtgggcctggttgctatttgcaccccctgtttactaaatacacccctgccttttttgctgattcttttttcgtaacgttacagaactttacgaatttcataacgatacttgttttctttccgtaa

SEQ ID NO: 40506 - DNA, 330 bp, Glycine max
  Peptide Sequence Number=SeqID_132191
atggtcgtcacagctcgaccggagagggtggtacgccagttcggttacatccagagcatcccttcgccgcctgttagtgcacgattgtcacacgatcagatagatgacaggtggatgcagtttgcgaatcacttactacctgcaggtcaggatgattatgagggatatgaggcgattgcacagaggttggagcgtgtgctcaaccttaggatagtcactgcaggcacattgttatatgacattatgcaggactacctaacgatcacgagagggggacccagtgctgatgggactgtcagggctcgtcagagacgccgcacagactattga

SEQ ID NO: 40507 - DNA, 291 bp, Glycine max
  Peptide Sequence Number=SeqID_132192
atgacgaacgacgaagaacggttgaaaatctttgcgaaatcacccacggaaacattacggaaacgaaaaggaaggagaagcttgccacccagctcgcccaggcgagctaggttgcttcctcctgaagcaacctccttctggaggaacatcctggaaggcccaagtgggcctgattacgcactatgctttcttttggctttcggcatgtctcggaacttcacgaattgcctaacgatgggtgccaagtacctcaaagtggtcaaacgagggtcgcatcccaacaatggatag

SEQ ID NO: 40508 - DNA, 381 bp, Glycine max
  Peptide Sequence Number=SeqID_132193
atggaaaagaatggtacatactttgaaagtgagcttcccaaaggaaagaaagcagtgacaagccggcttctcttcacaatcaatgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 40509 - DNA, 231 bp, Glycine max
  Peptide Sequence Number=SeqID_132194
atgggctcaaaaatctaccctaaggttcatgagaaccccagggtcttcattagtagctctagcccaagcctcttggagtcttctatccaatacccttggggggtagaattgcatcatcccctccaccttggaaaggatttgacctcaaatcctgagagtagggtaaggtctgaaaactcctttcatggatatcttcccatgagggaacatggttcctcaccaactcaatga

SEQ ID NO: 40510 - DNA, 261 bp, Glycine max
  Peptide Sequence Number=SeqID_132195
atgacgtttgaggcaacaaaggaaatcgctgagaaggtcctacagcagctgacccaacaaatcagggaccagctagaggagtcgatcacagaaaaagtgactcagcagctgatgacatctttcagccaaatgcagtcccagtttcaatcccagatgcagtctcagggacttgcattgcctccagagcctatggctggtccctcaggtcctcgtgtcatcacaaaggagagttgtgttgatccctcagggaatgatccttag

SEQ ID NO: 40511 - DNA, 192 bp, Glycine max
  Peptide Sequence Number=SeqID_132196
atgtgtgaatctggagtcgtatcctctacaggtgagcgaagatggtctccaggaacggtggttgccgtagaggtggtggcagcgcatccgcggatggctgctgctagtcctcctcctcctactgttgtgcctgaccttcatgctattcctgtctcgtctgagatcaactgggccacatggacactcccctag

SEQ ID NO: 40512 - DNA, 323 bp, Glycine max
  Peptide Sequence Number=SeqID_132197
atttcagagctccttttgagcacaaaattcgtgctcttctctccctctcccttcattcatctccttcttcctccaagctcttatccatggcctcctatggtggtgagcttcttctagactccatcttctcccttgaagtggcgtctcctctctctcttcccttctccatttcgctgccatttatcttccaagaagcaaaggaatccattgatgaagaagatcctaggcctacaagctccaatggagcttgcatcatgtggtatcaagagcatcttcatctaggtgtgttctgcttttatctttttgttaacggtgaattctga

SEQ ID NO: 40513 - DNA, 359 bp, Glycine max
  Peptide Sequence Number=SeqID_132198
gttgtctcttgcctgcccgtggattcagcagcagttcgaaaaggttgacctatatcgggaatccccggatctacgcttattttcaactccccgaaagcatttcgtcgcttactacgcccttcctcgtctctgggtgcctagttcacgagttggagataagcggactcgaaccgctgacatccgccacagggatccagctacaggagaaccgggaacggagagcttcccccgccccccttttttttccgcccgactctttgctcttaagaatactgggttctatggtcggtccgcgacccctggatgccgaaggcgtccttggggtgatctcgtagttcctacggggtggagacgatggg

SEQ ID NO: 40514 - DNA, 492 bp, Glycine max
  Peptide Sequence Number=SeqID_132199
atggagtgtgagaaaaatgcaagtcctccacttgccagccaaggctgcaacttctgggaccagcaggctcacccttccatagcaaggcctccatgcagaggcaatcaccctcacccaagtatttcaccaggcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 40515 - DNA, 237 bp, Glycine max
  Peptide Sequence Number=SeqID_132200
atggatacctcagagccctacactggggcaatgaaaggcaccatgcataatcctcaagcgaacctaggagcaggacaatccttcctttgtgttcagaattcctttacaacaaaagaccctcggtctcttaaccccttttcagaagtaagaagaagagaagaagaaatctctcttgaaagagatagattgtacaatgaagatcaatcacaattccttattgaatatgcaagtgtttga

SEQ ID NO: 40516 - DNA, 438 bp, Glycine max
  Peptide Sequence Number=SeqID_132201
atgacgtatatctccgcgtgcaaacgggcttgtcgatcgcgattgacgaagggcgcagaagacgacgttagtctcggcgtgctatcaggcttttcttcttacagacaacaaaaagtttatacggataaccactcgggtatttccggccgtcagcgtgactcaaaagtcgcagaagacgaccgtgactcaaaagtcagtatgacagatcttgtgagcacggaagatgacggcacagaagacgacgttagtctctgcgtgctatcaggcttttcgtcttacagacaacaaaaagtttatacggaaaaccactcgggtatttccggccgtcagcgtgtctcaaaagtcagtatgacagatcttgtgagcgcggaagatgacgtaaatctccgagtgccaacggcttgtcggacgcgattgacgaagggcgcagaagacgac

SEQ ID NO: 40517 - DNA, 774 bp, Glycine max
  Peptide Sequence Number=SeqID_132202
atggccaagttggatccagacatagtcctcgaattttatgccaatgcttggcctacagaggagggcgtgcgagatatgaggtcttgggtgaggggtcagtggattccgtttaatgcagatgctatcggccagctcctgggatatcctttagtgctggaagagggtcaggagtgcgagtatggccagaggaggaaccggtccgatgggttcgatgaggaggccatcacccagttgctatgtataccggggcaggattttgcccgaactgctgctgggagacgggtgcggatcatgcgcaccaacatgaccaccctgactcagatctggatgactttgctgctcagcaacatccagcccagcgaccataattccgacctccccctgccgaagtgtcagctggtgtacgccatcctgacgcggatgagcattcacgtggctcagctaatcgctgatgccatctatatatttgcaggtatggcgtctaccaggcaccctctggacccggataagtccaacagggccctgggatttcccgccttgatcacaggactctgccagtcgttccgagtccctgtcgcacctagcaaggtgattcggccgcccatcacccgagcttttattgagaagtattgcacgcagagacaggcccagggggatgctccgcaggccgcagacgcgccgccacctcatcaggccggtccagccggatcgtttgatacggagcagtatttgcggcatttggtttgccagcaggcggccaaccaccgggcacat

SEQ ID NO: 40518 - DNA, 474 bp, Glycine max
  Peptide Sequence Number=SeqID_132203
atgacaaattctgtaagttcgaaccgacctgagaagtacaacattgcagctttcttctcaggtgttgggggaattgagttgggatttgaacagaccaacgagttcagagtggtcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 40519 - DNA, 222 bp, Glycine max
  Peptide Sequence Number=SeqID_132204
gagttttgatgataacaaagatgatgacaaaaagctcaaaagtcaagatcacttcatgataacaaagatgatgacattcaagattgagtcaagaacacttcaaggatcaaaagaaaatttgatttcaagaatgaagaatcaagattcaagattcaagaataatcaagatcaagatccaagactcaaagattcaagaatcaagagaagacttaatcaagataa

SEQ ID NO: 40520 - DNA, 117 bp, Glycine max
  Peptide Sequence Number=SeqID_132205
atgagctcgcttagcgcgcggttaaaggcggtgcgcttagcgagttcacactcgctcagcgcctctgtacagcttatccttcttccagattcttctgtgcgcttagccggaggatag

SEQ ID NO: 40521 - DNA, 353 bp, Glycine max
  Peptide Sequence Number=SeqID_132206
atgggaaccggtgttgagagaacgaagatatgggctacgtgggagtacgtgagctcagatggaggtgggcaacaggggatgagtggtacctggagatatgtcgcgggggtcaggagaccttgggggagtcaaattttgatcggtgaatttagggtgggtaattcgattcaaggcttaaaaattggaagcggaggcttaggaaaggggactgagaacattgtggaggcctctggattgattaccagcctagttttctgcctttgctctgttttgcttggctgtgatagcttgtgctgtttgaatgttgttttgcttggatgttgtggaagcttgggaggattgatggggacccg

SEQ ID NO: 40522 - DNA, 450 bp, Glycine max
  Peptide Sequence Number=SeqID_132207
atgactaccctgacccagatatggatgacgttgctgctcagcaacatccagcccagcgatcataattccaacctccccctgccgaagtatcagctagtgtatgccactctgacatggatgagcattcatgtggctcagttgatcactgatgccatttgtctatttgcaggtatgccacctaccaggcaccctttagacccagataagtctaacagggccttgggttttctggcattgatcacgggtctctgccagtctttcggggttcctgttgcgcccagtaaggtgatccgatcgccgatcactcgcgctttcatagagaaatactgcacaactagacaggcacagggtggtgaccctcaggccccagatgcaccgccaccacctcctcatgctgacccaactgggtcatttgacacagagcagtatttatggcatttggttttctag

SEQ ID NO: 40523 - DNA, 966 bp, Glycine max
  Peptide Sequence Number=SeqID_132208
ccggatttcttcttcgccggctggaattacggcatgaagatcggcggcgacgtcacgccggagaagctcgccccgttcggcatcaaaacgctggtgctgagcgagagctgcgtacaggccggcgggcggccgcagaaggccgatatgaacctgctgtatgacgatgagctaaaactcggcaagattttcggcaagcagcaagaggccaccgcgctggttgagggctggcagcgccggttggctgcgcttcccgccaggccggcgggccagccgccgctcaaggtgttcgtctatgactcgggggaggagaagcctttcaccagcggcaaatacgctatgccgacggcgatcatcgaagcggcgggcggccgcaacgtgatggacggtttgccggcgagctggacgacggcgtcctgggaggcggtagcggcggccgagcccgacttcattattctgctggattaccagaccggctcgggcgccgatgcgctgcggcgcttcctcgagtctcacccgttgatgaaattgacgcctgccgtacggcaccaccgctatctgaaactgcagctgaatgaactcgccgacccggcgctttatgctgctcgcaccgctggcgctgtcggtattgtgcgggctaatgatctggagcctgcagttggggagcgtcgcgctgtcatggcggcaggcgtttgcggcgttagggctcggttcggcgccgctttccggcatgctggacaccatcgtcgtgcagctgcgggtgcccagggctttgttggcggcaccaccacccgcaatgagctggccgatccttttttgtttgggctctcttccggtgcctccgccggcgcggtgctggtcatcacgcgcttcggcgatgcgctgggcgtactgacgttgccgctgtccgctttcgtcggcggcgttttgtccgcattggcggtgatgatcctgtttcgcgtcagccgg

SEQ ID NO: 40524 - DNA, 825 bp, Glycine max
  Peptide Sequence Number=SeqID_132209
atggccccgaggaagcttgcctcaaagaggtccaggaaggacaaggcagccaaaggaactagttccgctccggagtatgacagtcaccgctttaggagcgctgtacaccagcagcgcttcgaggccatcaagggatggtcgtttctccgggagcgatgcgtccagctcagggacgacgagtatactgatttccaggaggaaatagggcgccggcggtgggcatcactggttactcccatggccaagtttgatccagaaatagtccttgagttttatgccaatgcttggccaacagaggagggcgtgtgtgacatgagatcctggctcctaggatatccgttggtgttggaagagggccaggaatgtgagtatggccagaggaggaaccggtctgatgggttcgatgaggaggccatcgcccagctgctatgtataccggggcaggattttgcccggactgctgcaaggaggcgagtgcgaatcatgcgcaccaacatgaccaccctgacccagatatggatgacgttgctcctcagcaacatcctgcccagcgatcataattctgacctccccctgccaaagtgtcagctggtgtacgccatcctgacgcggatgagcgtccatgtggctcagttaatcgctaatgccatttatatttttgcaggtatggcgcctactaggcatcctttggatccagataagtccaacagggccctaggatttccctcgctgattactggactctgccagtcattcggagtccccgttgcacctaccaaggtaattcggccgcccatcacccgggctattagtgagaagtactga

SEQ ID NO: 40525 - DNA, 372 bp, Glycine max
  Peptide Sequence Number=SeqID_132210
atggatattttcgttcgtaaccctgttttgaagtatgatgatgaagacaaaacattgttgcttgacatagatgaggacaagtggtccgtcttcaaattggttggcattctgaaggacgacatcaagtgcacgggtgactttaagctatggtggacaagggttaatgatgttggtctaaaagagttggcctttgatagtgatgctcttgagttgacaaattttgcattgagtaacaacaatgaagtgaaattttattttaagaaaaacaatgatagaggggttgttgctactgagggtgatgttgtagcacttgatgatgaggacgaaggtgttagtaataaagttgttggggttgaagctgccatcaattag

SEQ ID NO: 40526 - DNA, 884 bp, Glycine max
  Peptide Sequence Number=SeqID_132211
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgactccggtccttccgaggtcctggccttgaaaaagggctgcaaatgctggcagacattaaagcacgctacaaccttccattgaccacagacattcacgagagttatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40527 - DNA, 234 bp, Glycine max
  Peptide Sequence Number=SeqID_132212
atgggtactccttttatcgcctttgcagaatcgcttgatatcaaataccaaggcttactgtcccggattcctgtgagagcaggcttccacctgacaacaatgtacgcgggtccatcgatcaccaggaaagctcaatgtatggtaggtccccgtgcgttagcggaacatggacgccaaagtggcaagcgcatccgccatggtttcctctcgagcagggaacgtgatggaaggtag

SEQ ID NO: 40528 - DNA, 306 bp, Glycine max
  Peptide Sequence Number=SeqID_132213
atgtctcctccacctctagaacctcacaatcactcacaaactcatctcaagctctcaggacgacttcctcttcaagctctattctctataggtggccttgttggtgcttgcacgctttacgcaactctggactgcttagcgtgcattagtgaatttcgacttagcgcgcgtcttctcgctcaacactcaagcagtgcgcttagcgggatgagccctcgctcagcaaacatgcgtagctcatccttcttccaaattcttcctcacactcagccaagggaatggtgtgctcagcggatggctcgctaa

SEQ ID NO: 40529 - DNA, 333 bp, Glycine max
  Peptide Sequence Number=SeqID_132214
atggctggtatactcttccttttgaaacagcaagatagtttaggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 40530 - DNA, 399 bp, Glycine max
  Peptide Sequence Number=SeqID_132215
atggaggtcatgaaagagaaaatggccacaatgatggaggccatgatgagaatgaagaagataatggaagccaatgcgattgcagttgccgctaccagcattgttgctaaggtgaacccgatgcccccatctgacctcaaccaaatgaatcatccaacctcggatatggtaggcaaagatttgggaagtacggatggccccatgatgtggaaattcaaaacgagcacgccttcccgtcatatggcttgcctcccaactatacaccacccgatgtggcgtacactcccattgaggatgtcaataactccgctcccatactcattgagagccgacaacctcatcatgtacatgtctctcaacccatgggggagacacatgaaattccccaccacaatctag

SEQ ID NO: 40531 - DNA, 573 bp, Glycine max
  Peptide Sequence Number=SeqID_132216
tttctgtgggagccttacacagcaacggttttgtcgatgttgcctcccatttgtttggttggtagtctagcgtggcgaaaaacaaagatgtttgtcgaccaaaacaatgcaaagacagctacattgggtgaagttgcggagacattgcagtatatggtgtcaccacaagggcggaacacatggacagttgatgatttcgtgccttatgtggagaagctgacaattttatccgaagagcaagagaggatcactgagcctgtggcacatggtccagcatcagagcgtcgatttccgccacaacagtttcacatgcttccgtccagtgtcgaaactcgaggttttgacagacgaagggagattgttcaagcggaagatttttcccaacaaatggagcagcgtggccatggaatgtactataggccaccaacattttctcagtatccttctcagatgtatcaatatcctttcgaaggtcatgacactgatatgtctgcaagcgaacattcgtatggtggtgttgcggaaacaccctcatttttcatggccgatcatgaccccttcgcagcaacatga

SEQ ID NO: 40532 - DNA, 591 bp, Glycine max
  Peptide Sequence Number=SeqID_132217
atggaaaccgatttgccactggcgtttgaccaactcatcgcacaagcactgagcgtattcaatggtggacaagacgtcgcagaggccatcaaggcgttctgttttgaccgtctggctgtcaacctgcgtgaccagggcgcaagcgcgcaagaagttgatgccgtattgtcattatcacccaatcagctggcagaagtgccgcgtcgcctgagtgcggtccaggtgtttgccaatctgcccgaagcacctgcgttggccgctgctaacaagcgcgtgtctaatatcctgaaaaaggtcgaaggtgaggtgaaagccgaggtgcaggcagccttgctgcaagagtcggctgagaacgctttgtatcaggcgctgaccgataacaagcccaaagcagaccagttgtttgaagccggagattatgctgcttctttgcaagcattagctgtgttgaaagcaccggtggacaccttctttgacgaggtgatggtgaatgcagaggatccggcattaaaagccaaccgtctgggcttgctggcgaccttgcatcaggccatgaatcgtgtcgctgacttgtccaagttggccagttaa

SEQ ID NO: 40533 - DNA, 792 bp, Glycine max
  Peptide Sequence Number=SeqID_132218
atgcataccggggcaagatttcacccgtgccgctgcagaaagacaagtgcggatcatgcgcaccaacaggaccactcttacatggatacggatgccgccgctattcagcaacattcggcccagcgaccacaatgccaatcttcccctgcagatgtatcagttggtctgggccatcatgacatagggatcacgcccacaagacgcccagtggacccaaagaagtccaacagggccctggggtttccagctctggttacgggcctctgtcagtcctacagggtgcccgtccccacagcgaggtcatgccatcgtgacatagggatcgcgcccacaagacacccaatggacccgaagaagtccaacagggccctggggtttccagctctggttacgggcctctgtcagtcctacagggtgcccgtcccctcagcgaggtcatgccatcgtgacatagggatcgcgcccacaagacacccaatggacccgaagaagtccaacagggccctggggtttccagctctgggatcgtgctcccaagacacccagtggacccgaagaagttcaacagggtcttggagttgccaaactctaattacgggcctcggtcagttctacggagtgcctatcacccccagcaaggacatcaggccccctactaatcgagctttcatcaagaagtactgcgtccccaggcaggcgcagggcgaaacaccacagcagcctggggatggccggcagcgggcaacaaacgcaccgccatcacctctagagttcacctcagctcatccataa

SEQ ID NO: 40534 - DNA, 219 bp, Glycine max
  Peptide Sequence Number=SeqID_132219
atgaagaacaaggccaaaggaaaaggcaaggaggtcgccggaaaaggttctaccggcaagcgcaagggcgcctttgacgatgacaagatcggtggcgaccgaaagagaaacaagcgaggccttgttcgaatgaaccggtgtctcctgttatttcttttggattcgttgacgtgcaaacatgagacaggtcacctttggagagtctcacgactttcctag

SEQ ID NO: 40535 - DNA, 800 bp, Glycine max
  Peptide Sequence Number=SeqID_132220
gatcaggagttactggcgggtaaacaggatgcgctgcgcttatcgctggatgagcagatccgcgcgggaattgatatcgtcagcgacggggaacagacccgccagcacttcgtcaccacctttattgaacacctgagcggcgttgattttgagaatcgccagacggtgcgcatacgtaaccgctatgacgccagcgtgccgaccgtggtctctgctgtcgccaggcagaaaccggtcttcgtggacgatgccaaatacttacgccagctcacggataagccgatcaaatgggccctgccggggccgatgaccatgatcgacactctttacgacgcgcactacaaaagccgcgaaaagctggcctgggaattcgccaaaatcctcaaccaggaggcgagagagttagaggccgcaggcgtcgatatcatccagtttgacgaaccggcgtttaacgtcttctttgacgaggtcaacgactggggcatcgccgcgctggaacgcgccatcgaagggctgaaatgcgaaaccgcggtacacatctgctacggctacggcatcaaagccaataccgactggaaaaagacgctgggttcagaatggcgacagtacgaagaggccttcccgaagctgcagacctctaacatcgacatcatctccctggagtgccacaactctcgcgtgccgatggatctgctggagctgatccgcggtaaaaaagtgatggtgggcgcgattgatgtggcaaccaacacggttgaaacgccggaggaagtggccgatacgctgcgtaaagcgctgca

SEQ ID NO: 40536 - DNA, 132 bp, Glycine max
  Peptide Sequence Number=SeqID_132221
atgcatatccaaggcaacgcttcagcctttgtagatgagctgaggtggactctagaggtggtggcggtgcgtctgttgcctgctgctggccatccccaggctactgtgatgcctcgccctacgcctgtctag

SEQ ID NO: 40537 - DNA, 204 bp, Glycine max
  Peptide Sequence Number=SeqID_132222
atggagtatgttgaagaaggaaaaatagatgattcattgcaaggagttttccctttagaacatatgaacattcaagtgaacaagattccaaaggaaatgacaaaggaaacaatgaagatcctccagaagaaggcaaatccaatgatgcactcccaagagaatggaaacttcaagagatcatcccctcgacaacattattggtga

SEQ ID NO: 40538 - DNA, 393 bp, Glycine max
  Peptide Sequence Number=SeqID_132223
atggttcaagcttttctttctcaatcaatctgtccactgactaacatttctaattgtgatcctacactcttgttctttctcatctacaaacatgctcattcaaaacttatgatttcaacacatgcttcaccccttcatgcaatcaatttacaacaccaatttcacaaagaaaataattatgtttgcactgcatactcagataatcaagtcaaactattcagtatgcttcaagacatgcatactattatctacaataaaaacacaggagtggctgaagaagtggtagtcagtcccaggactggtgtggcagggtcctctggaatatccagtaatggcgtagaagggtctgctggcatctcatgcactggtgaaggagggtctgctagctactga

SEQ ID NO: 40539 - DNA, 96 bp, Glycine max
  Peptide Sequence Number=SeqID_132224
atggggttgaaccaagcacatgcttttaaggaaaggttcatcaagtcaagcggaatagagaaggagaaagatgaatggagacgccacttcaagtag

SEQ ID NO: 40540 - DNA, 478 bp, Glycine max
  Peptide Sequence Number=SeqID_132225
aggactacacgtcctcgccttgagaggactacatgtcctcgccatcagaggactacaagtcctcgccatcagaggacttcatgtcctcgccatcagagggctgcacgccctcacctccagaggactacacgtcctcgccttgagagggctacacgccctcaccttggttaccctcaccgtcagagggctacacgccctcaccttgagaggactacacgtcctcaccatcagagggctgcacgccctcacctctagaggactacatgtcctcgccttgagagggctacacgccctcaccttgggtactagttaccttcaccttcagaggactacacgtcctcgccttcaaagggtcataggactatacgtcctcgccatcagaggactacatgttccccattttcaaagaggggcacgtcctcaccttcagaggactgcacgtcctcgctttcagaaggctacacgccctcgcctttag

SEQ ID NO: 40541 - DNA, 389 bp, Glycine max
  Peptide Sequence Number=SeqID_132226
atgactaggggcaatccaggtgatttacaaccctttgatcctgaaatagatagaacctttcatagattagttaggcatagtgtacatcctggtcatcttttgcattttgagcattctgagtattatgttgctggtgattctgaacattctgattttgagcattcaactactaattttcatactgagaacatggctcaacctccacctcgtgagaggaatcttagggagatggctgcacctgatttcacttatgaaagcttgtgcattcaatatcctgatgaaggtgttccatatgttctcaagactggactaatacatttgctgcccaagtttcatgttctagcatgtgaagatcctcataagcatcttaaggagttccatattgtttg

SEQ ID NO: 40542 - DNA, 171 bp, Glycine max
  Peptide Sequence Number=SeqID_132227
atgacgggagacgcatcaaaattcacacatatctctcccaagaaaagcggacatgtaacttatggtgacaacaacaaaggtagaattcttggtgttggaaaaataggtcttaaacatagtctgcttagtgagtcaattaactgtgacaaaggctatctggtatcatcttga

SEQ ID NO: 40543 - DNA, 381 bp, Glycine max
  Peptide Sequence Number=SeqID_132228
gggggcggagcctatggaaaaacggctttgccgcggccctctcacttccctgttaagtatcttcctggcatcttccaggaaatctccgccccgttccgagtcagtgaggaggaagcggaatatgaatcctgtatcgatattcctgctgagcccgggggcacttttctgaggcctgccaccgcggtggagctccaattcgcccctcatagtgagtcgattacaatcactggccgtcgttttacacgtcgtgactgggaaaaccctggcgttacccaattaatcgcaaacttgcagcactcccctcgccgctggcgcataatagcgaagaggcccgcaccgatcgcccttcccgacagttgcgcaaatggcgaagggcagtga

SEQ ID NO: 40544 - DNA, 294 bp, Glycine max
  Peptide Sequence Number=SeqID_132229
atgtggcagaaatcgaaaagaggtgtttttgcgcaatcccaatctggcccacttgggccttccagatccttcttccagaaggctgttgcttctggaggaagcaaccttgctcgcctgggcgagctggctggcaagctcctcccctattttgctataaatagggggaggagtgaagaagaaaagggttcagccttcttggcacttctctctctgtcgaaattgctgaggaaaattatttccgtgaagaaaatccaagccgacgcgcttcctaacgtttccgtaacgtttccgtga

SEQ ID NO: 40545 - DNA, 75 bp, Glycine max
  Peptide Sequence Number=SeqID_132230
atggcgacaagtggaaagattggaaaagcaattaaaccatcaaatagaatggacaaatgtaataaaagcatttga

SEQ ID NO: 40546 - DNA, 366 bp, Glycine max
  Peptide Sequence Number=SeqID_132231
atggcagcgcggttgatccatgatcgtgttgtaatggagtgcctagagggtgtttgggagaccctcgaaggcaatgagaggtgccgattctgtggcacaattcgacttactgctacttcattagtacatccagaggaacccgcacgcacacttcagcggcctgtggagtggatactacctacacctactccatatcgactagtggaaccagttcaagtgatagaggtgtcatcctctgaagaggatcttgaagaggacccagaagagttacctcctgaacctgctatggacgctcttgacttacctgaggatgatgagacccactcccagatgttgatttttagagtacattatgtcagcatctga

SEQ ID NO: 40547 - DNA, 258 bp, Glycine max
  Peptide Sequence Number=SeqID_132232
atggtggtgacgggtgacggagaatttagggttcgattccggagaggggagcctgagaaacggcctcccacatccaaggaaggcagcaggcgcgcaaattacccaatcctgacacggggagttaaaaagctcgtagttggaccttgggttgggtcgatcggtccgcctccggtgtgcaccggtcggctcgtcccttctgccggcgatgcgctcctgtccttaactggccgggtcgtgcctccggtgctgttactttga

SEQ ID NO: 40548 - DNA, 878 bp, Glycine max
  Peptide Sequence Number=SeqID_132233
tgataccgctataaaagaaggagatcttgtcaaacgaactggatctattgtggatgttcctgcgggaaaggctatgctagggcgtgtggtcgacgcgttgggagtacctattgatggaagaggggctctaagcgatcacgagcgaagacgtgtcgaagtgaaagcccctgggattattgaacgtaaatctgtgcacgagcctatgcaaacagggttaaaagcagtagatagcctggttcctataggccgtggtcaacgagaacttataatcggggaccgacaaactggaaaaacagctattgctatcgataccatattaaaccaaaagcaaatgaactcaagggccacctcagagagtgagacattgtattgtgtctatgtagcgataggacagaaacgctcaactgtggcacaattagttcaaattctttcagaagcgaatgctttagaatattccattcttgtagcagccaccgcttcggatcctgcacctctgcaatttctggccccatattctgggccgtggcatatcgacaaatgtcattattgttacgccgaccaccaggccgtgaggctttctcaggcgatgttttctatttacattccccgtctcttagaaagagccgctaaacgatcggaccagacaggtgcaggctcttttatcgcggaaattagacctgctattaacgtcggcttatctgtcagtcgcgtcgggtctgccgctcagttgaaagctatgaaaacaaaccttgatgctgcgactcaggcattactcaatagaggtgcaaggcttacagaagtactgaaacaacctcaatatgcaccacttccaattgaaaaacaaattctagtcatttatgcagctgtcaatggattct

SEQ ID NO: 40549 - DNA, 765 bp, Glycine max
  Peptide Sequence Number=SeqID_132234
atggcatcattggtggattggctcgccaagttaaaagtcgtcagcgaagagagttttgaagcaccggaagaggacgaagaagtccaagctctcaaaagcgagttaggaaaggcgaaacttgccaaggagaagttcaagttggccgctacacacattcggaaggagtgtgccgggttacaggaagagaatgcaattaccgcaagagccctcgaacaagagaccaagagggctcgcaaggaagagtatggccgaaataaatttcgcggagctctatggggtagcaatagtgaactcaagctgcgaagggaagagagggaccagtcgcgagcacatagcatggttctgaaagaggagttagttgcttgttcaaggtccaaaagaagcttgtctcagcgtttatgcgagacggagaccaacatgctagctatcatcgccaagtaccaagaagagttaggtctagccacggcccacgagcataggatcgcagacgagtatgctcaagtatacgcggaaaaagaggctagaggaagggtgatagactctttacaccaagaggcaaccatgtggatggatcgatttgctcttaccttgaacgggagtcaagaacttccccgcttgttagccaaggccaaggcgatggcagacacctactccgcccccgaagagattcatgggcttctcggctattgtcagcatatgatagacttaatggcccacatattagaaatcgttaggaaacttgtatggtctctcagacctgactag

SEQ ID NO: 40550 - DNA, 159 bp, Glycine max
  Peptide Sequence Number=SeqID_132235
atgagaaaatgggcccttactgccaatcaggacggtgtggacgacactgtctgtgagaaatacaacataagcaaggaaaaatgggcccagttttgccagactcgtagagacccttcttgggaggatgtgcgaaaaaagacaaaggccatccagaaatag

SEQ ID NO: 40551 - DNA, 453 bp, Glycine max
  Peptide Sequence Number=SeqID_132236
atgtttggctgtttcttgtccctgccccattttgcggtttttgctttgcctgcccagacctttcttgttgcccttgcatcctttgttgctgctgatttctgcatttctcttttgagggattggcttgcttggccacagatattgaaattaaaagattggcctccttctaatttatttgaggaacaattgcctcgtcattgtgctgagttcatatcttccttacccttcaaggaatatactgatcctcacaaaggttctcttaaccttgctgtgaagttgcctaatggttctctaaagccagacctggggccaaaaacatatattgcttatggatttcctcaggagcttggacttggtgattcagtgactaagctccattgtgatatgtctgatgcagtatgctctatttgcttatttctttcctgggctgttattttcaaggatttcttctaa

SEQ ID NO: 40552 - DNA, 1128 bp, Glycine max
  Peptide Sequence Number=SeqID_132237
atgggaacaaatcaaaccggcaagaggttttaccaagtcaaggttaaaggcctagatacgaccagcatcaaggaattaggacgggtgatggaacctctccgaatgcaagccttccgcaagacttacggaaagatcttagatttgaccatagcagagatatctatagaggccattacgtcactcacccaatactacgaccagcctttgagatgcttcacgttcggagacttccaattggtaccgaccattgaagaatttgaagagattctaggatgtcctctcgggggaagaaaaccatatcttttctctgggtgtctcccctctttgagcaggattgcaactgtggtcaaagattcagcaaggggtttggaccgcgtaaaacaaactcgaaacggcatagcgggcctaccacggaagtacctagaagacaaggcgagggatatggccaatcaagaagattgggtcccgtttatggatgtgttagcattgctaatctttggggtcgtcctctttcctaacgtagatggtttggtggacctagcccccatcgacgctttcctcgcataccaccatagcaaggaaagcccggtggtagctgtcttggcagatttatttgacacatttgaccgaaggtgtgagaagagtagcgcacggattgtctgttgcttgcctgctctctgtgtttggttggtttcacacctgttccagcaagacacgagacacccgtgtccgcttcagagccatcactcgtgtaccgaaaagaggagaatagattgggaccagcttttggctgggataggaggtagaacaatcaattggttcccccgatggaaggaaggaaaggagggagtccttttctcatgtggagggtacccaaacattccgctgataggaacgaggggttgtattaactacaatcccgcgctcgctataagacaactagggtaccccatgaggggagcaccgatggaagaaagcatgtctcctttccttgtgagggatttcggcgcacaaaatttcaaggctatacaaagaattcataaggcatgggaaaccccgttaaggaaagatcaagaacttaggggcattcgtaatggcatcattggtggttaccatgaatgcctgaaa

SEQ ID NO: 40553 - DNA, 291 bp, Glycine max
  Peptide Sequence Number=SeqID_132238
atgaagactggacttcagcattgggcagtgatgttccttggacaatctttgatcagctcagggacagaagcatttttcaacaatgctattcacaagactgcggacttcttcctctcagttgagttttggaggatgatggagatgaatggtacagagggcattcaaacaggggaaggtttctttggtgaggttttcagccagagaagtccagcagccttgatgaggtccatgatctccttgcaatccaaggcatctcttcccagttctctttctaaagcaagtctgcgttga

SEQ ID NO: 40554 - DNA, 714 bp, Glycine max
  Peptide Sequence Number=SeqID_132239
gatgtgcgcatgaaggcacaggccatccagaagcagaatactgccccccacgttttgtctcgtgggggttatgattatttggagcagaagctcctagctgagaagaccaagaagaagatgcaggaagctgcacagtcaggaagcattgatggcgtcatcgaccctccatccccgatcagacgccacgtgaagtggaagatggcccgcacgaagaagacaggggagatgacgactgaggctgcaaaggaaatcgctgagaagattgtaagtcatgttcaactaaccattacaattatgattcgtttgaggagcaggccacacaggggatcgttcgtcccccatggacgtcaggatgttctggccgctgctattggacgtccagagcaccctggacgtgtccgtggtattggagccgcagttgacccagcagatcagggaccgctagaggagtccatcacagagaaagtgacgaggcagggacttgcagtgcctcctgagcctctggttggtccctccggaaacgatcctgagaccggtgactctgacaggtgtggcttgtacatagaagcagatcctgccggcctagttgccatggggagagtttatgagggattcactgttgttcataacactcctttgttgcctggccaagtaaaggtgagtgtggaggaggttacagatgcagatgctccagttcctgtacccattgatgag

SEQ ID NO: 40555 - DNA, 288 bp, Glycine max
  Peptide Sequence Number=SeqID_132240
atggcacaacctccaccccgtgaaaggactttaagggaaatggctgcacctgatttcacctacaaaatcttgtgcatccaataccctgatgaggatgtcccatatgttcttaaaactggactgatccatttgcttccaaagtttcatggccttgcaggtgaagacccacacaaacttctgaaagaatttcatattgtctgctccaccatgaaacccccaaatgtccaggaggatcacatatttccgaaggcctttcctcattctttagagggagtggcaaaggactag

SEQ ID NO: 40556 - DNA, 603 bp, Glycine max
  Peptide Sequence Number=SeqID_132241
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacgccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaa

SEQ ID NO: 40557 - DNA, 285 bp, Glycine max
  misc_feature (254)..(254): n is a, c, g, or t
  Peptide Sequence Number=SeqID_132242
atggggacaaatcaaaacggaaaaagattctatcaagtcaagattaagagcctagatgtcaccagccttaagaagttgggatggttgatgggacccctccaaaggcaagcctttcgcaaagtgtacggaaagattttagatttgaccacaacgaagccattgagatgcttcacctttagggacttccaaatagtaccgactgttgaagaatttgaggagattttaggatgccctcttgggggaaagaaaaccgntatcttttctccgggtttcttccttccttga

SEQ ID NO: 40558 - DNA, 216 bp, Glycine max
  Peptide Sequence Number=SeqID_132243
atgttggctacccactccaagtatcgagctacagccaagaaacccgcatcaaactgctttctcacttcttctttaattttcaaagacatttcgggtctcatccttcgtagtttttgcttaaccggggaagacccaggattcaatggaaacttatgctgcacaatgtcgaggtccaaacctagcatgtcttggtatgaccatgcaaagatgtcttga

SEQ ID NO: 40559 - DNA, 618 bp, Glycine max
  Peptide Sequence Number=SeqID_132244
atgacgacactcgctcagacatggagtgtcctctcttattatgatctcgcgcccacttctcacacatctgatgttaatcttgacagagcacgcttgatctatggcttgggggtggtttctgataccctgatatttgagtcactcagccctgcgatcaacttggcctacgtgaagaagaactgctggaaccccgctgatccatcgatcacctttccagggactcgccgcacacgcaccagagcttcgacatcagcatcagaggcccctctttctacccagcctccgtctcaaccttcttctcagagaccgcgaccttcacctgcctccacctcagcatccctaggcatgcatggtcagatgctgaggtccattcacgttggacaacagctcatcatggagaacatgcataggctatccttacacctgcagatggacccaccgctcatcactccagaggcttatcgtcagcaggttgcctggccaggagaccagccctccactgacaggggggaagagccttctggagccgctgaggatcctgcggtcgatgaagacctcattgctgacttagccagcgctgactggggcccatgggcagacttgggtggaggcagttga

SEQ ID NO: 40560 - DNA, 327 bp, Glycine max
  Peptide Sequence Number=SeqID_132245
atggagatgacaaggaaggggggagtggtgctgtgggcactccagatggtccgtggtgtcgatgggcaacagcggcggaggaagtggatgagccctttcgctttttcaatgattcagccatttgatgaagtttatggagatttcaatcgattgaatcaaaggaggattgaaaatgatgaagtttgggctttttgggagaaagaggcacgtcgaggggagtgtggctgcgcaacgctactggtttacgtggctatttatagaagatggcgttatgtaatcgattacaaggatgctataatcgattacaggctatctgttcttgtgtaa

SEQ ID NO: 40561 - DNA, 204 bp, Glycine max
  Peptide Sequence Number=SeqID_132246
atggctgatggaaaactgatagagatgaagggtagagttaacctagggatccaatatgggcaattttggatgagggcaagagtgatttcgaaaatctgcacttctatgcagaattttgctgttaaaaaaatgcttaggcatgactgtctgtggaaagggttgtacatattgggttctggaagttttctagaggagggtacgtag

SEQ ID NO: 40562 - DNA, 177 bp, Glycine max
  Peptide Sequence Number=SeqID_132247
atgacaataactgaagctacagggctccaaatgagatggttccaaaacgaggtgaaagaacaaggggtgaagatgaaaggaaggaaagaatcactctttccagcgagggcaacacacaaaggttgtgaaagttccttgatacagccaggggtgttcttgaatcactcaagaatttag

SEQ ID NO: 40563 - DNA, 273 bp, Glycine max
  Peptide Sequence Number=SeqID_132248
atgaacccaaggaacgttggtcccttgtgttcagtgttcaaccaagaagaccttctcttgaaaactgtcaccaagagtaggtctcttgaaaagctttttttgttgcaacatgcccttttgcgggcgagcgaggcgaggctcacgggtgcgctttcccaaggaggaaagatgcgcggagtcgccaccaacgtttatttgtggaaaacgtcagaaaaaccaaaggaaccgatcaaaagtgaaaattctaagttcgggagttgtatttacgtttga

SEQ ID NO: 40564 - DNA, 177 bp, Glycine max
  Peptide Sequence Number=SeqID_132249
atggttgctgttggaggaggtgggttggatgatgtagaagcaaagcttcatgatgatgacaaaggtgatgacaaaaagctcaaagatcaatcaaagaacaactcaagtaaatcaagaacaattcaagagttcaagttgagaatcaagaagaatttaagactcaagaagaaagtttag

SEQ ID NO: 40565 - DNA, 357 bp, Glycine max
  Peptide Sequence Number=SeqID_132250
atgggggatttcatcagcagactctccttccccgcatgtttgcattttagcgaagaaaacaccgagactttttcaagtctcacaagttatctagaactacgtaggtctgagttcctcattggaggatacgtaggagcaagagcctcgcttttgtcgaccgcaccgctttttgttaccatgatccaagaactggtagcccgcggagataccttacggttatccgcacctcgtcattcagtgaccccaagtgtgattgatgagcagaggccaatgtggtcatctgcgccctttccggagatgtcagcatcttctagtggagactttctcaagtctcacaagttatctagaactacgtag

SEQ ID NO: 40566 - DNA, 450 bp, Glycine max
  Peptide Sequence Number=SeqID_132251
atggcgcctaccaggcaccctttggatccagataagtccaacagggccctgggatttcccgcgctgatcacaggactctgccaatcgtttggagtccccgttgcacctaccaaggtgattcggccacccatcactcgggcttttattgagaagtactgcacccagagacaggctcaaggggatgctccgcaggccgcagacgcgctgccacctcatcaggctggccaggctgagtcgtttgacatggagtacatgcagagtcagggcttcgcttctttttcatgccctactccagaccagttcagggcagaggtcgcatggcccggggattggcccgaggcccaagcaggagaggcaccctcagaggctcccgacgatggagaggaggcccacgaggacgaagagatggccgatttgcttgacttcttgggagggagtggagctacatga

SEQ ID NO: 40567 - DNA, 417 bp, Glycine max
  Peptide Sequence Number=SeqID_132252
atgtcttcccataatcaggctactgctgaaggaaaaggctccagctacgtccccatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 40568 - DNA, 441 bp, Glycine max
  Peptide Sequence Number=SeqID_132253
gcggaatttgaaatctcagaggcttctgacagtaggacgaaaaagaagttgcttcagacagtcggcgagaaatggaggcagtttaaatcagacctcacaaggaaatgggtccttgcagccgatcaggacggtgtggacgacactcaagtgacacagggatccttcgtcccccatggacgtcaggatgttttcaccgccgctattggatgtccagagcaccctggacgtgtccgtgctgctagagccggtgtcaccatcaagcaatacttcggatcagctctacggacgtcccgcagctcttcctcgttgcctcctcaagaattgcagcagctgacccaacaaatcagggaccagctagtggagtcgatcacagaaaaagtgactcagcagctcatggcatcattcagccagatgcagtcccagattcagtcccagatgtaa

SEQ ID NO: 40569 - DNA, 246 bp, Glycine max
  Peptide Sequence Number=SeqID_132254
atggttgagagagagatgatcaccatgaggtatgacacttgccagttctactatggagaagaacgcggcacatgccgccagcttggatcagggggcaaaaaggacacactggaggagatggccatgccctttcaacacccgcgtgggtacaaacccagcaaggcttacaccttcatggtacccatcagtacgcgcaactattcaccacccaagcttctcgaagctcatgctgggaacgccatctag

SEQ ID NO: 40570 - DNA, 321 bp, Glycine max
  Peptide Sequence Number=SeqID_132255
atggaagaagaaggagctggtgtctctggtggtgctgaagtagtgagggcctctgacctcttacccctagccttccttggccctctaaatgtcactattggatcatcaagattccaacagttcttcttaatatatgccaagttaatggcagggctcaagttctccaaggatctagaatctgactggactcctctggccttgcatagagttgtgatcaaggcagggaatccaagtctggatgtatcatgttgtgcaatcaaagagatctggtgggagatgaggtaccccaaattcatgtccatcttcataatgataccataa

SEQ ID NO: 40571 - DNA, 168 bp, Glycine max
  Peptide Sequence Number=SeqID_132256
atgtcgaaccgcacttcacaaattatagagatgaccagtctcataactcatgatcaacagcggattatggcactggccgaaaggttcgacctcaaggctctgataccactgaagagtcgtgacagccctctacccctcacatatatcagtccaaccctaaaggaataa

SEQ ID NO: 40572 - DNA, 205 bp, Glycine max
  Peptide Sequence Number=SeqID_132257
atgaatattatgtcttataacattagagggcttggtagaggtataaagtgggcctctattaggagattggttgggaaacacaagatagacctcctctgtttgcaagaaacaaagagggactctttggataaggcactgtgccagactttgtggggtcaatcaaactttgaatgggaatgggtccctgctgtgaatactgttgggg

SEQ ID NO: 40573 - DNA, 216 bp, Glycine max
  Peptide Sequence Number=SeqID_132258
atggaggaagagggaggaagtgtagaagaaggaggtgctggagcctctgatggtgctgtggaagaggccttagatctcttacccctcgccttcctaggactcaatctctcatgggtaaaggaatcagagtggactccccgggctttacataaagcaatgattagggcaggaaagtcgagcctcgaggagtcatgttgggccatgagtgtaatctga

SEQ ID NO: 40574 - DNA, 342 bp, Glycine max
  Peptide Sequence Number=SeqID_132259
atgcaacgtttgttgaaccgtaacaaagaaaagccctacagacgaatagccaaatcttcctcgtttactcttaaacctctatcccctagagaaacttatcaaggtaatccttgtggcgtctacccagacttatcttccttcattggaagtggcgtctacccagacttatcttccttaaccggaagtggcgtctacccagacttatcttccttcactggaagtggcgtctaccctgacttatcttccttcactggaagtggcgtctaccctgacttatcttccttcactggaagtggcgtcatccaaacctccgtagcctgtatcaagcgatccgccccgtaa

SEQ ID NO: 40575 - DNA, 693 bp, Glycine max
  Peptide Sequence Number=SeqID_132260
atgattatgaggggccaagacatttatagtagtcaagatgaggctactacttcaccttcctctagtgaaagtgaaggagcaaaaggggaagaatctagtgaagaaatctacccccaagaagaaggacaacctttaatggttaaggagaaatgtaaggaggtaagtgtctcctccaagaggttagctaagaaggaaagttattttgaaataaatacaaatattaaagaaacttcccctcttagacaacctccacatcttctcctttgtaaaaagacacttgttagcactgccacacctcttaggcttgagattattcctcaagtaaaggagttattggatgagagtttgattcataagagcttaaatccttgtgctttgtcggtgcccaaaataggtattatgaggcaccaaatccatatgataggtggtatgatgattatgttgagtggtgcaaccctcttatgtaaaatcacccatgcgtccaacatcttcatgattctcatacataaggactcatttggggttcccacgaaccctaagagaataaaggtcattcataagtggttcactccaccaagtgttgatggaagaagcccagagtttcaaaaccctctggatttgaggtcaaatccttttcaagggggaggtaataatgcaatcctaccccccaggatattggatagaagactctaa

SEQ ID NO: 40576 - DNA, 345 bp, Glycine max
  Peptide Sequence Number=SeqID_132261
atgcgcgttgttggccagctgggccaggttctgggtccacgcggcctgatgccaaacccgaaagtgggtactgtaacccctaacgttgctgaagcagttaagaacgctaaagcaggtcaggttcgttatcgtaacgacaaaaacggcatcatccacaccaccatcggtaaagtggacttcgacgctgacaaactgaaagaaaacctggaagctctgctggttgcgctgaaaaaagctaaaccaactcaggcgaaaggcgtgtacatcaagaaagttagcatctccaccaccatgggtgcaggtgttgcagttgaccaggctggcctgagcgctgctgcaaactaa

SEQ ID NO: 40577 - DNA, 306 bp, Glycine max
  Peptide Sequence Number=SeqID_132262
atgttggctacagccagggatggggaaggtgtggatgtaggtaccggggatggttcacgtgcatcaaccgaggatggggatggtgtggatgtaggtgtaacatcgagaggcctaactggcatagacacagaagatgaggatggggtagatgatggtagactatctcgaggttgtaatagtctaactacatatcatcttttcttcgcaattgtccctttcccactagagtcatgtgataggggtcggggagggttagcaccacctgatgacatatctatatatagaaaaacatattatactgactaa

SEQ ID NO: 40578 - DNA, 222 bp, Glycine max
  Peptide Sequence Number=SeqID_132263
atgacacttatgcatggcagtggaaaaatggcacgcagcgtgtttgctccgtgcccctatttaagggacctatatgggagagagctaaaaaggtttttagtcataatcccaaaggtggtcatatctcgcttgatggtctctagaggtatcatcctcttcgaagaacatactgcagcagtagggactactagcaacaatatgttttcaaagagtaaactctag

SEQ ID NO: 40579 - DNA, 767 bp, Glycine max
  Peptide Sequence Number=SeqID_132264
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatacttggtggctgttggatactttgatcctggaaactgggctactgacctttctgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40580 - DNA, 129 bp, Glycine max
  Peptide Sequence Number=SeqID_132265
atggcctttgtggatacctgggtggtgggtaaggagaagacccacatcgatcctttcactggcaaagaccaaatcctcaaagctttgaagttgcatcctatccgaagacattatactgacactgcctaa

SEQ ID NO: 40581 - DNA, 723 bp, Glycine max
  Peptide Sequence Number=SeqID_132266
atgcgttcatgggtgaggggtcagtggattccttttgacgcagatgccctcagccaattcctgggtgacccgctagtgttggaggaaggccaggagtgcgagttcagtcaaaggaggaatagggctaacgggttcgacgaggaggccattgcccagctattgtgcacaccggggcaggatttcgcccggaccgctgtcgggagacgggtgcggatcatgcgcaccagcatgaccaccttgacccagatgtggatgacgttgctgcttagtaatgtcttgcctagtgatcataactccgatctccctctgccgaagtgtatgccacccactaggcaccctctagacccggataagtctaacagggccctgtgggttcctgtcacccctagtaaggtgatccaactgccgatcacccaggctttcattgagaagtactgcacgcctagacaggtgcagggggatgcacctcaggacccaaacgcaccaccgccacctcatcaggccgatcccactgggcggccaaccaccgggggcaggtacaaatacatgagtgtctctatcgcttcagccttagtcagcaggggcaaggtttcactccttttgcgtgccctacgccagagcagtttagggatgaggtcgcatggccgaagattggcccgaggcccaggtaggggaggcacctgcaagatccccgggcgatgccgaggaggcccgcatggatga

SEQ ID NO: 40582 - DNA, 51 bp, Glycine max
  Peptide Sequence Number=SeqID_132267
atggcattaaaggtcatggcagctcgcccaggtgagctagagctcgcccag

SEQ ID NO: 40583 - DNA, 369 bp, Glycine max
  Peptide Sequence Number=SeqID_132268
gcactccctagaactatgccacgacgacatgaacttgctggggggaacgggcgccctgtagggccgacagaggcccgtaaccagagctggaaaccccagggccctattggacttcttcaggtccactgggtgtctttggggagattggcattgcggtcgctgggcagaatgttgctaagtagcaatgtcatctatatctgtgtaagagtggtcatgttggtgcgcatgatccgcactcgtctctttgcagcggcacgggtgaaatcttgccccggtatgcatagtagctgtgtgatagcctccctctctggttgtgctcgcacagttggccgtcctccaatatcagggggtggcccaggaatccgttaa

SEQ ID NO: 40584 - DNA, 598 bp, Glycine max
  Peptide Sequence Number=SeqID_132269
atggggacaaatcaaaacggcaaaaggttttatcaagtcaaggttaaaagtctagatgtcactagcctcaaggaattgggacgattaatgggacctctccaaaggcaagccttccgcaaagtgtacgggaagattctagatttgaccgcagcagaggtatttacggaagttgtcgtatccctcgcccaatactatgaccagccgttgagcaagattgcagctgtgattggagattcagcaaaagagttggatcgcatgaaacaaactcgcaatggagtagtgggcttgccacggaaatacttggaaggcaaggcaagggatatggcgagccaagagaagtggggcccgtttgcggatattttagctttgctgatttttgggatttgtttgacacctttgaccggaggtgtgagaaaaataatgcacggattgtctgttgtttacccgctctttgtgtatggaagagtcgattgggaccaacatttggctgggatagggggcagcgcgatcaattggtttcctcgttggaaggaaggcaaggaaggagttatcttctcgtgtggggactaccctaatgttccattgatagggactaggg

SEQ ID NO: 40585 - DNA, 474 bp, Glycine max
  Peptide Sequence Number=SeqID_132270
atgcgagcacaacgagaaagggaggctatcacgcagctactatgcataccggggcaagatttcaccggtgccgctgcaaagaaacgagtgcggatcatgcgcaccaaaatgaccactattacacagatatggatgatgttgctacttaacaacattctgcccagcgatcgtaatgccgatctcccccctgcggaagggtcgcgccccacaagacacccagtggacccggagaagtccaacagggccctggggtttccagctctgatgacgggcctctgtcagttctacggagtgcccgtcgcccccaccaagttcatcaggccccctattgaccgggcttttatcaagaagtattgcgcccccaggcaagcgcatggcgagacaccacagcagcctagggatggccgacagcgggcaacaaacgcactgccaccacctctagagttcacctcagctcatccacaaaaaggttag

SEQ ID NO: 40586 - DNA, 201 bp, Glycine max
  Peptide Sequence Number=SeqID_132271
atggtggtcattgtgcccaaggaacacctagttgtctggttttgttcattgcataacaggccagacaactaccttaaggggataattaacagcctaaatcaaaggctcctgctaggtggattgtcgtcaagtgtaatagacaaaaaggaagtactgagtgcggctactatgtcatgcactggatgtccaccatcattttag

SEQ ID NO: 40587 - DNA, 771 bp, Glycine max
  Peptide Sequence Number=SeqID_132272
atgacagccaccatttttaggagcgttgagcaccagcagcgcttcgaggccatcaagggatggtcatttctccgggagcgacgcgtccagctcaggtacggcgagtatatcgacttccaggaggagatagttcgccggcggtgggcatcactggttacccccatggccaagttcgacccagacatagtccttgagttttatgccaatgcttggcctacagaggagggcgtgcgagatatgcgatcctgggtgagggtgctggaggagggccaggaatgcgagtatggccagaggaggaaccgggccgatgggtttgatgaggaggccatcgcccaattgctgtgtataccggggcaggatttttcccggactgctgctggaagacgggtgaggatcatgcgcaccaacatgaccaccctgactcagatctggatgactttgctgctcagcaacatccagcccagcgatcataattccgacctcccgctgcccaagtgtcagctggtgtacgccatcctgacacggatgagcattcacgtggctcagttaattgctgatgccatctatctatttgcaggtttggcgcctaccaggcaccctctggacccggataagtccaacagggccctgggatttcccgctttgatcacaggactctgcgagtcgttcggagtccccgtcgcacctagcaaggtgattcggccgcccatcacccgagcttttattgagaagtattgcacgcagagacaggcccagggggatgctccgtag

SEQ ID NO: 40588 - DNA, 282 bp, Glycine max
  Peptide Sequence Number=SeqID_132273
atggcttcgaagaaactctccacgaagaggtctagaagagacgccgcagcagaagggcccagtgccacccccgagtttgatagtcatcgtttcaggagtgccgagcaccagcagcgcttcaaggccatcaaaggatggtcgttccacagagagaggcgtgtccagctcagggaggatgagtatacggactttcaggaggagatagctcgcagaccttgggcgccgctggtgactcccatggctaagtttgaccctgagatagtcctaggagttctatgctaa

SEQ ID NO: 40589 - DNA, 228 bp, Glycine max
  Peptide Sequence Number=SeqID_132274
atggcctctggtaatcgattaccaagggtaggttttcacgtcctgaagctatgtaattcgagtttggcctctggtaatcgattaccaatgaggtgtaatcgattaccagagatgaaaagccttgagatatcccttttacttgcatgtagtggttatgggatgcattgtgttgctaccgcagttagatctcttgtgaaagagtctacccctttccttttcttcttgtag

SEQ ID NO: 40590 - DNA, 516 bp, Glycine max
  Peptide Sequence Number=SeqID_132275
tgccggaaggtcaaggaagttggtgacctgatgacaggggagccgacgtccgaagccccggtgaacggcggccgtacctataacggtcctaaggtagcgaaattccttgtcggatgcggactacctgcacctggacagaaagaccctatgaagcttcactgtttcctggattggctttgggctttcctgcgcagcttaggtggagggcaaagaaggcctcctctgggggggccagagccatcagtgagataccactctggaagagctagaattctaaccttgtgccaggacctacgggccgagggacagtctcaggcagaagggagcttgactgcaagacccacccgtcgagcagggacgaaagtcggccttagtgatccgacggtgccgagtggaagggccgtcgctcaacggataaaaggttgggctgttcgcccattaaagcggtacgtgagctgggttcagaacgtcgtgagacagttcggtccatatccggtgtgggcgttagagcattga

SEQ ID NO: 40591 - DNA, 675 bp, Glycine max
  Peptide Sequence Number=SeqID_132276
atggcccgcaacctctccagagctcaaaagaaatccaaatcctccaaaaggaagcaagagtgctctaaggcaactctcaacaggctagatacatggttcacagatgagaacaagaagaatgatttcaagatgctttacactatgaagaatggattcaactttcccaacttgctcaaagctcaaggtctatcaaaatttatgcaaatgaaaggatacaacaagatgcagacatacagaggtatgctccttgacccatcaaggaatttgagaaaccgcctaggagttggtggtttaactgctgaatataggatgttagtgtatctcattacctacattctcgcaccaaggtccagcaatcatgtgcaagtaactaatgacaatttacaaatcgtatatgggctaaaatcagatattatgttaaagagtcgtcaattggtggattatgagtttccatatgttgtcttagcctctaaattcattgattacttcaatatcgatgtttctaacgagatagttgattccaccaaagcctctaatgagataactgaaaggcatctcaagaagcttgatatgagatatattgatcatgaatggattatggtcggagagccaccaccagcagaaaacatgaatcagatggaaaaagaagctcaacaagagcctgcacaccaatga

SEQ ID NO: 40592 - DNA, 630 bp, Glycine max
  Peptide Sequence Number=SeqID_132277
atgcggagacaaaaacttacggttatctgcgccctcgcattcagacacagccgtgtcaccccaagtatgattgatgggcagaggacaatgtggtcatctgcgccctttccggagatgtcagcatcttccggtggagattcaaatgtctcattatctagaactaccctgttgtcgaggcgcgccccagagacaaaaatctctggtcatactgcaccctttgtcatccagaggcggcgggcccgacgacatgcggagaaaaatttggtcatttcgcacccctttgccattcagacacagtcgtgtccgatggtacgcagagacaaaatttggtcattctgcaccctttgtcctccagaggcggcgggcccgatgacatgcggagacaaaatttggtcattccgcacccctttgccattcagacacagccgtgttcgatggcgcgcagagacaaaaatatggtcattctgcaccctttgtcatccagaggcggcgggcccgatgacatgcggagacaaaatttggtcattccgcacccctttgccattcagacacagccgtgtccgatggcgcgcagagacaaaaattggtcattctgcaccctttgtcatccagaggcggcgggcccgatga

SEQ ID NO: 40593 - DNA, 177 bp, Glycine max
  Peptide Sequence Number=SeqID_132278
atggatcaagctggtgaggaaagaaagttgcacctgattgagatcaaaagcgactccacaaacaagagcttcaaggtcaacggacatcgacttaagccattcctcacgaacccttctttagtggacgtagtggtggaagaaacttctttactccaccctactcttcctccaccatga

SEQ ID NO: 40594 - DNA, 878 bp, Glycine max
  Peptide Sequence Number=SeqID_132279
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattagttttcaagatcccaacggtcagactgtagaaacatatcttagggattgtcgcaacctacccttcggcgggagggcgacgcgtgactcgcgagtgcgtgttccaagatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40595 - DNA, 138 bp, Glycine max
  Peptide Sequence Number=SeqID_132280
atggagaaggagaagatgagtcaagaacaagctcatcaccataggaagccatggataagagctctgaaggtaggagaagatgagtggagggagaagcagataaggagcacaaaattttatgcctcaaatgagatatga

SEQ ID NO: 40596 - DNA, 192 bp, Glycine max
  Peptide Sequence Number=SeqID_132281
atgactaaagcacgtcaaaagggagtacggaaaaaaatgggggagaagcttgccacccagctcgcccaggcgagcaaggtggcttcctccagaagcaaccgccttctggaggaatcttccgggcccaagtgggcttggttgctatttgcacccccatttttactaaatacaccccctacctttttttggtga

SEQ ID NO: 40597 - DNA, 186 bp, Glycine max
  Peptide Sequence Number=SeqID_132282
atgcccctcattgccccagtgttgggctttgagggaacctatggggtgagaacttctaatctgcccctaggttcgcttgaggttcatgcacggtgcccctcattgccccaatgtaaggctttgaggtaccaattgttgtcttgttttcacaacctcgtagtgaggaagaatgaaagaagcagttga

SEQ ID NO: 40598 - DNA, 465 bp, Glycine max
  Peptide Sequence Number=SeqID_132283
gcctcattggaagaacaaatgagacagggtacctttgtcccccatggtcgtgaagacatactgaacactgccatcgggcgaccggatcatggaggtcgtgttcgggcagcgggttctggggtcacaataagtcaatactttggaagggtagcacgtggctccagttgctcatcaggctcgatcagccaagtacagttggctgaaataataggaggcctacaggaacaatggaaaaatgaaatacaggtattgaaacatgagttgaaggaacaaatcatacttgagatgtcacaaaggggagcgtcgatcccaacacatattcagccaaatatacatgtgttaggagcacgagtgagcacaaaagggagcaatatggagactgttgtcaactcatgtccgcctaatcatgttgctactgttgaaccgcctatggggttgtatgtccagtgccaagattcaatttag

SEQ ID NO: 40599 - DNA, 345 bp, Glycine max
  Peptide Sequence Number=SeqID_132284
atgaacatacctctgctagatgccatcaagcaaattccaagatatgccatcaagcattccagatatgccaagtttctaaaggagttgtgcacccacaaaaggaggctcaaaggcaatgaaaggattagcatgggcagaaatgtgtcagcattgataggtaaatttgttcctcatattcctgagaaatgtaaggacccagagggattttcccatggctcagttccaattattttaggcaggccattttttaaaacatcccgaaccaagatagatgtttatgctggcacattgtctatggaatttggtgatattgttgttcattttaacattcttgatgccatctga

SEQ ID NO: 40600 - DNA, 558 bp, Glycine max
  Peptide Sequence Number=SeqID_132285
gaaacatgctttacggcgtcctcaccgaacttgtgctagagctagagtaatgggtgaagtagaggagatacaagagaagatggaggccgacatggaggccattaaagagaaaatggccacaatgatggaggccatgatgagcgtgaagaagataatggaagccaatgcggttgcaattgccgctaccagcgttgttgctaaggtgaacctgatgtccccatccggcatcaaccaaatgaatcatccaacctcagatatggtaggcaaagatttgggaagggagacacaagaaattccccaccacaatctagttgacttcgagccttggctcggatatgccactgaagggcaagcagttggtgcccctcctgctatggccgaaaagggagaggtggatcatctaaaggaaaggctcagggccattgaaggaggtgaagattatgcctttgctaacctagaagagttgttcctaaacccagacatggtcattcccaagttcaaggtgccggactttggcaagtaccaggggactactcgctccaagaaccatctaaagat

SEQ ID NO: 40601 - DNA, 243 bp, Glycine max
  Peptide Sequence Number=SeqID_132286
atggtcctttttggtaacctggttcagcctcctatagttgatgcagactctccaactgttctgcacccgagtaggaatcagcttctccttctcattttttatcacggtgagggaatgtccgccaggggtccagcctatagccttcttatgcttcttgagaacaggataacagcttctcctcttgctcatcagcaaggggaggcagatataattactggaaaacttttgctatcatccaagtaa

SEQ ID NO: 40602 - DNA, 708 bp, Glycine max
  Peptide Sequence Number=SeqID_132287
atgaagtgctttaaatgtcttggaagaggacacattacttctcaatgccccaccaagaaaatcatgattatgaggggccaagacatttatagtagccaagatgaggctactacttcaccttcctctagtaaaagtgaagaagcaaaaggggaagaatctagtgaagagatctacccccaagaagaaggacaacctttaatggttaaggaggtaagtgtctcctccaagaggttagctaagaaggaaagacattttgaaataaagacaaatattaaagaaatttcccttcttagacaacctccacattttctcctttgtaaaaagacacttgttagcattgccacatctcttaggcttgagtttattcctcaagtaaaggagttgttggatgagggtttggttcacaagagcttaaatccttgtgctttgttggtgcccaaaataggtattattaggcaccaaatccctaaaataggtggtatgatgaatgctttgggtagtgcaacactcatttgtaaaatcactcgtgcacccaacatcttcatgatttgtgtacatagggactcattaggtaggaataatcaacatgaaaatacagaaaaaggggttcccatgaaccctaagagaataaaagtcattcctgagtggcctgctccaccaagtgtgttgaggaaaaaagcccagagtttcaagaacctcgggatttga

SEQ ID NO: 40603 - DNA, 96 bp, Glycine max
  Peptide Sequence Number=SeqID_132288
atggagattcagaaggagacatatttattctgggtatacctgatgtttgcaatgaatacaaaaattcaggtggcaataatgcgaaagcaggattga

SEQ ID NO: 40604 - DNA, 390 bp, Glycine max
  Peptide Sequence Number=SeqID_132289
atggcagtaatggtggcccgggtaatgttggggaacggttacgagcccaaaataagtttaggcaaggacaacggcgtcataactagcttgataagcggcaaaggaaatcgggggaagtttggattgggctacaaacccacacaggcagatataaggaaaagcgttgcgggaaggaaaaacggaagtcaaggctcgcgattaagacaagaagacaaaggaatcccgccctgccacataagtaggagctttataagcgcaggtctaggggacgaaggccaagtcgttgcaatatgcgaagatgatgctccgagtgggtcggatttggtacgaccatgccctcctgatttccgactaggaaattggcaagtggaggagcgcccgaacatttag

SEQ ID NO: 40605 - DNA, 270 bp, Glycine max
  Peptide Sequence Number=SeqID_132290
atgccgttccccaggcgaggtcatgccattgacatagggatcgtgcccgcaaagacacccagtggactcagagaagtccaacaggagtgcctgtcatccccaacaaaggtcatcaagccccccattaaccgggctttcatcaagaagtactgtgcccccaggcaggcgcagggcgaaacaccacagccgcctggggatggccggcagcgggcaataagcgcgccgccaccatctctagagttcacctcagctcatccacaaaaaggttag

SEQ ID NO: 40606 - DNA, 283 bp, Glycine max
  Peptide Sequence Number=SeqID_132291
cgatttcagcctagaaagagagatgctcttgtcccatgatgttaagcccattggagcttgtaggcctaggcttttacaattggatttccttatgctatatcttgaagatgaatggcagcggaatgagaaagagagagaggagacaccacttcaaggagaagatttgagtctagaagaagctcaccactcaaggaggccatggataagagcttggaggaagaagaagatgaataagggagagggagagaagagcacgaaattttgtgctctaaatgagctctga

SEQ ID NO: 40607 - DNA, 411 bp, Glycine max
  Peptide Sequence Number=SeqID_132292
atggagggggagcagttaatgccattgagtcagataggccgcgcagttaaacctgttcctttcaccaaggatgcagctccactaaagccccgatatccctcggtagttaaacctgttcctttcccataccgaaacagccacacagtcccgtggaggtatgcacctccaagtgaaaggaaagaagaggccaccgacatcagctcgttgtcagctaaggtaaccaatatcacggggttgagcggcgtgacctgcagcggtcgcgtgtttgcaccccccgacttgccgactcaacccacaaacgttatggggaagacaaagatggtggaagaacaaaatgacaaaacaaccctcacttcagacaaggatattcctgtaaaaggtcttccggagaaaagggatggttgcggctag

SEQ ID NO: 40608 - DNA, 426 bp, Glycine max
  Peptide Sequence Number=SeqID_132293
atggggacaaatcaaatcggaaaaaaattctatcaagtcaagattaagggcctagatgtcaccagccttaaggagttgggacggttgatgggacccctccagccattgagatgcttcgtgtgtggggacttccaaatagtaccgactgttgaagaatttgaggagattctaggatgtcctcttgggggaagaaaaccgtatcttttctctgggtttcttccctccttgagcaagattacagctgtggtcagggattcggcgagagagttggatcgtataaaacaaactcgaaacagcgtagtgggcctaccgcggaagtacttggaaggcaaggcaagggatatggcgaatcaagaggagtgggtcccgtttgcagatgtactagctttgctaatctttggtagctatcttggcggacttatttga

SEQ ID NO: 40609 - DNA, 378 bp, Glycine max
  Peptide Sequence Number=SeqID_132294
atggggatcgcacccacaaagacacccagtggacctgaagaagtccaacagggccctggggtttccagctctggttacgggcctctggatcgtgcccgcaagacacctagtggacccgaagaaggccaacaaggtcttggagttgccagctctaaatacgggtctctatcagttcaagggagtgcctgttgcccccagcagggtcatcaggctccctaccaatcgagctttcatcaagaacgggcaatagacgcaccgccaccacctctagagttcacctctgctcatccacaaaaaggtttgagtattgcctacaccacatggccgaccaataggcgaccaagtccaaagccaaaggacgcacctagttgctcatga

SEQ ID NO: 40610 - DNA, 177 bp, Glycine max
  Peptide Sequence Number=SeqID_132295
atgggtcattccatcctcagtgccaagtccaaatccgtacagccaagaacaatttctacggcttccttccagaccttaaaatttgtcccattcaatattgggatagaattcacttgggcaacatttgcagcactggtatgttattatttggccaaattgtgtcttcctttgggctga

SEQ ID NO: 40611 - DNA, 749 bp, Glycine max
  Peptide Sequence Number=SeqID_132296
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaatatttgtcagctgacatcagtcagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40612 - DNA, 228 bp, Glycine max
  Peptide Sequence Number=SeqID_132297
atgtcaaatgaagaagtgaagttgcaggatccacgatgtcggatacaatgtcctgacatcctgcccgagaatactggagttgctgtacaatgcaagataaaagtcaagtgcagaaatttttcagaagaagatagatctcctccagcatcaagccgttgcagcccagaaacgcaaatttgctatataatcatggaggctgcaagagttctgtaccaagtccgggattga

SEQ ID NO: 40613 - DNA, 1218 bp, Glycine max
  Peptide Sequence Number=SeqID_132298
atgaagatccaacggttcaaaaaacctggctggataggctataggcaggagaggatctacatccttgcacctgctgctggctactgcacgttgtcccaaggtctgggaagagaggatcgtggtgattctgacggtgctccccagtgccgaaggcctactgcatcggcacggaggcaacgggtacctgtcactattgccgatgatgtgcctgtggtacctgcggactcgcctgcggtacctactgatgagccgatggtaaatgctaacgcacaggacaccggtgtagacatcggtgcagaggctgctgcagatgaggctgagggatttcctggtgaacccaacgatccatcaatgcttacggagtgtgctgagcatgttgcagccaacatatggtccagagaggagcataaattaggcagacctgttcttacaattgaggagatggttgctgggacaggattaagtcctttgatcatgtgttcagtagacaccgacgatcaaggacttatatcctcatttgtcgagaggtggcaccgagagacaagtactttccatcttcctgtgggggaggttaccatcacattggacgatgtcgcgtctcttcttcatctgttgatcgttggcgacttccatgccttccagcctctgcacatcgacgaggcagtgctgatgttggttgagttattgatggtctcactagagacaactgcagctcgtgcttatcttcttcatcttatgggttgcaccctttttgctaataagagtgcaacccatgttcatgttgtgttcttagacgcccttggtgacctcagtcagactaggaggtatgcatggggagctattggcctcgtccatatgtacgatcaccttaatgatgctagtatcagcaccagccgacaggttgctggttacatcacgttgttacagtgcaatgctgatctggactacgacaaggtgtcaccacgtgtgtgtcggtggattgtcacaaagaagactgtgaaaaagatatatatagcgacgtacaggcaacgcctggatcgtcttaggattctggatgtctactggatgccatacggggagcaccgaccgctccgccgggggcctgttgctgtcagatacaaaccagagagggttatgcgccagttcggatacgtccagagtattcctgcacaccctgtcgattcatgggtgtcatttgatgatatagacgataggtga

SEQ ID NO: 40614 - DNA, 714 bp, Glycine max
  Peptide Sequence Number=SeqID_132299
atgagctgttccagctgggatgaacaagggagtgaaggttggcttgcaagcagagttgcgacagctagaggagggatcaccggaggaggagttggtggagtgtctggagtggctcgagccctaacccaccttggccccgagaagacaatagaagaatctgttggattccagcagtttttccggatggaagccgagccgagatgtaatggattgggcaatctgggtaatctgggaagaaatgaggctgcccaggtccatgtccatcttcatcaccaacccataaatgagtcaagcacgatcgacattgaggttaaaggtgtgagaggtaggagtgaggttgaagtagctgagaatgctccacgtcttggcctgggtgcttggccacgatggcttggtggttgggatatgtgtggaggtactgggagtaggtgtcttgaggaaagttttcaacgtctgagcattaaacggaataagcttcccccagaccctacactacttcggggcattgtcctctgggtcatagatgttggagcatgtgaggcgtctatgccattgtcttcgctggagctcgtcataaaactcattgtacatggtgggggcgagctccataatcctctctggaagaatgttccaaaggtgaacgttgtcctggtagtggagctaggcaaccttagatacaaaatgggaggagtcccaagcaagatccccccttga

SEQ ID NO: 40615 - DNA, 123 bp, Glycine max
  Peptide Sequence Number=SeqID_132300
atgtggatatgtaatgttagccacttgaacttctggcctagctatgctggtcacagagtttggatgacgccacttccagagagggaagatgagtcagggaagatgccacaaggattgccttga

SEQ ID NO: 40616 - DNA, 150 bp, Glycine max
  Peptide Sequence Number=SeqID_132301
atgggtcatgaagatgaggaggatgatgatgataacaacaataccaacaataacgatgataatgatgatggtgatgatgatgacaacggtaatgatcatgtttctcaacaacaacacacaattacacattacacattatctaaattttaa

SEQ ID NO: 40617 - DNA, 633 bp, Glycine max
  Peptide Sequence Number=SeqID_132302
atggagattgttgctgacaatattgattaccagggttgggatgatccttatataccacgtacccatgaaggactcttgaagtggaaatatgcttatctgaattcagttgattttcttttcgaggttgatggtgatcgtgagctactttttctcaatgagcggggaaagaagaaacttttggaagggaatagggttgaattcacagatggttcagatccctcactttattctggaaagataattgaatgttcttgggattttgacaaactggaatggaagtatatgcgaatcagaacagataaatcaactccgaatgagtttaatacttacaggaaggtgctgcgaagcataagagacaacatcaccgaggaagatttgttgaatgaaataagtgagataattcgccttcccatgtatgctgaccggatcagaattgatagtaaagcgaatcagcatgctaatgtcgcaaggcgaagcatgtttgacggtagcccagtcactgctactcattctactagtagctctggaaatctaccatggaaggatgaggaaggtggcaactgtgtgaactgtttggcagtggtgaaaatgtgtaaggttcagataaatggatgtggaaagaaacagtgttaa

SEQ ID NO: 40618 - DNA, 1938 bp, Glycine max
  Peptide Sequence Number=SeqID_132303
atgaaaccgtgcttgcggacaaagcctcttcttcttctgctctctctgctacttctccacaacatcacattcgttctctccgatgattccagcaggaaaaacaccttccgcgagcgcgaagcctccgacgactccctcggataccccgaaatagatgaggatgcacttgtgaattcaaagtgccccaagaatttggagctcagatggcaaacagaagttagttccagcatctatgcaaatcccttgattgctgatattaacagtgatgggaagcttgagattgtggttccgtcttttgttcactaccttgaggttctagaaggtgctgatggggacaaaatgccaggctggcctgctttccaccaatcaactgtgcattctagtcctcttctatatgacattgacaaagatggagtgagagaaatagctttggcaacctacaatggtgaagtgctgtttttcagggtttcgggctatatgatgtcagataagcttgaagttccgcgtaggaaggtgctaaaaaaatggtttgtgggcttggatcctgacccagtggaccgttctcatccagatgttcatgatgaccaacttgtccaagatgctactatcaagaattctatgtctcaaatgaatggaagtagacatgaagccaaatcttcagctgccacatcaacagaaaaccaccttgagacaaaaaatttgtccaatcctgagccagaaaagaaaataaatggtagtcaagtagatgagagtattaaggtgcctaatcctgagccagaaaagaaaataaatggaagtcaaatagatgagattattaaggtgcctaatcctgagccagaaaagaaaataaatggaagtcaagtagacgagagtattaaggtgccaactgttgtggataattcctctgtgaatgctgggtctctggaaactgttcatgctgataataaaaccagcactgggagacgtcttctggaagataacaattccaaaggagcagtgcaaggcagttctgaatccaaagttaaagagggtattcatgctgcaactgtggaaaatgatgaaggcctggatgcagatgctgattcatcttttgagttattccgtaatagtgaagatctggctgatgagtatagttatgattatgatgattatgttgatgaaacaatgtggggtgatgaagaatggactgaagttaaacatgaaaaattagaagattatgtgaatgttgactcacacatcttgtgcactcctgtcattgctgatatcgacaatgatggtgtttcagaaatgattgttgccgtttcttatttctttgatcacgagtattatgacaaccaggagcatcggaaagaactgggtgatattgacattgggaaatatgttgctggtggtattgttgtttttaatctggatacgaaacaagttaaatggactgcagaacttgatctgagtacagatacttcaaacttccgtgcctacatatattcttccccaactgttgtagatttggatggtgatgggaatcttgacattcttgttggaacttcatatggcctgttttatgtgttagatcatcatggtaaggttagacaaaagtttcctcttgaaatggctgagattcaaggagctgttgttgcggctgatgttaatgatgacgggaaaattgaactagttacagctgatacacatggaaatgttgctgtatggactccaaaaggagatttaatatgggaaaaacatctaaagagtcttattccacaggtagagaaaaacataaggggaagtggatgtatcactccagttctatatttggttcacttccctttggctttaggcattctcttggatgtgttggaagatgaaaagaggcttaaagatgaagagattgagcatgctacaatagaagagtccatgcagcaatgtgctggcctccaatga

SEQ ID NO: 40619 - DNA, 111 bp, Glycine max
  Peptide Sequence Number=SeqID_132304
atggcgctaagcgcgccttcgagatttatggaacctaataggcgaagggcatacgcgaatgatgcactttcaatgaccttggctcagatgaccgaagttatgcaagcatag

SEQ ID NO: 40620 - DNA, 249 bp, Glycine max
  Peptide Sequence Number=SeqID_132305
atggcgaacgtcatggtaatgaaggagatcaagggcacggtgctgcgtctcggtgttgatctcttcactctcgatctcgacgccattcgcctccctcccggcgaagattgcagcatcgccagtgatgacgaggtggtttaccgagaggagaatctcgagtttgagtctggatttggtaacatcattatcgtggataacctccttgtggttccgagggagaagtttgagaagctcgaaggagtggtttga

SEQ ID NO: 40621 - DNA, 564 bp, Glycine max
  Peptide Sequence Number=SeqID_132306
atgcggttggctagctcatcctccttcaacgaagaaatcaagcaaatctaccatatctccatcatcctcaactccaccttcgtccccttaggcatctccttgagcatatgtaggacatgcctcctccaaaaaattaggcctatccccaggtcatgcgacagtggctctgaactgctcgggagtaggccatggccaaatgatgcatgtacacgagcatatggagctccatcctttgcatgtgagctgagatggactctagagatggtggctgatgtggaggcggtggtggtgtgtctatggctggctactgctgttggtcttgccccgactgttagacctatgatcaatgttgaaaatcccagtgccctgttggacttatctgggtctactggaccaactaacatttgggtagagggagatcagagttatggtcactgggaaggtgttactgagcaggcacatcatctagatttgagtcagagtggtcatgctaatgtgcatgatccatacccgcctccctgctcgctccgtgaaaaatcatgtcccggagagcaaagtagttga

SEQ ID NO: 40622 - DNA, 261 bp, Glycine max
  Peptide Sequence Number=SeqID_132307
atgaacgggctaagcgcacctgctgcgcttagcctgttcatcgcaactgttaaaattttggatttccagatgatcgcgctaagcggaccatcgctaagcctggcctgtcaagctaagcaccactttgcttctgtagtcagtcctttgaataaggctaagtgcagctactgcgctaagcccttgttgtgtgtcgaggaggttgagctaagcgtgccctgctgtgctaagctcaactctctcactgtttttgagtttttgtag

SEQ ID NO: 40623 - DNA, 213 bp, Glycine max
  Peptide Sequence Number=SeqID_132308
atggaggttgaggaatggaaggtggtgatttttgtggcgaaagtggaggcgcataatgtagctccatgtagagcttgtaggccttggatcttattcatcactagagtcctttgcttcttgaagatcactggaggcattggatcttcttcatcagtggcaatggggtgtagcaagcaaatgctcaactcccccttaggctggtctgaaatttaa

SEQ ID NO: 40624 - DNA, 705 bp, Glycine max
  Peptide Sequence Number=SeqID_132309
atggggtcggaccaagcgtcgtcttttaagaaaagatgcttcacttttggggactttcagttagcaccaaccataaagaagtttgaagggatcttaggatgcccgataggaggaaggaagccatatcttttttctgggtactattattctatggcgagaatagcaggagtggtcaagatctcgaaacgagaattagatcaagtaaagaaaagtaagaatagagtagcaggaataccagggaagtacttggaggagaaggcagaaactctagtgcgccatcagaggagaccatcgcctttcataatgcgaggtttcgatgaagctaatgcgaagatacttcagaggatctgtaaggcatggaataaagtgggaagaaaagataaagaacttaggggaagtagcaatggtgtcataggcgactatcacaaatggttgaaatctagaacgcaagggataacttggctccaaaagctaaagtgtctgaatggggaagaggcagaagtgcctgaggagagtgaagagatgcaagctttgaaagctgagctcgaaaagacaagagtagcaaaggagaagccgaaggtggcagtcactagagttaggaaagaatgtgatgagttgaaagatatcaacatgaccacggctgaagcgctagagcgggaaacaaaaaaagctagaaaggaagagtggagcaggaacaagttctaa

SEQ ID NO: 40625 - DNA, 56 bp, Glycine max
  Peptide Sequence Number=SeqID_132310
atggcaagaatgaaaatagagcacgatagcgtgagaggtgcgacaacgatagtgcg

SEQ ID NO: 40626 - DNA, 159 bp, Glycine max
  Peptide Sequence Number=SeqID_132311
atgaccccttcacagcaacatgatgccccaattccaacacctaacaccccattaggtattgatttgcgtgaccaattttctactgaggctaacgaagtagaagcggggagacatcggggaagaagaaatcctgatcgccaagtgcgaagatgggattga

SEQ ID NO: 40627 - DNA, 508 bp, Glycine max
  Peptide Sequence Number=SeqID_132312
atgcaaaccgccagtcccattggcgagtttgccctggctacgacacgtggcgtttgtagtggtctcgtcactgtcattgacgatttggccatgcaaaggggtctagccacgcttttcaaactgggaatcaccaacaccactggcgacttgtgcttggatggtatcgccaacaccactggcgatttgagttcgttttatgaatccctcccccctaaacacacgaagcacattcagttaaacgcaagaagcacattgacttggccatcaaatctgtctcataaaaatgacgatctcgaactcattcaccgttggatcgtagtgaaatttaaaaagcatgtttgcaacccatttccaaacattctcaccgttgggaatttcgatatcacggagaaaaaggaatcgcatgaagatagtccaaatggaggctttaatcctttctccgtttctctgacgtttgggaactctatcggagcagtcggaggaaaaactggaggaatcttaggaaacc

SEQ ID NO: 40628 - DNA, 471 bp, Glycine max
  Peptide Sequence Number=SeqID_132313
atgaacacttgtgcatcaagagtccttctaaaacctcaaagaggagagacaactttgttgatcactgatatgacaaaggctaatgtttctctcccaataaccataaaatgggatgaggtaactcttcctaaaaaatggatcatggacaaggccacaccgtcagtccccagacccgctccaaccatagaacaaatcaagcagaataattctgataaggtagaaataaccttcaaaaggagaaactctttctcatttaagatagaagcctcaagatccgagtatgaatcggcaagaaggtctttctcgaaattaagaaacctcaacctagaaccatccatagaagagcagattaataatctactcattgaaacctcagagaaagaaaccgaagatgtatcctctgaagaaaatcttaacctaattcaacgggatgatcaaccaccatctacagatgatgaagatacccaataa

SEQ ID NO: 40629 - DNA, 282 bp, Glycine max
  Peptide Sequence Number=SeqID_132314
atggagatggtgattaataatgagacaaacctccacggaaagcgttggagggaggcacttcgggaggctgctggcatttcgggggttgtagtcctcaattccaggtgtcatactagtggtaaatcatttccatcgagggtggtaaacttgagtgtccaccgagtttacttagagtttatagagtctactcagaatatgctaaaaaagagtttacacatgagtcaactcacagagaagatcaacgaagaggaatcaaacagacaaaagaagttagaacaataa

SEQ ID NO: 40630 - DNA, 663 bp, Glycine max
  Peptide Sequence Number=SeqID_132315
atgagcaaaaaggaaacaacaaaagtccatacgactctcgccgacaaaccaaggtgcccactggagagaagaaactcacaactgcaaactgacaaggttcaggtaccaagtgacaagtatcttttgtatgagattggagatgaggagtttgatatcagaggtagtcgcaaacttaaccatacacaacaacttagtttctttgacaaggccaatgtagtgaccccatcatataaaataaaaggcacaatgaatccttggagactctactgcactgtgtctcagaaacatcacaagccacaagaacagtttcacacagcttttcaaagaatagaaataggcctagtaatctccatctttgccatgtttgtgtttggcacattggagtttctaaggctaagggaagtcaagaattacaactactataatctcaagcacatgcttatgtcaattttttggcaagtgcctcagtacttcatcataggatttgctgaggtgttcacatttgttggaaaattgaagtttttctatgagcaagctcctacatgcaatgagagtctttgttcttctttgtctctcacaacagtagcacttagaagttatttgagtattatgcttgtgaatgttgtgacggatgtgagcactagacatggtggaagtggctag

SEQ ID NO: 40631 - DNA, 255 bp, Glycine max
  Peptide Sequence Number=SeqID_132316
atggaagacgcacccgtgagccccgcgtcgccctcccaccgaaggtggttcgtgagggaagtgatgttgcatgtgttgaaagcttattcttgccaatttgaaattgaaccacaggtggcagagaggcaaggtaaagccaatggaggtcgtgcaaacagtgcaaaagatgtagactttggggatcaatttgtttacaagcacatgggaagcatggcatctatagggagttacaaagctctagtggaccttagatag

SEQ ID NO: 40632 - DNA, 279 bp, Glycine max
  Peptide Sequence Number=SeqID_132317
atggcaggagctggtgacggtggtgcgcttgttactggacgtgatgactacacaaatgcaacgtttgtgttgaaccgtaacagtgaagagccctatggacgaatagaaggacaagagcaccaaatgaatcagaatgttgggagaccttatggtgggatcagaaggggcaataatggaccgaggcaaaatagaatggaatggcagaacagaattgagggagtaaaactcagtatacctcctttcaaaggcgagagtgacccaaatgcctaccttgactag

SEQ ID NO: 40633 - DNA, 1035 bp, Glycine max
  Peptide Sequence Number=SeqID_132318
atggggatgaggggttgtattaattataatcccgtgttggccataagacagttaggctaccctatgagaggcgcgcagttggaggaagtcatcatgcctttcatcatgcgaggcttcaatgaagctaatctgaagatacttcagaaaattcgtaaagcgtggaatagagtgggaaggaaagataaggagcttaaaggaagtagcaatggtgacatcggcggctatcacaagtggttgaagtctagaatgcaagggataacttggctcccaaagttaaaaagtctaagtggaaaaaaggctgaaattcttgaggaaaatgaagaagtgcaagttttgaaagtagagctaaaaaacacaagagtggtgaaagtgaagctaaagacgacaatcactagggtcaggaaagagtatgatgaggaacaagttccgaggggctctatgggcagtagtaacgagctcaagcttagaagggccgagagcggcgaatcaaggatggaaagcatggtgttagaaggtaagttaaaggcttgtcagaggtcgaagagaagtttgacagaacagttgagcaaaatagaagacaatatgttgataatcatcaaccaatataaggagaaggtgaacttggttgctagtcatgggcagatgttggaagatgaacatgcaaagagtcaagagcttccaaggttgttagccaaagccaaggcagtggttgacatgtactcggctctcgatgaagttcacagtcttttcaattactaccaacacatggccgacatggaggccatgaaagaccaaatgaccaccatgatgagcatgaggaaaatgatggaggtcaacgcggctacaattgccactacaagcgtcgccactaaggtagatccaactcacctattcagtgtgaatcaagtccagagcaagcatcctttcctactgtatggtctgcctcccaactatgcaccacctagtgccgtacatgtgcccgaggagaacgtcgaccactcctctcccataccccttaaaggccaacaaccttag

SEQ ID NO: 40634 - DNA, 506 bp, Glycine max
  Peptide Sequence Number=SeqID_132319
atgactaggggtaatccaggtgatttacaaccctttgatcctgaaatagatagaaccattcatagattagttaggcatagtgtgcatcctgatcattctgtgcattttgagcattttgtgcattctgagtattctgttgctggtgattctgaatattccgattttgagcattcgactactaattttcatactgagaacatggatcaacctccacctcatgagaggactcttagggagatggctggacctgatttcacttatgaaaacttatgcattcaatatcctgatgagggtgttccatatgttctaaagactggactaatacatttgctgcccaagtttcatggtcttgcaggtgaagatcctcataagcatcttcaggagttccatattgtttgttccactatgaagccccctaatgtccaagaagatcatatctttctaaaggcttttcctcattctctagagggagtcgcaaaagattggctatactaccttgctcccag

SEQ ID NO: 40635 - DNA, 993 bp, Glycine max
  Peptide Sequence Number=SeqID_132320
atgggcagtgatggtgagggaaattggtacacttcattggcgcatcaaatttcaatgtatggtgtagctgccggttactgtttatctgcatctttgctttccataatcaacaaatgggcagtgatgaaattccctttccccggtgccctaaccgccatgcagtacgccacctgcaccgccgctgtcgtcctttgcggccgccttaagctcctcgagcacgacccccttgaccttaaaaccatgtggcggttcttgccggcagcaatacttttctacctctcccttttttccaacagtgagttgctcctccatgccaatgttgacacattcatcgttttccgctcggttgttcccttgtttgttgcggtaggagagacgttgttcttgcaccagccgtggccgttgacgaagacgtgggcctccctggccaccatcttcgccggcagcgtgctctacgtgataaccgattatcaattttcttttatggcttatacctgggccttggcctacttggttagcatgaccatagattttgtttacataaagcatgtgattatgaccattggcttgaacacatggggtcttgtgctgtataacaatctcgaggctcttctgctttttcctttggagctgctgattatgggtgagttggagaagatgaagcgtgagatcaaacatgattctgattggcactcattccaagtcattttgccggtgttattgtcgtgccttttgggtctttcaatctccttctttggattttcttgccgcagagcgatttccgctaccgggtttactgtcctcggtgtagtgaacaagttgttaactgtagtaatcaatttggtaatatgggagaaacattcaacatgggtgggtacagtgggtcttttgatttgcatgctgggtggggttatgtatcagcaatcaactagcaagccgaataatgctgcaaaacaggaaaatgaggaggaacaactgaagttagttgattga

SEQ ID NO: 40636 - DNA, 630 bp, Glycine max
  Peptide Sequence Number=SeqID_132321
atgagttgtccatcctctacaccctatatggaagctgtggaagagtcattggaaacatcttttcaagagcttgaaattgtgaacaatgcttatgtggatgctcctccggtgcaaccgcgtctatctagtgcctccttgatggtggcccgagttatgttgagggatgtgtatgagcccgaaattggtttaggccggaatggtaatggcacgacaagcttggtgaggttcgttgaaaaccatggaaggtatggtctaggttacgagcctacacatgccgacaagagaaaggtcgccttagaaaggaaagaaagaagcctagcctatttacaagggcggggaccacaaatagagagggtccctatttgccacattagcaaaagctttgttagtgtgggatggatgcatcaaaatcaggttgttgtgctagacgaagaaactaaccaaaaacagccaagttgggtgcagaggaagaatgaaaaggaggtgaagccataccaagaagagacaaaggttgtgaacttaggcattggtggagagaaaaaggaggtcaaggtcagcacttgtatgtccgcgaaggtccgagatgagtttgtgactttgttaggagactaccaagacatcttcgcttga

SEQ ID NO: 40637 - DNA, 981 bp, Glycine max
  Peptide Sequence Number=SeqID_132322
atgatacaaggagagaggaatgtcaagctctatatcacagagtttgacgagtttagaagggagttggagaggcgcaacctgcacaagcgactcaccaacttagctgatggcagtattgatgtcgcgatggtcagggagttctacacgagcctctatgaccctaaagataactcaccaaagaaggtgagagtgagagggaacttgataaagttcgatgcggacaccctcaacacatttctggagaccccagtggtattggagcctagggagaccatctccacatattccagattttgcagattgaggatggatcctcaagagatagtggctaacctctatattccaagcaggggatttgttctaaatactgaaggcatgccgtggaagctactgaggagagacctcaccaccttagcacaaacttggagtgtgctatcatattctaacctggcccttacatcacatacatctgacttgaacttggacaaggcactgttagtttatgggttggtgatgaggatggacatgaacattggagcattaatttcaggacaaatctcattcattgttcagtccaaatcctctaggttggaatttcctaccttgatcacagctctctgcaaggcaaggggagtcacttttgattccctctcttatgattcactgagcccaaccattgatttggcatatatcaagaaaaattgttggaacctggatgaaccttcggtctactttctagggactcgcaaggctagggccagagcagctgagatcccttcgtcatccactcctgaggaccctcctgtacccacttcttctccatcaccagctccaactcatccaggaccttccacagaccttatcatggtgatgctccaaagattataccatggacaatacctgttgatgcataattttcaaaacttagctcagcatcagccattcatatccttggaggagttcactcggcaggtggcctga

SEQ ID NO: 40638 - DNA, 265 bp, Glycine max
  Peptide Sequence Number=SeqID_132323
cagtgctttgaaaggaccttatgatactccacaatctaaatccaaggctggtgctaggtggattgttgttaaatgtaataaacaagaaggaagcactgagtgtggctattacgtgatgcactggatgtctagtataatcttaggaagtttcaggaataattggaaaacgtattttaatgatgttagaccattggaagcagagagattgaaggcgcttcgcatccagtggacacaatattatctcaaagttgaaaatcaaacttag

SEQ ID NO: 40639 - DNA, 231 bp, Glycine max
  Peptide Sequence Number=SeqID_132324
atggtatcagagcaaactctaaccctgggacctcgcattcgcctccgctgcgacaagcacccaccatttgtggttcacgcaccaagcccaataagtgctgggcgtgaaggggtactagtagtacgtggtggtactagtggtagtggtgatgatagtaatagaagtgtgacaattataatgatgataaaagctaaaaattcccaaccactcgaaatgaggccaataaattaa

SEQ ID NO: 40640 - DNA, 192 bp, Glycine max
  Peptide Sequence Number=SeqID_132325
atgagagggttaaacgagagcaactgggagggtgttctgcagcacggatctttgacgtggttggcagcacaagctcggatctacgaccgcgaccaagaacaagggtggatacataacaagcgtggttgggcggtggcctggtggcaactagcaccgttgaacgaagcaaacaccgccgatgcagtgaaatag

SEQ ID NO: 40641 - DNA, 348 bp, Glycine max
  Peptide Sequence Number=SeqID_132326
atggggaagtcactatctctagaacaacacacttatgatctggctgaggtctttgaaaaactcgaaaagcttaactcgaggctaaaccctgaaaagtgtacttttagggtaggcagagaacccattaaatctcaatgtttggttgatttcattgtcgagcttccccctataacgagcaacaatgatggtgacgattggtggatgctctatgttggtggagcaggaattaccctggagggaccaggacaaatattacttgagcagtcactaaggtgcaaaagtgattcaaagctagcaatggtgatttctaagccaaatatgcacagatgcagaaatactaccacttga

SEQ ID NO: 40642 - DNA, 936 bp, Glycine max
  Peptide Sequence Number=SeqID_132327
atgtcttactctatttttggtggagatgagtcttcagttgtctgtcaaaagtctatgttagatacaaaatatttcggtattggggaagagtcagaatcatcctctggctcttttgtttgcctttttcattctgatgaggaaactttccagaacttgatgaagggaacgaaagtgacctctaatgttaatgtttttgttagtgatattaatgccatccctattgagtctaatgaggatgaagaaaaatatgtttttgaccgtatttgggatgagccagatataggaggtgacaatatagttgttggtggtggcggcctagggagaaaaggaattaagtttcctctagttactatctctaactatacttgggtgactggagaggtcgttgtgtattcttctatctttcaacacactagctcaattgccgacttgaagagtaaagtaagtataacacatttcaatgatcttgactgggtcattgtcgatcattgtctttccaaagcgtgggtttatcttagtgctgatcaactattgtctcccaaggaaaggcaagatgcagtcataattatggaatttcctaggagaatgaacatcaagaaagttctcaatttgccttattgtggcaatgttgagaacactttagaggcaagcatcgttgacttaatgaagccaaaggaaggaaagcattatgataaggaggttggtaaattttgtgacaagaatgaccaacctcaagtaaaagtggctagaattatggagattgggagtactaactttgagaaagagaagaagaaaaataagtctcctgaaaaagaaaaagagattccaaagacaattaatgttgaagaacccactattgatggtggaaatcctcctgatgttactcaacctcgaaatatggataagccaattaccactcttgatgaggctgcttag

SEQ ID NO: 40643 - DNA, 531 bp, Glycine max
  Peptide Sequence Number=SeqID_132328
atgtgtaatgcaggcaagggtgcagaaaaatatttcaagcatggatcgcgtctaaaatggcatgaaggagctatttcaagggagagcattagtgcagtgaagaagcttggtcatcttaaggatgaagtctgcaatgccacaaaatttgatctaccaaataaggatagaaaggattcccaaggaatatgctttttgggcaaggtatgtggagtgagcagctcctttacatcatatctatttcatggtgctggatttggatctaagagaaaatatatgtttcggaaagtaaccatccagctcaagcttgtggagggtgactctattgaaactggaccatttctatttaacaatgaacataatttacggtgtacatattctgctcaatgcattgagcttttctcaagttcagacaacccgatttgcatcaatgaattgaatattaccagtttaggcatcatggagattcctatttgcttaggtggctccatttcatcctctggctccactttatatgtgctcatgttttcctga

SEQ ID NO: 40644 - DNA, 213 bp, Glycine max
  Peptide Sequence Number=SeqID_132329
atgaccaacactaaacattattccttaccctgtatagaccacaactacaaaaacgcctccctgaattatcttcaatccacgatgtcaccagtggagcctctacgttacataaacacatcacgtgactttggggcttcgacctatagacaacaaactccttttcttgggaatgatgccaatgacgatgtggctcaggcaacgaggaggttttag

SEQ ID NO: 40645 - DNA, 375 bp, Glycine max
  Peptide Sequence Number=SeqID_132330
atgggtgtttcctacatgggtgaagaggaggatatggtaaatcatatgaagcatatggaagaaagggatcaaaaggagattgagcaagttaagaagaagaaaaaagagaaaaaagaggtagacagtgggaggagttggtggtgcataggagaagtagtgagaaaaagaattggttgtttgataggtgactttaataatgtgaggagaacttgtgagagaaagcgagttggtggtattgagcttggaagaagggaaaggacggactttaataacttcattgacaatacggagttggaagatgtctctttgcttggaagaaagtttacttggcttagaccaagtggaacgactagaagtaggattgatagagcttag

SEQ ID NO: 40646 - DNA, 513 bp, Glycine max
  Peptide Sequence Number=SeqID_132331
atggctaagcccgacactagtgcgcttagcgagcttagcgcgagattgacgctaagctcaaattcacttactcgcgctaagcgcgagaatggcgctaagcgcgacatcgagatcaggaatttagaatttattttcttcttgaattgcttaactgttgttcctgttagtgtatgcacgcgtagatcttctgtaggtgaattggttccattggatttagaaattgaagccacctttagaagaaataacgcagagagaaaaagaaagcttttgcacgacagaacagtagcatcaatccttgaagaggctcacttttctgagtcatcatcttctaattcatctacatccagggaatctcaaacagcagaatttgaagtcgaagtcatggctgaagagcaacctcgtcgagtgaccttggaagattactcaagtactttcgtgccacaatatttcttaagtgttgcacagccagaggttcaggcacaaaacttaacttacccaccttcattgatatag

SEQ ID NO: 40647 - DNA, 744 bp, Glycine max
  Peptide Sequence Number=SeqID_132332
atgccagttagccctcacgatgttgcacctacaccatctccacctccgactgaagctagaccatttgtatgtcatcttaatgcacgtggactatcctcggtacctacatccacaccatccccatcgttggttcatgcacgtggaccatcctcggtacctacatccacaccttccccatccccggctatagccaacatgcctacagatgaagatgctacaaatttggcgatggaagaccacccccttaatgattgtccaatgattatgctaataaatggagcgttccatccatctaaggttccaacaaaggctgtctccttgtccattaggcaacaatttggtggttctatcagcttgcaagatcacgtcattcgcttgtcagaggagcttggtcaatctgtatatgtagatgacgtctttcaacaaactcatttacgaaaggatactggtcaatttgtcaatgatagatctaggcaaacacatgaagaattcgaggctagactatctcaagctaggtctgatactacatcaagtgttggtgaatcacaactcactcctttagaccctactgaagaacaaagacttaggagtcggtgttgggttgctaccgcaggaccaaagtgtaagggacacctttatggtactggagaccttgctcatgctttcaaatgtgaaaatgaaaacttcatgcaacatatacaaggattttccagtggtgctaaagatgttgcagagattaactga

SEQ ID NO: 40648 - DNA, 540 bp, Glycine max
  Peptide Sequence Number=SeqID_132333
atggcttcgcgtaaaaggaaggcactagcttcagtgtcccaggcacgatatgatagatctagatttgtatcccaagatgcttgggaccgctatgcaaacaatgtccttagcctgaagatccttccggaaaggaatgtgaagctgtatatcacagaatttgatgaatttataagggaaattgagaggagaaattggcataaggagctcactaacttctcagagggaaggattgatgttgctattgttaaagaattttatgctaacctctatgaccctgaagacaaatcgcctaaaggaagaggagagcttgcccgcctactccagaacctagatgacccttcggtcacttttcggggaacccagaaatccagggctaggagatctgaggcctcatctacatcagctccccctaccttagctccttctacatcagctccttctacctctcctctccctccagcactagcacctccagttcttacaggttttcctgctcagagcttagagcattccctatctatgctgcagagcctgcattag

SEQ ID NO: 40649 - DNA, 321 bp, Glycine max
  Peptide Sequence Number=SeqID_132334
atgactagaggcaatccatatgacttacaaccctttgatcctgagatagataggacatttcatagattagttagacatcatttagtaccttttgagcatcctgagcattctatttttggtgattttgagcattatagttttgaacattctgattttgaacattctgagaacatggcacaacctccaccccgtgaagacccgcacaaacatctgaaagaattccatattgtctgctccaccatgaaacccccagatgtccaggaggatcacatatttctgaaggcttttcctcattctctggaaggagtggcaaaggactga

SEQ ID NO: 40650 - DNA, 319 bp, Glycine max
  Peptide Sequence Number=SeqID_132335
atggcttccatttatgattgtcgtgaagctagcaatgaaaaagctaggactgaaaaagatgtggccctacagttgggcttgaagattgatggattgtcagtaaccgatatcatcaccggtgatgtacgtgttgcttgtcaggccttactaggggaaactccacctgataagtatgtaaagggtaaaataatttaccaaagttggttgtggcaaaattttcagcaacttcacattgattctgaagatgttgtcattgcacagcatgctagagctcatatcatgatgcacataggctgttgtttgatgccagatacatcag

SEQ ID NO: 40651 - DNA, 969 bp, Glycine max
  Peptide Sequence Number=SeqID_132336
atggatgaggagtcttccttcgttgatgacttgttttgcatcattggaggtttacatggtgacagtatgctttacattgttgatttttgtcctgagattgatttggcttgttatatatttgtgactgatttcttagtgtgtactattcctttggatactgccaaagtgaggcttcagcttcaaaagcaagctgtagctggtgatgttgtctccttacctaaatataagggtatgctgggaacagttggaaccattgccagggaagaaggtctttcagcactctggaagggcattgtgccagggttacatcgtcaatgtttgtatggaggcttaagaattgggttatatgaacctgttaagactttctatgtggggaaagaccatgttggagatgttccattgtcaaagaaaattcttgctgcatttacaactggtgcttttgcaattgcagtggcaaatccaaccgatcttgtcaaagttagacttcaagctgaaggaaaattacctcctggtgttcccaggcgctactctggatctttaaatgcttattcaacaattgtgagacaggaaggagttggggctctttggactgggcttggccccaatatagcaagaaatggtatcatcaatgctgccgaattagccagctatgatcaagtgaaacagactattttgaaaattccaggattcactgacaatgttgtaactcatcttcttgctggtcttggggcagggtttttcgccgtctgtattggctccccagttgatgtggttaagtcgagaatgatgggagattctagttacaagaacacccttgattgttttatcaaaacattgaagaatgatggacccttagccttttataaagggttcctcccaaattttggacggctgggatcttggaatgtgatcatgtttctaaccttagaacagactaaaaagttcgtcaaaagtttagagtcgtcctga

SEQ ID NO: 40652 - DNA, 177 bp, Glycine max
  Peptide Sequence Number=SeqID_132337
atgatggcacatcatccaccatggagatgcagcggaagacaaataagaagagctccattggagcttgtaggcctaggatcttcttcatcaatggattcctttgcttcttggaagatgaatggcagcggaatgaagaaaggaagagagagaggagacaccacttcaaggagaagatga

SEQ ID NO: 40653 - DNA, 402 bp, Glycine max
  Peptide Sequence Number=SeqID_132338
atggctactccacctgcctcgcctccccctcctcttcttcctcctcatgcagacgcatcagcgtctccgtctacattgaagcagacaggcaaggcgacacgactacgatcattggccactagaccacctggggtagaaagagttgtggtcaacattgatcctgctaccggcaaggccgaaggtccccacaagaagaaattaagaacatatttggggattgtcgcttgtgataaggtcgacgtgacatacgagacctggaaggaagtccctgctgctcagaaagatttgatatgcgaggatattcaggatgtgcagaaaaatatatgtgttatgtacaggattctttggaaaagcaggcgtcacagggatggttcgtcccccatggacgtcaggatgtcttga

SEQ ID NO: 40654 - DNA, 486 bp, Glycine max
  Peptide Sequence Number=SeqID_132339
atggaaaagctcggtttgaggggaggagcttgccacctagctcgcccaggcgagcaaggttgcttcctccagaagcaacagccttctggaggaaggatctggaaggcccaactttcgaagaagttacggaaactcacggattacgcaaaaacacctcttttcgatttccgccacattacggaatttcacggatcgctgagagcaacaacttctctagatgacgaatcagaaagatcggcaattcctccaactggggaagtaggaaggtcaactgtttctccagctgatgaatcaggaggggcagccgcttcatctgatgatacatcagagatgataatcagaggtggacatggggaaactacttcacgctcaggagaagacagtgagttcaccactggagattatgggtcaactggctctggatcaacctgcacaggtgtgggctcaggtggagcagcctcgttgggtctcaccaatggaagttga

SEQ ID NO: 40655 - DNA, 258 bp, Glycine max
  Peptide Sequence Number=SeqID_132340
atgacctcaacaaaccttttaggtttgaaggtgatgcctaaagatgttgtaaaggaagtgaaggataaaatgactatggaattagctctttggaatgaaaatgattacctatgcaataatttcattctgaatgtgttagctgatgatctctatgattattatagcctatataagtctgccaaattagtttggctgactttcgaagagaagtatgatactgaggaagctgggactaaaaagtatgccgttagtcgctag

SEQ ID NO: 40656 - DNA, 150 bp, Glycine max
  Peptide Sequence Number=SeqID_132341
atgacaatcagcgaaaaaattatagttaataaatatgagaaagccgctacggcgaaatatttggtacgctgctcggaaaaagctagaagtcccactcctattaacataggaactggaaatggaataaaaggtatgatccatgaatattga

SEQ ID NO: 40657 - DNA, 143 bp, Glycine max
  Peptide Sequence Number=SeqID_132342
ttgagatcaaaagtgaatccacagataagagcttcaaggtcaatggacaccggctgaaaccattcctcacaaatcccttcttagtggatgtaatggtggaggagacctccttacttcactttgtttggggttttctaggttaa

SEQ ID NO: 40658 - DNA, 246 bp, Glycine max
  Peptide Sequence Number=SeqID_132343
atgtcgactcatcacatcctggggttgaagaaggtcccaaggggagaactgcgaggagccaaccctagtacgagaggactgggttgggccaacctatggtgtaccggttgttatgccaatagcagcgccgggctgctaagttggtatggaagaactgctgcgccgcgggaaatccttctctatacaagttctcggacgaggtttttgaacagaacttcgataggcgagaggtgtaagcaccgcgag

SEQ ID NO: 40659 - DNA, 459 bp, Glycine max
  Peptide Sequence Number=SeqID_132344
atggttaaggaggagtgtaaggaggtaaatgtctcctccaagaggttagctaagaaggaaagacattttgaaataaagacaaatattaaagaaatttcccttcttagacaacctccacattttctcctttgtaaaaagacacttgttagcattgccacatctcttaggcttgagtttattcctcaagtaaaggagttgttggatgagggtttggttcgcaagagattaaatccttgtgctttgttggtgcccaaaataggaataatcaacatgaaaataaagaaaagtgatcaagggctttccatggaccctaagagaataaaggtcattcctgagtggcctactccatcaaatgttaaggaaagaatccatgagtttcaagaacctttggatttgaggtcaaatccttttcaagggggagggaatgatgcaatcctaccccccaagggcattggatag

SEQ ID NO: 40660 - DNA, 450 bp, Glycine max
  Peptide Sequence Number=SeqID_132345
atgagcattcacgtggctcagttaatcgctgatgccatctatctatttgcaggtatggcacctaccaggcaccctctggacctggataagtccaacagggccctgggatttcccgctttgatcacaggactctgccagtcgttcggagtccccgttgcacctagcaaggtgattcagccgcccatcacccgagcttttattaagaagtattgcacacagagacaggcccagggggatgctccgcaggccgcagacgcgccgccacctcatcaggctggcccagctggatcatttgatacggaggagtatttgtggcatttggttcgccagcaggcggccaaccaccgggcgcatgcaccagcagaggctcccgacgaggcagatgaggcccgcgaggacgaggagatgaccgatttacttgatttcttaggagggagcggagccacatga

SEQ ID NO: 40661 - DNA, 303 bp, Glycine max
  Peptide Sequence Number=SeqID_132346
atgggggtttttatcgtgggagcccgatctcgatatcgggggcaaaacaaatttgggtgtcaaggtgtcggtctcgggccgaacttccatattattccacaaggcacgcgtgacaatgatgatttgaaaacaacatgcaaaattagtcatggctacagccaggtggacactcaagcattccatttatggccttatgatactacggttgggaatttacacaaacagacccaatgtttccaaattatgttctcccatcagttcaatgaattcatccattcttatttcggttatttcggaaaataa

SEQ ID NO: 40662 - DNA, 299 bp, Glycine max
  Peptide Sequence Number=SeqID_132347
gggttcccgtgaaccctaagagaataaaggtcactcctgagtggcccactccaccaacaccactcattgagttggtgagaaaccatgttccttcatgggaagatgcccaggaaatgggtgttgagggaaggagcccaaagtatgaagaacctcgggatttgaggtcaaatcctttccaagttctagcttctcatctcaaggaggtgagcttagctattagagagcttctcaaggaagttttctcaaagaagcttctcaaggaagttttctcaagaaagcttctcaaggaagctacctag

SEQ ID NO: 40663 - DNA, 538 bp, Glycine max
  Peptide Sequence Number=SeqID_132348
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtttccccctggcggctccctcgtgcgctctcctgttcctgcctttcggtttaccggtgtcattccgctgttatggccggcgtttgtctcattccacgcctgacactcagttccgggtaggcagttcgctccaagctggactgtatgcacgaaccccccgttcagtccgaccgctgcgccttatccg

SEQ ID NO: 40664 - DNA, 267 bp, Glycine max
  Peptide Sequence Number=SeqID_132349
atggattacgctgcaatgctctttgatgcaagctccattggagcttgtaggcctaggatcttcttcatcaatggattcctttgcttcttggaagatgaatggcagcggaatggagaaagggagagagaaaggagacgccacttcaaggagaagatgagtctagaagaagctcaccaccatagggggccatggataagagcttggaggaagaaggagatgaatgaagggagagggagagaagagcacgaaattttgtgctctaaatga

SEQ ID NO: 40665 - DNA, 138 bp, Glycine max
  Peptide Sequence Number=SeqID_132350
atgttatcaatgtttgaccagcaaggtcgtccttctgggaaagagtcaattcactggttaactgacgatgagaaagactcaatccatgttcatgtgttgattaattgtgctgaagttaaaccatacctcgagttataa

SEQ ID NO: 40666 - DNA, 402 bp, Glycine max
  Peptide Sequence Number=SeqID_132351
atggggaaagttggaacctcttacgtgccgatcaacgtctcattttcgccaaaagtttggcccagggcttcccggtatcaacagggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcggggcgcgtcccattcgccattcaggctgcgcaactgttgggaagggcgatcggtgcgggcctcttccctattacgccagctggcgaaagggggatgtgctgcaagccgattaagttgggtaacgccagggttttcccagtcacgacgttgtaa

SEQ ID NO: 40667 - DNA, 195 bp, Glycine max
  Peptide Sequence Number=SeqID_132352
atggctccctacaaagctctgtatggtagaaggtgtaggacacccttatgttggctagatcccaaagagaacctcaccttagaacatgaagtggcgaacaaagcacctaagagaagagggaaggagattccattggtcaaggtgatctggggaggtgcatcaggagaggacatcacgtgggaactagagatttag

SEQ ID NO: 40668 - DNA, 168 bp, Glycine max
  Peptide Sequence Number=SeqID_132353
atgggggaagattcgtggtcgcatgagtacatgaacctcttcggtggcacagagagatttgaacaattaaagttgtccctacttgttgatggcttttcaaaggttagtgtggacaagtggatggatataacggacataggatatgtgattgcttcacggtttatttga

SEQ ID NO: 40669 - DNA, 523 bp, Glycine max
  Peptide Sequence Number=SeqID_132354
atggaaacgtgtttgggagtcgaggaattgttacagcggatgatagatcaaggtcgacaagaagttggcagtgaaggaagagaggagcagcacatatgcatgcaatccacggatgggagcattgttgcgaagcccaaacccttggtgatatacttcaccaagggcacagcttcgcaaaagcccggacaccctttggctgctaaacctgttcctttcccgtaccaaaatagccacgcagtcccatggagatatacacctccgagggggaaggaagaagaagcccccgacgtcagctcgttgtcggctaaggtaacaaatatcacgggactgagtggtgtgacccgtagcggtcgtgtgtttgcacccgcggacctaccagtccaacccgcaaacgtcaaggggaaagcaaaagtggtggaggaagaagatgacgaagcacccctcacttcgaataaagatatttcggcgaaaggtcttccggagaaaaaggatggtaaaaaggaggtgtcactagaggaagcca

SEQ ID NO: 40670 - DNA, 993 bp, Glycine max
  Peptide Sequence Number=SeqID_132355
cctgggtaccaccaactctgggtgggtatcctggagaacggttacgtcaaggtcatcgagaacgccgagggcgcgcgttccaccccctcgatcatcgcttacaccaacgatggcgaaaccctggtgggccagccggctaagcgccaggcggtcaccaacccgcagaacaccctgtatgcggtgaagcgcttgatcggtcgtcgcttggaagagaacgtggttcagaaagacatccagatggtgccgtacagcatcgtcaaggccgacaacggcgacgcctgggtggaagtgaagggccagaagatggcgcctccgcagatttccgccgaagtgctgaagaaaatgaagaagaccgccgaagactacctcggcgagccggtcaccgaagcggtgatcaccgttccggcctacttcaacgacagccagcgccaggccaccaaggacgccggccgcatcgccggcctcgacgtcaagcggatcatcaacgagccgaccgcggcggcgctggcctatggcctggacaaggccaagggcgaccacaccgtgatcgtctatgacctgggcggcggtaccttcgacgtgtcggtgatcgagatcgccgaagtcgacggcgagcaccagttcgaagtgctggccaccaacggcgacaccttcctcggcggcgaagacttcgacatccgcgtgatcgactacctcgtcgacgagttcaagaaggaaagcggcatcaacctgaagggcgacccgctgcccatgcagcgtctgaaggaagcggccgagaaagccaagatcgagctgtcctcgacccagcagaccgacgtcaacctgccgtacgtgactgccgacgcgagcggtccgaagcacctgaacgtcaaggtttcccgcgccaagctggagtccctggtcgaagacctggtgcagcgcaccatcgagccgtcccgccccgcgctgaagtatgccggcctggatgtttccgatatccatgaagtgatcctg

SEQ ID NO: 40671 - DNA, 342 bp, Glycine max
  Peptide Sequence Number=SeqID_132356
atggacaataaatgctttgagctaggagtggaaggccctgggagaactggagctggggctgaaggtgggagagcagatgtagatgtagatgaagccgatgtggaagaagctgaagaagggggagcagaagaagatgttacctcgtatcctttgcccctagatttgcgggttccccaaaaagtgaccgaagggtcatctaggttccaacaattctttttaacatatgccaaattaatggctgggctcaagctcttgaaagtcaaagagtcagaggtgactccccgggccttgcacaaggcagtgatgagggtaggaaaacctagcctcgaggagtcatgttaa

SEQ ID NO: 40672 - DNA, 294 bp, Glycine max
  Peptide Sequence Number=SeqID_132357
atgggtgatcagaccaaaagcatgcaacaatcaagcaccgatagaagcaatgaacacgttttacatctattgttcaatagaaatccccaactaagggttttagccttccatggcaaggaagctccttttacaataaagaaagggaatcaagagaaatcgcttgcttgcacagaaggggggatgtctcttccacctcttggcacctcacaatcactcaaaagctccctaatctctctaaaagttgacaacttggctccttgctctgcttcttcattctctacagtccacacttag

SEQ ID NO: 40673 - DNA, 321 bp, Glycine max
  Peptide Sequence Number=SeqID_132358
actcatcttctccttgaagtggcgtctcctctctctcttccttctccattccgctgccatttatcttccaagaagcaaaggaatcaattgatgaagaagatcctaggcctacaagctccaatggagcttgcatcatggacactggcagatggtggtcattgtgcccaaggaacacctagttgtctgcctaaatcaaaggctcctgctaggtggattgtcatcaagtattttaacgatcctagaccattggagccagagagattaaaggcgttgcagatccagtgggcacattattatctccgagttagagatcagacttag

SEQ ID NO: 40674 - DNA, 134 bp, Glycine max
  Peptide Sequence Number=SeqID_132359
tccgggagttgtatttacgctttgaggaaggtattagcacctcttacgtcgacaaaagcggggcttttgctcctacgtaccctcctttggagaggaaatcagacctacgtagttcttacttatgtgtgaaacaa

SEQ ID NO: 40675 - DNA, 126 bp, Glycine max
  Peptide Sequence Number=SeqID_132360
atgtcatggaacttcacggattgcttaacgatgggtgtcaagttcctcgaagcggtcaagcaaaggttgcatgccatcaaacaatggtccccggacgaaattaggggactcattaggcaggaataa

SEQ ID NO: 40676 - DNA, 285 bp, Glycine max
  Peptide Sequence Number=SeqID_132361
gacatacagaactatcctgtggatgtggtgaacaaagcaatcagcttcttcgaagagtataagaaggagaagctaaaaatagtgcaaacacctataggttggcaggccccaccccatggtgtttataagattaatactgatgctgcaatttttaacctgcaagggattggctgcttgcttcatcccgcccttccttccctcaccgcacgtgccatagatttagatgaattagctgttgcggcgctcttctcttttctaaagcaaggaatttcctttcattcataa

SEQ ID NO: 40677 - DNA, 132 bp, Glycine max
  Peptide Sequence Number=SeqID_132362
atggcagaaatcaaccaaggtaagacgatgaccgatcacgattggccgtgtatttttgtttcctacttgcaggttagctcgcctgggcgagctgagctcgcctgggcgagcaacccctgcaccaaaatataa

SEQ ID NO: 40678 - DNA, 168 bp, Glycine max
  Peptide Sequence Number=SeqID_132363
gtcgactctagaggatccccggggcgacctcttgggtctggttatcttgatcatgtaatagattggtgtttcttgaagaagatgaagaggaggaatttgagcgaaaggagatacgggaaaaagatcgcaataatcttcttcagacatgataacacatctcttaaatga

SEQ ID NO: 40679 - DNA, 156 bp, Glycine max
  Peptide Sequence Number=SeqID_132364
atgctcttgacaccatatgatgtagctccatgtagagcttgggaatggagaaggaagaaagatgattggagatgccacttcaaggagaagatgagtcaagcacaagctcaccaccataggaagccatggataagagcttcaaggaggagaagatga

SEQ ID NO: 40680 - DNA, 649 bp, Glycine max
  Peptide Sequence Number=SeqID_132365
agggcttcatgccatcaccttcagagaactacacgttcttgccatcagaggaccacacgtcctcgcctttagagggctacacgccctctccttcagaggactacacaccctcgccttcagaggactacacctgctcaccttcagaggactacacgtcctcgccttcagaggactacacgtcctcgccttcagaagactacacgtcctcgcctttagagggctgcacatcttcgccttcagagggctgcacatcctctccttcaaaggactacacgtcctcgcctacagaggactacacgtcctcgcctacataggactacatatcctcaccttcagaggactacacgccctcaccttcatagggctgcacgccctcgccttcagaggactacatgtgctcgccttcagaggactacacgtcctcgccttcagagggcaacacgccctcgccttcagaggacttcacatcctcaccttccgaggactacacgtcctcgccttcagaggactacacgtccttgccttcaaaggactacacgtccttgccttcagagggcttcacgcctttacctttagagggctgcacgccctcgccttcatagggctgcacgccctcaccttcagaggactagacgtcctcgcattctga

SEQ ID NO: 40681 - DNA, 718 bp, Glycine max
  Peptide Sequence Number=SeqID_132366
atgcagatccgtatcaggggaacaagatctctgacaggagataataatccgttgattgtattggatggaattcctttcgtaggatcactgggagatataagttcaagtgatatcaaaagtattgacatccttaaagatgcttctgctacagcgatttacggatccagaggagcaaacggagttatcctcgttacaaccaatagaggagcaaaagggcagaaacccagattcacttacaatacctttacgggagttcagacgttgttttcaaaatatcctatgatggatggtcctaagtttgcacagttgcgtgcttatgcgattccggcaggaaatacaacacctttatattcaaatggtgctgatgaaagcaacagtgttaatacggactggcaaagcctgtactacaaaccggcgatgatgaccagtcatgatatcggggtttcaggaggaacagacggaggaaattataatgtagggttatcttacttcaagcaagatgcattgatccctattcaaagttatgaaagatttgccctgcgaatggctattgaccagcaggtaggctctgtttttaaatttggttttacatccaataccaattattcaatctctgaaggaaatggggtaaatccgggagcagtgctgggattttctccaattgccaatccttacaatgcggacggaagcccgaagagggtaatgagcacggcaggag

SEQ ID NO: 40682 - DNA, 187 bp, Glycine max
  Peptide Sequence Number=SeqID_132367
cataagcttcagactgttcaattactccagattgctacacagaagggcaaagttgggttaccaagtgatgcaatcctacctcgtaagggcattggatagaagactccaagtaaattgggccagagatccaagggaaggccctagggttctcatgagccttagggtagatttcgggcccatgggctaa

SEQ ID NO: 40683 - DNA, 87 bp, Glycine max
  Peptide Sequence Number=SeqID_132368
atggcgttaaatatattatttagtagcatgtgtgagttgtcgaggaacgcctacaaagctttgggaaggctagtggtgataccattg

SEQ ID NO: 40684 - DNA, 258 bp, Glycine max
  Peptide Sequence Number=SeqID_132369
atgggcaaaacactaacccttaaggaaggaggggacatggttaatgtttctctcaaacaaaaaaaaaagtgcaggaaatggccccgaggaagcttgcctcaaagaggtccaggaaggataaggcggccgaaggaactagttccgctcctgagtatgacagtcaccgttttaggagcgcgatacaccagcagcgcttcgaggccatcaaaggggatggtcatttctccgagagcgacgcgtccagctcagggacgatga

SEQ ID NO: 40685 - DNA, 1497 bp, Glycine max
  Peptide Sequence Number=SeqID_132370
atgaaccccattcccgatcatagctgtgatgtactgattgttggcagcggcgcggccggtttatctctggcgctgcggctggcaccgcactataaggtaacggtgctgagtaaagcgcagattagcgaaggctccacgctgtatgcacagggcgggattgcggcggtgtttgatgagaacgacagcattgaatcgcacgtcgaagatacgctgattgccggcgcaggcctgtgcgatcgcgagacggtgaattttatcgccagcaatgcgcgcccgtgcgtccaatggctgatcgataacggcgtggcgtttgatcgcgagccacaggataacggcaaggcgcgctatcacctgacgcgcgaaggcggtcacagccatcgccgtattttacacagcgccgacgccaccgggcgcgcggtcgaaaccacgctggtcagccaggcgctcagccatcccaatattcgcgttattgagcgtgccaacgcggtggacttaatcctctctgataaaattggcctgcccggaacgcggcgcgtggtgggcgcgtggatctggaatcgcaatcgcgaacaggttgaaacctgccgcgcccgcagcgtggtgctggccactggcggtgcggcgaaggtatatcagtacaccactaatccggatgtcgcgtccggcgacggcatcgcgatggcgtggcgcgccggctgccgggtggccaatctggaattcaatcagtttcaccctacctgcctgtttcatccgcaggcgcagaactttttgctgaccgaagcgctgcgcggcgaaggtgcctggctactgcgcccggacggttcgcgctttatgccggatttcgatgcgcgcgccgaactggcaccgcgcgatatcgtggcgcgcgctatcgatcacgaaatgaagcgcctgggcgtcgactgcatgtatctcgacatcagccatcagccggccagctttgtgcgtgcccactttccgatgatctatgacaagctgctgacgtttggcctcgatctgacacagcagccgattccgattgtgccggccgcgcattacacctgcggcggcgtgatggtggatcaacatggtcgcaccgatgtcgacgggctgtatgcgattggcgaggtcagctacaccggcctgcacggcgctaaccgcatggcatcaaactcgctgctggagtgtctggtttatggctggtcggcggccgaagatattgtgcgccgtctgccgcagatgcacgccgtcgatcacctgccggcgtgggatgaaagccgcgtcgacgatgccgatgaacgggtggtgattcagcacaactggcatgagctgcggctgttaatgtgggactacatgggcatcgtgcgtaccaccaagcggctggagcgcgccctgcgccgcattacgctgctacagcacgagatagatgaatactatgcgcactttcgcctctccaacaatctgctggagctgcgcaatctggtacagtggcagagctga

SEQ ID NO: 40686 - DNA, 1023 bp, Glycine max
  Peptide Sequence Number=SeqID_132371
atggctgaaccggtagtgggcgtgggctccagccgccgtaaagcagagcaggccgccgccgaacaggcgacccgaatgagcgaactcgaaacatacagcggctttatcgcgattgtcggccggcctaacgtcggcaaatccaccttactgaaccagctgctggggcagaaggtgtcgatcacctcgcgcaagccgcaaaccacgcgccaccgcatcatgggtattcataccgaaggcgcttatcaggcgatctacgtggatacacccggcctgcacatggaagagaagcgggcgatcaaccgcctgatgaaccgtgctgccagcagctccatcggtgacgttgagctggtaatttttgtggtggaaggcacgcgctggacgcccgacgatgagatggtgctgaacaagctgcgtgacggcaaagtgccggtggtgctggcggtgaacaaagtagacaacatccaggataaaagcatcctgctgccgcacctgcagttcctcagccagcagatgaacttcctcgagatcgtgccgatctccgccgaaaccggtaaaaacgtggatgcgattgcggagattgcccgcaagcgcctgccgctgtcggatcaccacttcccggaagactacatcaccgatcgctcgcagcgtttcatggcctcagaaatcatccgtgaaaaactgatgcgcttcctcggcgccgagttaccgtattcggttaccgtggagattgagcagttcgtctctaacgagcgcggcggctatgacatcaacggtttaattctggtcgagcgcgaagggcagaagaagatggtgattggcaacaaaggtgccaaaatcaaaaccatcggtatcgaagcgcgtaaagacatggaagagatgttcgaggcgaaagtccatctcgagctgtgggtcaaagtgaaatcgggctgggcggacgacgaacgtgcgctgcgcagcctggcgaaagtcagggacgcgtccgcgtccttgccaagggcgcacgctcgcgccgttcccagctga

SEQ ID NO: 40687 - DNA, 782 bp, Glycine max
  Peptide Sequence Number=SeqID_132372
gcgggcatctggtgtcgctgtttattgatgccgatcagcgccagattgaagcggcggtcgcccagcgcgccgcaacctttgccgccagccgcggcctgaaaggtgaatgctggccacggtctgacatatcacaacgtccagccgattgctgcgctgccggaaatgcacgagctgaatattggccacgcgattattggtcgtgcgctgttcagcgcgatatcgtcgagatcgagcgtattgccggcgtaattgaacgctccggcgatcgtctggcgcgccgcgtgctgagcgaagctgagtggcagcagtatcaggcgcatcagcagccggtgcgcttcctcgccaaacgttttgcggtgaaagaggcggcggcaaaagccttcggcaccggcattcgcggtggtttagcgttcaatcagtttgaagtgtacaacgatgcgctggggaagcctggcctgcgcttctttgaacaggccaaagtgattgccagccagctgggcgtgcagcatgtgcacgtcacgctggccgatgagcgccactacgcctgtgccacgaatagtgttatcaatcgggcagacgctctgacaggtcggctcatcataatgacccacgcattcagtgcagcggtcagcgtcgatctgatagatcgattcacccatgctaatcgcctggttcgggcactcaggctcgcacatgtcgcagttaatgcagcgctcagtaattatcagtgccattgcataagctcatcagttgcttgttttcattgcatgtttcatggttag

SEQ ID NO: 40688 - DNA, 318 bp, Glycine max
  Peptide Sequence Number=SeqID_132373
atgcccgccgccagcaggaaaaacaggaacagaaaagctttacgcggtttgaaattgggtgccttcacaatgcccacgatgatcagtgagcaggagatgataatgctgacaatcgagcgcccggtatcaaagttgcacagcgcatttctgagcggttcagcgataaaccaggtgatttttttcagcggcgctaaggtgatattggttctggccagtacttcattaaacagcacgagcggcagaactttcgccagcaccagcgccatcaccatgccaaatcccagcatcaacatcagcttgatcaccgcgctgcgctga

SEQ ID NO: 40689 - DNA, 87 bp, Glycine max
  Peptide Sequence Number=SeqID_132374
atgacagctttcgccccggcgcgcgatgctggctacactgtagagcaggtatcgccgcgtttagaaaaaggagtcgggttgacaaag

SEQ ID NO: 40690 - DNA, 1167 bp, Glycine max
  Peptide Sequence Number=SeqID_132375
atggtgccgggacgcggcgtcaccagcaacagacgcccttgtggcacatgttcggcgagagaaggaccgtatttcagcagacgctgcaggcgggcttgctgttccgcgctgagcgatgagcgtcctgaaagcgggtcagcagtttgtttacacgaaatgccgacagagcgggcgaaccacgcagaatttccatcattaaagatctctcgtcttcgaagcgccgggcgacgcttcatggggcgcaacagggaaaacgggcggtattatagagaaatggcacggacagaggcctgtgagccattacgagacaactatttgaaacgcctgaaattaaattatctgtttatcggtctgatcaccgtgctgcttgcgctggcgctgtggccgtccatcccctggtacgggggcggaaaagacgcgttatcacagatcaaatcgcggggagtgttgcgcatcagtactgtcaactcgccgctgacttactacaccatcaataatgcaccagccggtatggactacgagctggcgaagcgtttcgccgattatcttggcgtgaagctggaagtcacggtgcggcccaacctcggcgacctgtttgacgatctcgacgacggcaaagccgacctgctggccgccgggctgatctacaacagcgagcgcctcagccgttatcagagtggcccgagctactattcggtgtcgcagcagctggtgtatcgcatcgacaaaccgcggcccaaaaaccttggtgatctgaaaggccggctgattgtgcagtccggttcggcctatctgtcaacgttacgttccgccaaagcggacagctatcccgatctcgactgggccatttccaccgatatgggccagaaagcgctgctggaagcggtcgccgacggcaagctcgactataccgtgggggattcggtgaccatcggcctgctgcagcgtatccatccacagctggcagtggcgtttgatattaccgatgaagagccggtgacctggtatctgccacgtaacgatgacgatagcctgaacgccgccatgctcgacttctacagtcagatgggggaagaaggcaccatggcgcggctggaagagaagtatctcggccacgtcggcacctttgattatgtcgatacccgcacacttcctgcgggcgattga

SEQ ID NO: 40691 - DNA, 354 bp, Glycine max
  Peptide Sequence Number=SeqID_132376
atggcttcaagatttaatacaagattgcttcaacaaacaaagccttgcttcaagattaactcaagatcaagacttgccataaaacaaagtgctttcaagacatgcaaggctctggcagagagttttgttggtccaaaatgtcttatcctttcaaaagaaaatgaaagagattccaagagaacttcattgtcaaatgctctctcaaaagaaactattgggcaaacacctacaaatccattaagagtttatccatggacatcaattgtaatatccttctcttcaagagagaattcttctttctttcttttcgttcaaagagattgtttaaaggaccgagcgtctcttaagttgtaa

SEQ ID NO: 40692 - DNA, 509 bp, Glycine max
  Peptide Sequence Number=SeqID_132377
gccatcctgggaagatcctcaggaaagatctaacaactcttactcaggtttggagtgttctctcatactccaacctggctctgacttcccacaccttggatttgactgtagatagagctaggttaatctttggtctagtctctcagctggacatgaatgtaggagctctcatctctggccagatcacatctatgacccagtctaactcctctagacttgggttccctgctcttatcacaactctatgtaggtctagaggggttgcttatgacagcctggtcttcgaacgcctgagcccgatcattaacttggcctacatcaggaagaactattggaatctcgacgatctaacagtttctatccgaggggctaggagggcgagggcaaggccaattgagcttccttctacttctgcagctcctactccagcattcacttcagcatccccttctgtcccagctcagtcaaattctcagcgctttgaagccatgcttcaaagcattcattag

SEQ ID NO: 40693 - DNA, 621 bp, Glycine max
  Peptide Sequence Number=SeqID_132378
atggctaagtatgaccctgagatagtcatggagttctatggaaacgcctggcccactgaagaagaaatcatggataagtgttcctgggggcggggccaatggatcccatataatgaagatgctatcaaccaattcctggggcatctgttgatcttagaagagggacaacgttgtgaatacgctaaaaaaagaagccaagtctcaggttttgatgaagaggccataggcccagctactatctggatgatgcttctgcttagcaacatcattcccaatgaccataattttgatctcccactgcctaaatgccagttggtctacattattctcacccagggtcagtgttcatgtagcacagcttacctcggatgccatctaccagtttgtaggtattgcacctctgagacaccaatggactcaaagaagtccaacagggcactgggatttctagcattgatcacaggtgatgaggacaaggcaaggaataagggcaagaaacctttagaaggacttggaggacctatggcaagggctagaacaaagaaggctaaggaagctcttcaacaagtgttaaccatgctatttgaatttaggcccaagttacaagttgagaagctttag

SEQ ID NO: 40694 - DNA, 312 bp, Glycine max
  Peptide Sequence Number=SeqID_132379
atggctaagtttgaccctgagatagtcctgaagttttatgctaatgcttggcccacaaaagagggagtgcgagacatgcggtcatgggtgaggggtcagtggattccctttgacgcggatgccctcagccagtttctgggtgacccgctagtgttggaggaaggccaagagtctgagtttagtcagaggaggaacagggccgatgggttcgacgaggaggccattgcccagctattatgcacactggggcaggacttcgaccggaccgctgcagggaagcgggtgactgtaacgacccgcctcgtcgctacg

SEQ ID NO: 40695 - DNA, 456 bp, Glycine max
  Peptide Sequence Number=SeqID_132380
atggtgggttacacaccttcaagctttgcggatttggtcttcgctggtgaaatgatcgaagtgggtctaaaaagaggcaaatctgataatcatgctttgataaaaaaaactggggcaaatgaagagggtgagagtgaaggagaaacccatgctgcgactaccattcctatacagccaagtttcccaccaacccaacaatgtcattactcagccaataacaacccttctccttacccaccacccaattatccacaaaggccatccctaaatcaaccacaaagcctgtctactacacaaccaatgctaaacaccacctttagcacgaaccaaaacaccaacaaagaaaggaattttgcagcgaaaaagcctatagaattcgccctaattccggtgtcctatgatgacttgcttccatatccactcaataattcaatggtagccataaccccaaccaag

SEQ ID NO: 40696 - DNA, 639 bp, Glycine max
  Peptide Sequence Number=SeqID_132381
ggctacacatcctcgccttcagaggactacacgccctcacctttcagaggactacacatcctcacctttcagaggactacacaacgtcctcgccttcacagagctacacacgtgctcaccttcagaggactacacgtcttgccttccagagggcacaggccgtcaccttcagaggactacacgtcctcgctttcagaggactacaccttcctcgccttcagaggtgtacacgccctcgccttcagaggactacacgccctcaccttcagagggttacacatccttgccttcagagggctacacgccctcaccttcagaggacgacacgtgctcgccttcaaaggactacacgggcttaccttcagagggctacatgccctcaccttaaaaggactacaaggctacacgccctcacctttagaggattgcacgccctcgccttcagaggactacatgtcctccccttcagaggagtacatttcctcaccttccgaggaatacacgtcctcgccattagaggactacacgtgctcaccttcagaggactacacgtccttgccttcagatggcgacacaccgtcaccttcagaggactacacgtcctcgccttcagaggactacacttcctcgcctttagag

SEQ ID NO: 40697 - DNA, 147 bp, Glycine max
  Peptide Sequence Number=SeqID_132382
atgttgatgcacaatccgcccacttgggccctccagaagattcctccagaaggcggttgcttctggaggaagcaaccttgctcgcctgggcgagctgagctcgcctgggcgagctgggcggcaaccacctcccctattttgctataa

SEQ ID NO: 40698 - DNA, 234 bp, Glycine max
  Peptide Sequence Number=SeqID_132383
atggccataacttttgctccggaacggaagcttcgagcacactccagacatcttctgaaagatcccaacagtcagatcatggacaagtgtcttgtgaagctgctgaccaaatttcgagaagatccagcggttaacgaaggctgggcatcttttttaccgatgcagcttcatgtagcttcctcaagaagcttcattaagaggcttcttcaagaagcttccccatggcttttttga

SEQ ID NO: 40699 - DNA, 1592 bp, Glycine max
  Peptide Sequence Number=SeqID_132384
aatctggtggtgaccgtattcgccagcgccgtaaggcactgaaattaacgcagcaggcgctggccaatggcattggcgtgtcgcacgttgcggtttcgcagtgggagaaagaagagacggtgccgcgtggtgagcatctgctgcggctggcggagttgctgcagtgtagcgcggcgtggattattgatggcgacggccagccgtttgccagtacgcacgcttcccccgctctcactgccgtgccgctggtcacgctggtgcaggccgcggactggctggatgagcagcgactgcagtggcagcagcaggccgtccactttctttacagtgacgaagcgctgagcgacagtgcgctggcggttacgctggaagatgacgccatgaacccggcgtatcgcgccggcgaccggttgatctttgatccgcaacgcgtgccccagccgggcgatgtggtgctggcgcgggtagacaacgtcgcgatgtcagaaaagtacgctggaactgattggcacgctggtggaaatgcggcggcgcggcagccgctgaagcagcaaaaaacccgccacgcggcggcggcggttactcagtttatcgaacagcgccacgctgcccttgtgctcaccgttggcaccgacaatatgccattcgggcgacatttcttccagctgcttgaaggacccgatcaggccgttcagggcatttacgaccgtatctgccgcgacgcccgtcatcacaatctggttgagctgatgcatgacttcgcgccagcccggcgctttggtaacgtcggtatggagctgtttgacctgcgcgagcatgacaaatccagcgtgctacaggcggtgctggataaaggcacttcgcgttaccagctgacctatgacgaccgtgcactgcagttcctgcgcaccttcgttgaggcgcgggaaaaagagaactatttcgagatcccaccggcgaatacctgggaatttattactgatgcggaaagccagcgtcagctggagagtctgcagcactatgtgcaggattgccggtttgcgtttcagccgattgtcgatcccttctcgcgacgtattacggcctatgaagcgctgattcgcacgccggacggcggttcaccgcaggagtacttctctgcgtttggcggcgatgcgatttaccatgccgatattcagtccaaaagtctggccttcaacctggcgaaaaatctcggcctcggcgagcagacgctgaccatcaatctgctgccaatgtcgctggtcaccgtcccgaatgcggtggatttcctgctgcaggaaatcgcggccaacggtctggtaccggagcagatcgtggtggaagtgacggagaatgaaatcatctcgcgtgccgaagagtttacggcagaagtaagaaaacttaaggcggcaggtatcagcctggcgctggatgactttggtgccgggtttgcgggtttgtcgctgctgtctaaattccagccggataagatcaaaatcgatcgggaaatcatcagtgacgtgcacaaaagcggtccaaaacaggcgattgtgcatgccatcattaagtgctgcgcttcgctggagatcgcg

SEQ ID NO: 40700 - DNA, 336 bp, Glycine max
  Peptide Sequence Number=SeqID_132385
atgagcctctgtcagtttacggagtccctgtcaccccccggcaaggtcatcatgtcccttactaatcaagctttcatcaagaagtattgcgaccccaggcaggcgcaaggccgagacaccacaacagcctggggatggccggcagcgggcaacaaatgcaccgccaccacctccagagcccctcagctcatccacaaaaaggttagagtattgcctacgacacatggccgaccaataggcgaccaagtccaaagccaaaggcgtccagctcaagacgttaaagaagcgctactaggaggaaacctagtaccttttaaatctctgcttgttatttaa

SEQ ID NO: 40701 - DNA, 467 bp, Glycine max
  Peptide Sequence Number=SeqID_132386
cagataagtctaacagggccctaggttttccgacattgatcacgggtctctgccagtcgttcggggttcctgtcacacctagtaaggtgattcgaccgccgatcacccgggctttcatagagaagtactgcacaactagacaggcacagggtggtgacgcacaggccctagacgcaccgccgccacctcctcaggctgatccagctgggtcatttgacacggagcggtatttacggcatttggttcgccagcaggcggccaaccacagggcgcacagccagggtttcccttcgtttccatgccctactccggatcagttcagggaagaggttgcatggcccggagattggcctgaggctcaggcaggggaggcacccgcagaggctcccggcgatgcagataaggcccgcatggacaaggagatgaccaatttgctcgatttcttgggagggagcggagccacatga

SEQ ID NO: 40702 - DNA, 135 bp, Glycine max
  Peptide Sequence Number=SeqID_132387
gataaatggtctattaatgaactgatgaccatgtgtgttcaagaagaggagagattgataatggaagagggtgagaagggtatggaaagtctaaggaagccagtggaaagtgagcagtgcatctactcagagtag

SEQ ID NO: 40703 - DNA, 519 bp, Glycine max
  Peptide Sequence Number=SeqID_132388
atgaagcacttcactgacaccctcatcagtgccaacataggaacaaaagctggtaccgggccccccctcgaggtcgacggtatcgataagcttgatgatgaaaggtatgatatatcgttgggcctaaatacctttggtgttaagtatgtcatcaacttcgccaaaaaatgtaccaaactcaaggttcttgtgcatgtatcaacagcctatgtatgtggtgagggaggccgagaagggctcatattagagatcgaattcctgcagcccgggggatccactagttctagagcggccgccaccgcggtggagctccaattcgccctatactggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 40704 - DNA, 771 bp, Glycine max
  Peptide Sequence Number=SeqID_132389
atgctttcttttgacttccggcatgtcacggaacttcacgaattgcctaacgatgggtgccaagtacctcgaagtggtcaaacgagggtcgcatcccaacaaacaaatgggccccggacgaaattagggtatgacagagacgccacagcagaagggtccagtgccgccctcgagtttaatagtcatcatttccggagcatcgagcaccagcagcgctttgaggccatcagaggatggtcgttccacaaagagaggcgtgtccagctcagggaggatgagtatacggactttcaggaggagatagctcgcagaccttggacgctgctggtgactcccatagccaagtttgaccctgagatagtcctagagttctatgctaatgcttggcccacagaggagggagtgcaagacatgcatgccctcaaccagttgctgggtgacccgctagttttggaggaaggtcaacagtgtgagttcagccagaggaggaacagggttgatgggttcgatgaggaagccattgcccagttgttgtgcacaccggggcaggatttcacccggaccgctgcagggaggcaggtgcagatcatgcgcaccagcatgaccactttgacccagacatggatgacactgctgctcagcaatgtcttacctagcaatcacaactccgatctccctctgcctaagtgccagttggtgtatgccatcctgacacggatgagcatccacgtggcccaggtatggcacctaccaggcaccctctggacctag

SEQ ID NO: 40705 - DNA, 336 bp, Glycine max
  Peptide Sequence Number=SeqID_132390
atgacaccagaccacgcattagatcctctgccagatggtcatgccccgcagccccgagtcgtccctcaggccccacagacggatatctctcacgtactggagccaggagcactgtcgacatctgcgaggcccgctgtggaggagcctagacatgcagtggaagtttgtgatgagattgctgagaggttggagcgccatctgagtctaggggtggtcacgtctggctcatcgacacatgaggtgatcgaagaatgcctcaggatggccagaagtgtgacacaggaccatctagtatatgttaggtctagacgcaggcggcgcacggatcaggcgtag

SEQ ID NO: 40706 - DNA, 165 bp, Glycine max
  Peptide Sequence Number=SeqID_132391
atgacaccggtaaaccgaaaggcaggaacaggagagcgcacgatggagccgccagggggaaacgcatggggggcggagcctacggaaaaacggctttgccgcggccctctcacttccctgttaagtatgttcccggcatattccaggaaatgtccgccccgttag

SEQ ID NO: 40707 - DNA, 309 bp, Glycine max
  Peptide Sequence Number=SeqID_132392
atgcttgtaaccctcacacctgccgcggttaaagcgccatttacagggggctttccattagcttttcaggttgcgcagttattgggaagggcttcggtgagggcctcttcactattacgccagctgactcactatagggcgaattggaaatccacgaaggtgtgggtcgctctagaactagtggatcccccgggctgcaggaattcgattataggaaaaagggggaggaggttgccgcccagctctcctgggcgagctaatgtcgcctgggcgagctgggcggcaacctcctccccctttttcctataa

SEQ ID NO: 40708 - DNA, 171 bp, Glycine max
  Peptide Sequence Number=SeqID_132393
atggagaaggccctaggtgatgcaatcctccctaggaaggaaccagttaccagatgcatgagcaagaggcttcaagaggattcagcaagagcgattgaagaaggccctagggtagggtaccctagaaatgttggattttttagctcttatattttagggcacctagactag

SEQ ID NO: 40709 - DNA, 675 bp, Glycine max
  Peptide Sequence Number=SeqID_132394
atggggcttctagaacttgggggcaatagtcattcttatgatgttgaccaattaagaaatataagagttcctatcgaggataggataacaagagatagcagcatggtctctagaggaaatgctttggccattcccagaaaccaacctgggaatagacatataattcagatgcttcaaggacaaaatggcccaaacagaggcttaggcctcgaagcaattcagaatcctaagatcattcaaatgatggaacttgctttgaatatgtattgtttcggaataggaaatgcacaaccaccttactttgtttctgccttccttgattatattttagcatctgaattgccaagagtgagtgctcctttatctagagaggaggtcaaccaagccttggaagagttcaaaaaggaagaagagtttccacttgcagaggaatcattggtcgaatttctattgaagaaacaaaaagttgagaaagaggttatgctttgtctttgttgtaacgtcgtgtttgacaagtcgactgctaaagcatttgaagcttcaaaaaattcgaagagtttccagaaagtgcaagaagcaaatgttaaagaaaaggggaagcagagtataagcttgactgcgagccaagttcaaaggccctacaatttgtctcagaagaaatcttatgtcccttaa

SEQ ID NO: 40710 - DNA, 506 bp, Glycine max
  Peptide Sequence Number=SeqID_132395
gtcttcttggttacaaacactgaacacaagggaccaacgttccttgggttcattggaagtagcaagatttgattcttggttgatcactggacacaaaagaccaacgtcttttgtgttcattgcaagaagtgggtataacttcttggttgttatcactggacataagggacaaacattccttgaggatagtggaaatctcaagcgggttgcttggggactggacataggcacgggttgtggccgaaccagtatgaatctggaacatgtgatggaattgcaaagacttaatcaaaatgagaaagagcaagcaaacatatgcttaatgaccaagaatcatgaaagcgatgaggaggagcccttgaagaaaaagtggtacatagacagcggatgctctaaacacatgaggggagatgcctcaaagttcacaactatttctcctaagaaaagcgggcatgtaacctatggcgacaacaacagaggtaaaattcttggagtcggaaaaatag

SEQ ID NO: 40711 - DNA, 258 bp, Glycine max
  Peptide Sequence Number=SeqID_132396
atgtgggcatggaaacgatgtcttcccttggctccaaagaggactccttctcaagtagaaaataaaccactggggcacagacttgtagcacatatgcatggggaccttccgtacttgcttttctatacagagagatgtgcagtaccaccgattataaaactaaatcaatctgaggtatgtgcatcttactacaaatgtgggcatggaacgatgtctaaccttggctccaaagaggactccttctcaagtagaaaataa

SEQ ID NO: 40712 - DNA, 537 bp, Glycine max
  Peptide Sequence Number=SeqID_132397
atgtatagagtgctcatcaaggcaccaccacaagttgttgtttcggttgagcctaagaaactgaggttcaagaaaaagggtgaaaaaaaggagtttagagttacattgaccttgaagcctcaaactaagtacaccactgattacgtatttgggtgttttatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 40713 - DNA, 857 bp, Glycine max
  Peptide Sequence Number=SeqID_132398
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgaaaggctttgtaggcttgagcacggtgatattcactaccctttgtttcctttgtggtttccctcactcgattgtttttttcttcacaagattcctcttgttgccgccagcgacaacaaagagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40714 - DNA, 510 bp, Glycine max
  Peptide Sequence Number=SeqID_132399
atgttggcaagttgcccctcctcggcaccatatgtagaggcagcagaggaatcattggaaacaactttccaatccttcgaggtggtaagttgtgcctctatggaaacaagtccattgctaccttgtctctctaatgcggccttgatggtggcgtgggtaatgctcaggcacagttatgagcccggaatgggtctgggcaaggacagccacgagaatgccgatgtggttgacattaggggtaacctgtacaaatatgggttggggtatgaacccgggaaacctggaagaaggaatgcaccatcaagactccaggcagatagggcatggccaggtcatgttagccagtgtttcacaagtgccgagataatgtttgaggaagaggtggaagcaataggagaagaggctccacaagatccgccgagtttcgtgcgaccgtgccatcccaatttccaagtagggaactggcacgtgatgagccagtcagaagtctatgccgctgattcaatgtaa

SEQ ID NO: 40715 - DNA, 764 bp, Glycine max
  Peptide Sequence Number=SeqID_132400
agggctgcatgccctcgccttcagaggactacacgtcatcgtcttaagacaacttcacgtcctcaccttcaaagggctgcacgtcctcgccttcagaggactacacgtcttcgacttcagaggactgcacgtcctcaccttaagagggctgcacgtcctcgcctttagagggctgcataccctcgccttcagaggactacacgtcatcaccttaagagggctggacgccctcggctttagaggactgcacgtcctcgccttcagaggactgcacgtccttgccttaagagggctagacatggctacatgccctagccttcagaggaatacatgtcctccccttcaaagggctacacaccctcaccttcagatgactgcacggctacacgccctcaccttcagaggactacacgtcctcgccttaagagggctacacgccctcaccttcaaaggactgtacatcctcgcctttagaggattgcacgtcctcgccttaagagggttacacgtccttgccttcagaggacttcacgtcctcgccttcagagggctacacgccctcacctttagaggactgcacatcctcgccatcagagggcttcatgtcctcgccttcagagggctgcatgccctcgccttcagcagactacacgtcatcgtcttaagacggcttcacgtcctcaccttcaaagggctgcacgtcctcgcctttagaggactacacgtcctcacctttggagggctccacgtcctcgcctttagag

SEQ ID NO: 40716 - DNA, 726 bp, Glycine max
  Peptide Sequence Number=SeqID_132401
atggcttccagaaaaagaaagagtattggtacaagacccatagctcagtatgatacaaggaggttccactcttttgaggcttggacccgatacacagataatgttcttggaagacatatactacctaagaggaaggtagaaatataccatactgagctgggcgagtttaaggctgaattggagaggcgtaacttccataaacgcctcaccaatttagttgacaacatcatagatctagctttggtgaaggagttttatgccaacctttacagctccgaagggccttcaccaaagcaagtcagggtcagaggccacttggtgaggattgacgcagacaacctcaacacctttctggagacacctgtggtactagctgaggaaggccaccctgggaagattctcaggaaagatttaacaactcttgctcaggtgtggactgttctctcatactccaacctggctcctacttcccacaccttagacctgatagtagatcgagctaggttgatctttggcctagtctctcagatggacatgaatgtgggaactctcatctttggtcagattacatctatggaccagtctaactcttctagacttgggttccctacttttatcatcgctttatgtaagtccagaggggttgcttctgacagcctggtctttgaacgcctgagcccggtcattaacttggcctatatcaggaaaaactgttgggaaccctga

SEQ ID NO: 40717 - DNA, 228 bp, Glycine max
  Peptide Sequence Number=SeqID_132402
atgaatcggccaacgcgcggggagaggcggtttgcgtattgggcgctagcggagtgtatactggcttactatgttggcactgatgagggaatatgtgatacaggatatattccgcttcctcgctcactgactcgctacgctcgggtcgttcgactgcggcgagcggaaatggcttacgaacggggcggagatttcctggaagatgccaggaagatacttaacagggaa

SEQ ID NO: 40718 - DNA, 147 bp, Glycine max
  Peptide Sequence Number=SeqID_132403
atggcttgcacctacattccagtggaagcaaagatgattcacaagcgattctcctcaaatttcagccagcccgcatcaattaaactttgcaccttacgcttcaaggtcatacagtgctcaatggaatgtcccggaactcctccatga

SEQ ID NO: 40719 - DNA, 339 bp, Glycine max
  Peptide Sequence Number=SeqID_132404
gtagtgtctaatccttggaggtttacagtagggaactggttatgtgactcagatctggttagtcctactggaattgaacgggttctaaccgaaaaggaccttctggctgactcatattcagacctagaggcttctatccttgatgaaaaagaatttctcctattgaaggttatctctacctttccggagttatcttgcttaatatgctctatggttggagcgggtcggggaatagacggttttaacaggactctagatgcacaagtattcatgaccttgtactggatcctatatattaaggctgctgggattgatccttctttcatgtcaaggccatga

SEQ ID NO: 40720 - DNA, 196 bp, Glycine max
  Peptide Sequence Number=SeqID_132405
atgggggtgcaaatagcaaccaggcccacttgggccctccagaagattcctccagaaggttgttgcttcttgaggaagcaaccctgctcgcttgggcgagctgagctcgcctgggcgagctgggaatttcgcgaaggttttcgaccgttcttcaacgttcttcattcgttcttcatcgttcttcagtcttcaacgg

SEQ ID NO: 40721 - DNA, 381 bp, Glycine max
  Peptide Sequence Number=SeqID_132406
atgccgatcttcccctgcggaagtatcagttgggatcacgcccacaagacacccagtggacccggagaagtccaacagggccctggggtttccagatctggttatgggcctctatcagtcctactaggtgcccgtccccccagtgaggtcatgccatcggatcgcgcccgcaagacccccagtggacctgaagaattccaacagggtcctggggtttccagctctgattacgggcctttgtcagttctacggagtgcccatcgccccagcaaggttatcaggcctcttactaatcgatctttcatgaagaagtactgcgcccccaggcaggcacagggcgagacaccacaacagctggggaatgccggcagcgggcaatag

SEQ ID NO: 40722 - DNA, 117 bp, Glycine max
  Peptide Sequence Number=SeqID_132407
atgctctcgggaatggaagcttcgagcatactccagacatcttctctgagatcccaacggtcagattgtggacatggtgtttcccttgctcctacgtattcatcaaattgtgaataa

SEQ ID NO: 40723 - DNA, 767 bp, Glycine max
  Peptide Sequence Number=SeqID_132408
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatctggtggtggtggacaaccggtggttgtccaccttcttgttgctcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40724 - DNA, 363 bp, Glycine max
  Peptide Sequence Number=SeqID_132409
atgtacaatgtaggtcggctaggtttttttgtgcggagctcatccgacattttgtttcaatcaagcttatcgataccgtcgacctcgagggggggcccggtaccagcttttgttccctttagtgaggctcactgcccgctttccagtcgggaaacctgtcgtgccagctgcattaatgaatcggccaacgcgcggggagaggcggtttgcgtattgggcgctagcgggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactga

SEQ ID NO: 40725 - DNA, 60 bp, Glycine max
  Peptide Sequence Number=SeqID_132410
atgggaggacccctagaaaagttgatcgagggtagtaaagtaaatttcgaaaaagacggg

SEQ ID NO: 40726 - DNA, 925 bp, Glycine max
  Peptide Sequence Number=SeqID_132411
atggggacaaatcaaaccggcaagaggttttaccaagtcaaggttaaaagcctagataccaccagcatcaaggaattagggcggttgatggaacctctccaaatgcaagctttccgcaagacttacggaaagatcttagagttgaccttaggagaggtatccatagaagccattgcatcactcacccaatactacgaccagcctttgagatgcttcacattcggagacttccaattagtaccaaccattgaagaatttgaggaaattctaggatgtcctctcgggggaagaaaaccatatctttcatccgggtgtctcccctctttgagcagaattgcaactgtggtcaaggattcagcaagaaggtttggacagcataaaacagactcggaacggcatagcgggcctaccacggaagtacctagaaagacaaggcaaggggatggtttggtagacctagcagcaatcgacgctttccttgcctaccaccatagcaaggaaagtccggtggtagctgtcttggcagatctatttgacacatttgaccgaaggtgcgaaaagagtagcgcacggatcatctgttgcttacccgccctctgtgtttggttggtttcgcacttgttccaacaagacgcaagacatccgtgtccgctcctgagccatcgctcgtgtactgaaaagaggagaatagattgggaccagctcttggccgggataggaggtagaacaatcagttggttcccccgatggaaggaaggaaaagaaggagtccttttctcatgtggaggatacccaaacattccgctggtaggaacgaggggttgtattaactacaatcccacgctcgctataagacaactagggtaccccatgaggggagcaccgacggaagaaagcatgtctcctttccttgtgagggatctcg

SEQ ID NO: 40727 - DNA, 303 bp, Glycine max
  Peptide Sequence Number=SeqID_132412
atggtagccataaccccaaccaaggttcctcaacctccatacgactcgaacgcaacgtgtgcttatcgtggaggagccctggggcattccattgagcattttacaatgctaaatgatatggataaaatggacatccttgtccctcatcctctcacaaacgcatgtttgcttattcaacttttcaccggaatgtgggtgcaagccattggtctatttgctcagcgacctgcgctcctgagtgttgacttccaagactgttcaatcagagattactcgtcttgcacgttggtgggggtgccgtaa

SEQ ID NO: 40728 - DNA, 285 bp, Glycine max
  Peptide Sequence Number=SeqID_132413
atgaggatgcgtagccctctaaaggcgagggcgtgcaaccctctgaagttgaagacgtgtcgccctttgaaggcgagggcgtgcagccctctgaaggtgagtacgtgcaaccctttgaaagcgagggcatgtagccctttgaaagggaggacgtatagtcctctgaaagcaagggcatgtagccctatgaaggcaaggacctatagtcctctaaaggcgaggacatgtagtcctctggaggggagggcgtgtagtcctccgaaggtgagggtactagtaccctag

SEQ ID NO: 40729 - DNA, 387 bp, Glycine max
  Peptide Sequence Number=SeqID_132414
atgaatattgtcaatgatgatgcaaacaagaaaatgataagtgtcttcgagcttatgctgcaacaaacaaggttcaacaagtcaatcattgttcctgtgttctattcatgttcaggaaacatctaccagcataacacaccctacactgcaagcaagaatgacacctactatgagttggtaaaagaaaccttccaaggcctcaccacatgtcaagcaatgatgggtcataattactatgctcctgtcaacattgtaattggtgctaagctaacagttccaatgttatatgcttgtctaattgaaaatcagacagcaagagggatcacctctttgctggtttacttggtgaactatggtggcactattgagtccataggaagcttataa

SEQ ID NO: 40730 - DNA, 746 bp, Glycine max
  Peptide Sequence Number=SeqID_132415
gacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcgggttaaattcctgaaccgggacgtggcggctgacggcaaccctgcccaccctggaaacggctcagccggagtaggtccagcggctggagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaag

SEQ ID NO: 40731 - DNA, 564 bp, Glycine max
  Peptide Sequence Number=SeqID_132416
atggcgtacaccagctggcacttaggcatggggagggtggtcatattggtgcgcatgattcgcactcgtctccctgcagcagtccgggcaaaatcctgccccggtatacataacagctggggcgatggcctcctcatcgaacccatcagaccggttcctcctctggccatactcgcattcctggccctcttccaataccatcggatatcccaggagctggctgatagcgtcggcatcgaacgggatccactgacccctaacccaggatctcatgtcacgcacgccctcctctattggccaagcattggcataaaactcaaggactatttctggatcaaacttggccatgggagtaaccagtggtgcccaccgccggcgccctatttcctcctggaaatcagtatactcgtcgtccctgagctggacgcgtcgctcccggagaaacgaccatcccttgatggcttcgaagcgctgctggtgtacaacgctcctaaagcggtgactgtcgtactccggggcggaactagttccttcggccgccttgtccttcctggacctctttga

SEQ ID NO: 40732 - DNA, 255 bp, Glycine max
  Peptide Sequence Number=SeqID_132417
atggctaccattgcgttatcaagtagatatgggagcaagttagcatatgacaccggaattggggtgaattctacaggctttctcgctgcaaaattcacttcttggttggtgtttttgacagactttgtggtagatttagggatggcctttgtggatacctgggtggtgggtaaggagaaggaatggcagtcacaacatgggtttctcccttatcctcaccctctttatttgccccagttttctcagtcgtcctag

SEQ ID NO: 40733 - DNA, 259 bp, Glycine max
  Peptide Sequence Number=SeqID_132418
atgtggtggcattccttcatcatgcatactggaaaccactggtggactttcttgtggaggatgttgttcaatttccatcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagg

SEQ ID NO: 40734 - DNA, 447 bp, Glycine max
  Peptide Sequence Number=SeqID_132419
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatggtaacaacactgtggcggtagggactactagcaacaacgtatcatcaaagaggaaaaactctagatga

SEQ ID NO: 40735 - DNA, 330 bp, Glycine max
  Peptide Sequence Number=SeqID_132420
atgactagaggcaatctatctgacttacaaccctttgatcctgagatagataggacatttcatatattagttaggcatcattttataccttttgatcatcttgagcattccattactggtgaatctgtgcaatctgttattggtgattttgaacatcctgattttgagcattataattttgagcattctgattctgagcattctgattttgaacattctaagaccatggcacaacctccaccccgtgagaggacactaagggaaatggctgcacctgatttcacctacgaaagcttgtgcatccaataccctgatgaggatgtcccatat

SEQ ID NO: 40736 - DNA, 529 bp, Glycine max
  Peptide Sequence Number=SeqID_132421
atgtcgggacgacacagaccaactgatacttttgcagggggagattggcatgcggtcgctgggcagaatattgctaatatgcatagtagcagtgtgatagcctccctctctagttgtgctcgcacagttggcgctcctccaatatcagggggacagaggaccttaaattatctgaaggtgtggatatggagcccactgaaagtgaggatacgtagtcctctaaaggtgagggcgtgcagccctttcaaggcgaggatgtgtagtcctctggaggtgagggcgtgcagccctctgctggtgaggacgtgtagtcctctcaaggcgaggacgtgtagtcctctcaaggcgaggacgtgtagtcctctcaacggtgagggacgtgtagtcctctcaaggcgaggacgtgtagtcctctcaacggtgagggcgaggacgtgtagtcctctgatggtgagggcgtgcagccctctgatggtgaggacgcgtagtcctctcaaggcgaggacgtgtagtcctctcaacggtgagg

SEQ ID NO: 40737 - DNA, 204 bp, Glycine max
  Peptide Sequence Number=SeqID_132422
atgcgactgttgtttaactaccaaggggtatcagggcttttggggagcggcgtctttggtgaaatatatcaccaaaggcttaggccttccaaaacttctctcatctggggactagatacatatatgccactcttccctcccctcatcgccgatttccagtcggccttgatctatcatctgttgcaaaaggtcctccactgctaa

SEQ ID NO: 40738 - DNA, 1182 bp, Glycine max
  Peptide Sequence Number=SeqID_132423
ctcctggttcaccttctgtaccatcatctccatcatccaccaaagcaccatcacaccaggaacgacctgaattcactatccaacccatacaaatgattcctggtcaagctcctgtccctgagaaactggttcccaaacgacaacagagagtgaagatttctgaaaaccctagccttgcaacaagtcctagggaagtagacacggagatggacaagaagatccgcagtattgtgagtaacattctgaaagatgcttctgttcctgatgctgataaagatgttccaacatcttccaccccaaatgtttctgttcctgatgctgagaaagatgttccaacatcttccaccccaaatgctgaagtcctctcttcctccagcaaagagagatcaacagaggaagatgatcaagccacagaggagacccctgcaccacgggcaccagaaccggctccaggtgacctcattgacctagaagaagtagaatctgatgaggaacccattgccaacaagttggcacctggcattgcagaaagattacaaagccgaaagggaaaaacccccattaagagaaattcctcatctgattctgattatgatgtcgaactagatgttcccgacatcaagcgggccaagaaatcagggaaaaaggtgcctggaaatgtccctgatgcaccattggacaacatctcattccactccattggcaatgttgaaaggtggaaatttgtatatcaacgaaggattgctttagaaagagaactgggaagaaatgccttggattgcaaggagatcatggacctcatcaaggctgctggactgctgaaaactgtctccaagttggtagattgctatgaaagtctagtaagggaattcattgtcaacattccctctgacataacaaacagaaaaagtgatgagtatcagaaagtgtttgtcagaggaaaatgtgttagattctcccctgctgtaatcaacaaatacctgggcagacctactgaaggagtggtggatattgatgtttctgagcatcagattgccaaggaaatcactgccaaacgagtccagcattggccaaagaaagggaagctttctgcagggaagctaagtgtgaagtatgcaatcctgcataggattggcgttgcaaactgggtacccaccaatcacacttccactgttgccacag

SEQ ID NO: 40739 - DNA, 285 bp, Glycine max
  Peptide Sequence Number=SeqID_132424
atggatattgactatgctattaggaaagatgagccgctaggcattactgaaactaacactctagacattgtcgatctttatgaaaagtgggagagatctaatcgtctatccgtaatgttcataaagactaatatatctgctagtattcgtagttctgtcgatcaacatgaaaaagtcaaggatcttttgaaggccattgatgatcagtttattacatctgataaggcccttgccagcacccatataatgcagctctcatccttaaaggtccaagggataagggat

SEQ ID NO: 40740 - DNA, 351 bp, Glycine max
  Peptide Sequence Number=SeqID_132425
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacgccaatccctgggtgagtttcaccagttttgatttaaacgtggccatatggacaacttcttccgcccccgttttcaccatggcaaatattatacgcaaggcgacaaggtgctga

SEQ ID NO: 40741 - DNA, 757 bp, Glycine max
  Peptide Sequence Number=SeqID_132426
cgggggaggccctccttcgacgtgttcgccgccgctgacgacggcctaccctcgtgctcgcggcactgttcctcgtgattccggagacggcgccgcggaaggcgggggcatgggcctcgctgagcttccggctctcgatcccgccgtcgatccgcggagacttctggcgcggtgctccggccgtgatcgcaggctgggcgacgggtggactgttcctggcctcggggtcgtcctcctcgccggagtgggtgccgccacggcattcgtgctgcgcaagatcaccgcccggtcgatggtgctcttcggcacgtcggcgctcgccatcggcacgctgctgtcgctgatcgcgctcgccgtcgggtcgctcccgttctacctcgtcgctgccggagtgaccggcatgggcttcggcaccgcgttctcgggagtcgtcgcctcgctcgcaccgcggatccccgcgaccgagcgcgccgacacgttcgccgtgatctacctgctcgcgtacctggccttcggggtgccggccgtgatcgcgggagcactggtcggcatcgtcggcctcgaggcggtgtgcatcggctacggggtggtggtgatcgcgctcgccgcggtcgcgttcacgctgcgggaccggggagccccgtcacgaccccgtcatcggtgccgtcgagacgtcgatgaccccgagcgggaaggggctcatgacggaccaggatccggagtcgaactgctcgagcgggatcgtgtggaaccacac

SEQ ID NO: 40742 - DNA, 1217 bp, Glycine max
  Peptide Sequence Number=SeqID_132427
atgggacctctccaaaggcaagccttccgcaaagtgtacgggaagattctagatttggccgcagcggagatatttacggaagccgtcgtatccctcgcccaatactatgaccagccgttgagttgtttcacgtttggggacttccaaatggtaccaactattgaagagtttgaggaaatattaggatgccctcttggggggagaaaaccgtatcttttctccgactttcttccttccttgagcaagattgcagctggggttggtgattcagcaaaagagttggatcgcacgaagcaaactcggaatggcgtagtgggcctgcctcggaaatacttggaaggtaaggcaagggatatggcgagccaagagaagtggggcccgtttgcagatattttagctttgctgatttttggggttgtcctcttcccgaacgtcgacggtttggtcgacttagccgccattgatgctttcctcgcatattaccatagcaaggaaagtccattggtggctatcttggcagatttgtttgacacctttgaccggaggtgtgagaaaaacagtgcacggattgtctgttgtttacccgccctctgtgtgtggttgatttcacacctattccaacaagacacgagacacccgtgtctgcttcaaagctatcgctcatgcgccgaaaaaggaaaagtcgattgggaccaacatttggctgggatagggggcagcgtgatcaattggtttcctcgttggaaggaaggcaaggaaggagttcttttctcgtgtggggactaccctaatattccattgatagggactagggggtgtattaattataatcccgcactcgccataagacaactagggtaccctatgaggggagcgccaaccgaagaaagtctctcgcctttccttgtgaggaatctaggcgcacaaagtctcaaggcgatacaaagattccacaaggcgtggagaagtccgttgaggaaagacaaggagcttaggggcatccgtaatggcgtcatcggagattatcatggatggctaagaattcacacgtgggggttagattggctctccaagttgaaagttatcgatgaggaggacttcgaagcttcagaggaagatgaagaagtccgagctctaaaattagagttagggaaggcaagactcgccaaggagaagttcaagtcagctgctacacacatccggaaggagtgcaccga

SEQ ID NO: 40743 - DNA, 486 bp, Glycine max
  Peptide Sequence Number=SeqID_132428
atgcataccgggtcaggatttttcccggaccgctgccgggaggcgggtgcggatcatgcgcaccagcatgaccaccttgacccagatgtggatgacgttgctgctcagcaatgtcctgcccagtatgccacctaccaggccgcagacacaccgccaccacctcatcaggctgatccagctgggtcatttggcacgaagcggtatttacagcacttggttcgccagcaggcggccaaccacagggggcaggtgcagatacatgagtgtctctaccaactcagcctcagtcagcagagccaaggtttcactccttttgcgtgccctacaccagatcagtttagggctgaggtcgcatggctcggagattggcctgaggcccaggtaggggaggcgcctgcagaggctcccggcgatgcagaggaggcccgcatggatgaggagatgacagatttactcgatttcttgggagggagtggagccacatga

SEQ ID NO: 40744 - DNA, 177 bp, Glycine max
  Peptide Sequence Number=SeqID_132429
ggtgaacccttgggtactagtacccttgtctccagaggactatacatcctcgccttgagaggactacacgtcctcaccatcagagggatgcacaccctcacctccagaggactacatgtcctcgccttgagagggctacacgccctcaccttgggtactagttaccctcaccgttag

SEQ ID NO: 40745 - DNA, 272 bp, Glycine max
  Peptide Sequence Number=SeqID_132430
atggcatactccgagttatggccttcattattggagaatcatttggtggtggccataccagggagggtcttccagccaccctaccccaagtggtatgacccgggtgccaaatgtgagtaccatagtggagctcccggacacaacattaactcctgcctctcgttcagaggggctagcgtgaacgccgtcgaagagggtgggccatcacgcgcaaagaggttaggagaggtggctacttctagacgcttcatctaccaatcactgcaagcggc

SEQ ID NO: 40746 - DNA, 222 bp, Glycine max
  Peptide Sequence Number=SeqID_132431
atgacaataatttgtctctgcgtgccaccagactcgatcgtctctggatggcaaaaaggtgtgcgggatgaccataatttgtctgcgcaaagtgaccataatttgtctctgcgtgccaccggactcgatcgtctctggatggcggaaaggtgtgcggattaccataatttgtctccctatgtcatcgggctcgcggctctggatgacaaaagggcgaattga

SEQ ID NO: 40747 - DNA, 684 bp, Glycine max
  Peptide Sequence Number=SeqID_132432
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcccttttttctcctgccacatgaagcacttcactgacaccctcatcagtgccaacatatcgaaaatcaatttgccgagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 40748 - DNA, 402 bp, Glycine max
  Peptide Sequence Number=SeqID_132433
atgcctctatatggcctcattttacctgaagggagatgccttgagttagttcaaattgggatttcttctcttgccctagaactgcgattcaacccttccctttttgagaaccaccaagcaaagttgtttaagctctatcaacatgattttgtggctgattaccagcaacagtttaagaggccatgcaaccatgtccatggtctcacaccagaggcactccttaactattacagttctaggcttcaacctggtatttgtgttgagttaaccattctctgccccactaccatatctaatgccatgtgtcgcaacctacccttcggcgggagggcgacgcgtgactcgcgggatgcgtgttccacgaaaggaatacgcgcggagtcgccaccaacgtttatttga

SEQ ID NO: 40749 - DNA, 508 bp, Glycine max
  Peptide Sequence Number=SeqID_132434
gctatcgtcccttgggacggacgtgtgggatgctaataccttccccgtgcgtaaatacaactcccgaacctttcactttaaagttcgtagatcgtgtcttttccggttttttcgacgttttcctcaaataaacgttggtggcgactccgcgcgtattcctttcgtggaacacgcatcccgcgagtcacgcgtcgccctcccgccgaagggtaggttgcgacacatggcattagatatgaccatggacatggttgcatggcctcttaaactgttgctggtaatcagccacaaaatcatgttgatagagcttaaacaactttgcttggtggttctcaaaaagggaaggggtgaaaaagtggtcagcttggaaaagcttgttaaggggttatgtaccatcaaacaagaggaggtggagtttaggggattaggcaatgttttggttgggtgtgggaaaagggaaagtgttctaaacaaaggggtttgtggaaagaagggtgaccatgggtga

SEQ ID NO: 40750 - DNA, 376 bp, Glycine max
  Peptide Sequence Number=SeqID_132435
gacttagaagcagcagcaactccaaaagaagaacctcgatcttccgaggcatcttctagttttcctattgcagggcattctcatatagaacctgttgaagacctaatcatggctgaagagccaagaagactgattcaaaataatctttttcatggtctacccaatgaagacccttatgctcacttggccacctacatagagatatgcaatactatcaggctggcaggaaacagtcagaagtcatgggatgaagtagtggaaaagttcttgaagaagtacttccatgaatcaaagactgtagaaggaaaagctgccatctcttccttccaccagtttccagatgaatcattgagtgaggcacttgaaagattcagag

SEQ ID NO: 40751 - DNA, 375 bp, Glycine max
  Peptide Sequence Number=SeqID_132436
atgaagcttgacaggttcaggctcttgtctcttgctgaaattgcatattctggatggtcatttgcctcactaactcttctaaggaaggttgaggaggagcctcagttgctggttgtctttgttgtgattgctgctgctgttgttgttgctacattggaggaggaacatatggcttgcttggaccagcgacattctgaaaaggagggacaggctgttgtttttgtgaaggacttgtccatctcagatttggatgattcctccaacctggattgtatctattgcttgaaaggtcataattattatgttgttgttggttttgctgctgaggaggtctattataaatgtttgcagcataagcttcaggttgctcattga

SEQ ID NO: 40752 - DNA, 327 bp, Glycine max
  Peptide Sequence Number=SeqID_132437
atgctagccatcgtcagcaggtaccaagaagaactaaatctagccacgacccacgagcatagagtggcggacgagtatgcccaagtgtacgtggaaaaggaggatagaggaagggtgatcgactcgttacatcaagaggcaacaatgtggatggaccgatttgctattaccttgaacgggagtcaagaacttccccaattgctagccaaggccaaagcgatggcggacacctactccgcccccgaggagatccacggacttctcaggaaaaacaccataactaaacgcgccccaaggcatccctatcgcaccagatccaaatcttga

SEQ ID NO: 40753 - DNA, 192 bp, Glycine max
  Peptide Sequence Number=SeqID_132438
ttctacggagtgcctgtcgcccccagcaaggtcatcaggccccctactaatcgagctttcatcaagaagtactgcgtcccaaggcaggtgcagggcgaaacaccacagtaccctggggatggccggcagtgggcaacagacgcactgccctcacctctagagttcacctcagctcatccacaaaaaggttag

SEQ ID NO: 40754 - DNA, 586 bp, Glycine max
  Peptide Sequence Number=SeqID_132439
atgatgtttgcctttacttctgctggtattaagtttgacaaatcgattaatcattatagaggacctcctacaataagaattcaaggtcaaccatgtcatagaataggtagtatgttaccaatgcctgtgaaagaaccaaaatttgcacaattgtatatctttgacacagaaaatgaagtgcagaataggattaatgcaataagtccacataatcaaattcaagaacacattgtttcacaactcagtgagatgctggatgaatacaacgtgcatgcaaaaactttcaggatggcgagagatagattgcaagatgttcaagtggataatatcaagttgaaattgattgctaatcgtgagaaagatggtcgtacatataatgtacctattgttcctgaagttgcagcactaatagtaggaaattttgatgcaaattcaaaaagagatattattattgaaactcagcatggacaactacaaaggatccatgaattacattctagctatctagctctacaataccctatcttatttccttacggggaagatggatatagacctgatattctacatagcagtcgatcagatg

SEQ ID NO: 40755 - DNA, 342 bp, Glycine max
  Peptide Sequence Number=SeqID_132440
atgtctgtgtcatctcggggaatcacacgacatggaaacctgccccacggtggaagagttacttcaacggctcatggactgggggaatgtgaccggctcccgggtccaagtacccccccgatagtacccaagccaacatcgttttcctatcaaagcaataaggttgttccatggaagtatacccctcccgcttttggagaaagggttgcaaccgaggttgactccttgtcagccaaggtgaccaacattaccggccttagcggcgtaacccgtagtggccgagtgttcgctccccctcactcggcggaattgccctccaaggggaaagcacccatgatctaa

SEQ ID NO: 40756 - DNA, 221 bp, Glycine max
  Peptide Sequence Number=SeqID_132441
atggagatgttgaggcaaatgagcataagagagtcaatggataagaatgaagtattgaaggtgcatcaacatattgctcgcttttggtaccaagcagccattggtcaatatgggccacatttgcccacttctagctatcatgacatcagagttccactcctgaagaaggaagttgaatatactgaaaatttgatgaaaggccacagggagcaatgggtcaa

SEQ ID NO: 40757 - DNA, 465 bp, Glycine max
  Peptide Sequence Number=SeqID_132442
atggtgaaagttggaacctcttacgtgccgatcaacgtctcattttcgccaaaagttggcccagggcttcccggttccaacagggacaccaggatttatttattctgcgaagtgatcttcccgtcacaggtgctccagtggcttctgtttctatcagctgtcccctcctgttcagctactgacggggtggtgcgtaacggcaaaagcacccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 40758 - DNA, 377 bp, Glycine max
  Peptide Sequence Number=SeqID_132443
accatgtatgggggctgacgcctgcccagtgccggaaggtcaaggaagttggtgacctgatgacaggggagccgacgaccgaagccccggtgaacggcggccgtaactataacggtcctaagggcaaagaaggcctccttctgggggggccagagccatcagtgagataccactctggaagagctagaattctaaccttgtgccaggacctacgggccgagggacagtctcaggcctcccaaaaggtaacggaggcgtgcaaaggtttcctcgggccagacgggagattggccctcgagtgcaaaggcagaagggagcttgactgcaagacccactccgtcgagcagggacgaaagtcggccttagtgatcccgacg

SEQ ID NO: 40759 - DNA, 411 bp, Glycine max
  Peptide Sequence Number=SeqID_132444
atgagaactgcacgccctcaccttcagagggctacacgtcctcaccttcagagggctgcatgtcctcaccttcagagggctgcacgtcctcaccttagaggactacaagtccttgccatcagagggctgcatgccctcaccttcagaggactacacgtcctcaccatcagagggctgcatgccctcacctttagaggactacacgtcctcgccatcagagggctgcacacccttaccttcaaagggattacacgtcctcgccttcagagggttacacgccctcgtcatcggagggctacacgccctcaccttcagagggctacatgtcctcgccttcagaggactacacgtcctcgccatcagagggctgcacgccctcaccgtcagaaggctacacgccctcacctttag

SEQ ID NO: 40760 - DNA, 183 bp, Glycine max
  Peptide Sequence Number=SeqID_132445
atggtgaaagttggaacctcttacgtgccgatcaacgtctcattttcgccaaaagtcctggcccagggcttcccgggtggtgttatccgtcacaattccacacaagcataccgagccggacatcagcgtggcaagtgtagcctggggtctaagacgctgacgctaacctcacaccccccttaa

SEQ ID NO: 40761 - DNA, 297 bp, Glycine max
  Peptide Sequence Number=SeqID_132446
ggtgatagggcactgataatcgattatcagttgggtgtaatcgattacacagtgttacctgctactgttgagccggttcaagtgatagaggtgtcatcctctgaagaagatcttgaagaggacccagaggagttacctcctgaacctgctgtggatgcccttgacttcccagaggatgatgaggatccactccctgatgttgattctccaaaggatgttatgtcagcatctgaggcagactctacagaggagagcgaccctggagggacaacgaatagtgatgactcttcatcatag

SEQ ID NO: 40762 - DNA, 327 bp, Glycine max
  Peptide Sequence Number=SeqID_132447
atggctccgaaaaagctttccacgaagagatctaggagagacgtcacggcagaagggtccagtgccgcccccgagtttgatagccaccatttccggagcgccgtgcaccagcagcgcttcgaggccatcaaaggatggtcgttccacagagagaggcgcgttcagctcagggaggatgagaaggccagtagtgcgagttcagccagaggaggaacagggccgacgggttcgacgaggaggccattgcccaactgctatgcacaccggggcaggatttcacccggacccctgcagggaggccggtgcggatcatgcgcaccagcatga

SEQ ID NO: 40763 - DNA, 351 bp, Glycine max
  Peptide Sequence Number=SeqID_132448
atgttcgaaagttttcaacaacaaaatcaaatgtcagttttggaattgtacatagaaaaggatgtggctggtggttctatgtttcattctgcaaattctcttacatcatgcgaaaataatttatctaataatgaggcgcaaccgccaacaaatgtgagcaacttacacagtgatgatgatgatgatgattatcttgtgtctaactcatacgttgaagagtctttagacgaagatgatagtgttgacgatatatctgatacagacgatgaagtcgccgacatcattcaaccagtaagaattgttcactcagcagaaggtgtacaaggaattgaaaatccattttgggaatga

SEQ ID NO: 40764 - DNA, 537 bp, Glycine max
  Peptide Sequence Number=SeqID_132449
atgttagctatcatcaccaagtaccaagaagaactaagtatagctacgacccacgagcatagggtggcagacgagtatgcccaagtgtacgcgaaaaaggaggctagaggaagggtgatcgactcgttacaccaagaggcaaccatgtggatggaccgatttgctcttactttgaattggagtcaagaacttccccgattgctagccaaggctaaagcaatggcgaaaacctactccgctcccgaggagatccacggacttctcgactattggaaaaacaccataactaaacgtgccccaaggcatccctatcgcaccagatccaaatctagaatgatgggtgatcaagaggagacacaggaacagatgaaagccgacatgtcggctctgaaagaacaaatggcttccatgatggaggccatgttaggaataaggcaactcatggagaaaaatgtggccactgctgccactgttagttcgactgccgaagcagacccaactctcctagctaccgcgcaccatcctcccccaagtgcg

SEQ ID NO: 40765 - DNA, 393 bp, Glycine max
  Peptide Sequence Number=SeqID_132450
atgaggggagcaccgacggaagaaagcatatctcctttccttgtgagggatttcagcgcacaaaatttcaaggttgtacaagcaattcataaggcatgggaaaccccgttaaggaaagatcaagaacttaggggcattcgtaatggcatcattggtggataccatgaatggctgaaagttcatatacgaggtttagattggctcgccaagttaaaagtcgtcagtgaagagagttttgaagcaccggaagaggacgaagaagtccgagctctcaaaagcgagttaggaaaggcgaaacttgcccaagagaagttcaagttggccgctacacacatccggaaggagtgtgccggattacgggaagagaatgcaatccaccgcacgagcccttga

SEQ ID NO: 40766 - DNA, 1055 bp, Glycine max
  Peptide Sequence Number=SeqID_132451
gatcccacatatggcaagtcaaggggattgggtcccgtttatggatgtgttagcgttgctaatttttggggtcgtcctctttccaaacatagatggtttggtggacctagcagcaatcgacgctttccttgcataccaccatagcaaggaaagtccggtagtagctgtcttggcagatttatttgacacatttgaccgaaggataggaggtagagcaatcaattggttcccccgatggaaggaaggaaaggagggagtccttttctcatgtggagggtacccaaacattccgctgataggaacgaggggttgtattaactacaatcccgcgctcgctataagacaactagggtaccccatgaggggagcaccgatggaagaaagcatgtctcatttccttgtgagggatttcggcgcacaaaatttcaaggctatacaaagaatccataaggcatgggaaacccccgagctaggaaaggcgaaacttgccaaagagaagttcaagttggccgctacacacatccggaaggagtgtgccagattacgggaagagaatgcaactaccgcgagagcccttgaacaagagaccaagagggctcgcaaggaagagtatggccgtaacaaatttcgcggagctctgtggggtagcaacagtgaactcaagctgcgaagggaagagagggaccagtcgcgagcacatagcatggtcttgaaagaggagttagtttcctgttcaaggtccaaaaggaacttgtctcagcgtttacgcgagacggagaccaacatgctagctatcatcgccaagtaccaagcagagttaggcctagccacggcccacgagcatagggtcgcagacgagtatgcccaattatacacggaaaaagaggctagaggaagggtgatcgactctttacaccaagaggcaaccatgtggatggatcggtttgctcttaccttgaacgggagtcaagaacttccccgattgttagccaaggccaaggcgatggcggacacctactccgcccccgaagaaattgatgggcttctaggctatt

SEQ ID NO: 40767 - DNA, 372 bp, Glycine max
  Peptide Sequence Number=SeqID_132452
atggcagcgcagttgatccatgatcgcgttgtgatggagtgcctagaggtacatccggagcaacccgcacgcacacttcagcagcctgtggagtggatactacctacacctactccatatcgactagttgagccggttcaagtgatagaggtgtcatcctctgaagaggatcttgaagaggacccaaaggagttacctcctgaacctggtatggacgcccctgacttaccagagcatgatgaggacccactccccgatgttgattctccagaggatattatgtcagcatctgaggcagactctacagaggagagtggccctagagggacagcgaatagtgacgactcttcatcataccaaacggctccttag

SEQ ID NO: 40768 - DNA, 66 bp, Glycine max
  Peptide Sequence Number=SeqID_132453
cgattctgtggaattcttcatcgttcttcaccgttcttcatccgttcttcgttcgttcttcaacgg

SEQ ID NO: 40769 - DNA, 825 bp, Glycine max
  Peptide Sequence Number=SeqID_132454
atgggtgccaagtacctcgaaacagtcaagcaaaggttgcatgccatcaaacaatggtccccggatgaaattaggattgatgttaagattggttttgttgcaatgcttcaggttcaggaagctaagaacaagcttgatgttcctaaaaatgcaaaggaaaaagtttgtgatgaaaccaaggggcataaattggatattactggtgacaaagatgtccaaattctggatgatacaaagtcaagcagaagaagtggtacttctactatggacgatgaagcaataagattatctggtccaaataggagaccacattttgaaataactaagaactccaaaagaggaaatgtgaaagccaatatggaaactgacaatttagactctgttcaggaatcaaaattagaaacacagttgaatactgtaccaaggaagaggggtcgtaagcctaattctttaatgaatgctgaggaagcctatgatcactcatggatttctcaagaaacaaaacctgggaaatcagccaatccagaaaggctcgcaattgcagctctccttatccatcttttgaaaaacatacttctagaaaggataagttgcatagaatgcctaaaactttcgagccgcttcaagtcaatatacttcctcactctctcttcgggtccgagtcacgagcttcgagccgtgaaagaagatgaaaacattgctgggaacttcaagtgggctaggtgcaaaggaagaacaacgaagaacaaggctagggttcgagtcgggttagcagtcaaggtgcaaaggaagaaggaagaaaggctacctaggagtgaactttga

SEQ ID NO: 40770 - DNA, 198 bp, Glycine max
  Peptide Sequence Number=SeqID_132455
atgctgacaaagaagaaaccgtgtcgcaacgtgcccttttgcgagcgagcgagggcgaggctcacgggtgcgctttccaaaggaggaaagatgcgcggagtcgccaccaacgtcgacaaaagcggggctcttgctcctacgtaccctctatcaaagaggaaatcagacctacgtagttctttcttaggcgtgaatcaa

SEQ ID NO: 40771 - DNA, 362 bp, Glycine max
  Peptide Sequence Number=SeqID_132456
atgcttatggacctgacaaagaatcagatgttagggaaagttattgcatatgaaattgatcaaattatagcagcagagataccttcacagcaagatcatccagaactgcattcattagtaaaaaaccatatggttcatggcccatgtggaacttcgaatcctagatctccatgcatgaaagaaggcaactgcagtcatttctatcctaaaatattccagtcgcatactgttttagatgcagatggttatccggtctaccgtagaagaaacaatggtcacacaattgagaaaaatggtgttataattgataacaagttgtcgcaacatgcccttttgcgggcgagcgaaggcgaggctcacgg

SEQ ID NO: 40772 - DNA, 273 bp, Glycine max
  Peptide Sequence Number=SeqID_132457
atgtcgattttggaaatgttcgatcggagtcatcccggtcatgcttcttttttaagacctcgatctgtcatcttttcctggccgacgtcggctagcatttttttcgatcaatatcggaaatgttcgatcggcgtcatcgggggtgatgcttttgatttctggacctcgatcggtcatctttcctggacgacatcggctattgtttttctcaatcagtgtcggagaataatggttgttttgccgaggtgggttaatgtgttcctggcagagtaa

SEQ ID NO: 40773 - DNA, 759 bp, Glycine max
  Peptide Sequence Number=SeqID_132458
atggacctcatcatggctgctggactgctgaagactgtcaccaagttgggagattgctatgagagtctagtcagggaattcattgtcaacattccctctgacataacaaacagaaagagtgatgagtatcaaagagtgtttgtcagaggaaaatgtgttagattctcccctgctgtgatcaacaaatacctgggcagaccaacagatggagtggtggacattactgtttctgagcatcaaattgccaaggaaatcactgccaaacaaatccagcattggccaaagaaagggaagctgtctgcagggaagctaagtgtgaaatatgcaatcctgcacaggattggagctgcaaactgggtacccaccaatcatacttccactgttgccacagagaatcgcctctatcccctgcattacaaattgtttgaggggacacatgtcccagacattgtctcgacatcaaggaaagctgctgcttcaggtgctgtgtccaaggatgccttgattgctgaactcaaggacacatgcaaggtgctggaagcaaccatcaaagccaccacagaaaagaagatggagctagaacggctgatcacaaggctctcagaaagtggcattgatgatgaagaagcagctgaagaagaggaagaggcagctgaggaagacaaagaagcagctgaagaagaagaagaagctgctgaggaagaggaagatgcagcagaagagacagaatcagatgatgattctgaagccaccccatga

SEQ ID NO: 40774 - DNA, 228 bp, Glycine max
  Peptide Sequence Number=SeqID_132459
atgaccaagtgcccctccactacgaatttcaacttttggtggagtgtagaaggcacaactcctactgagtggatccacgggcgccccaacagacagctgcccatttgggccctccagaaggttcctccagaaggcggttgcttctggaggaagcaaccctgctcgcctgggcgagctgagctcgcctgggcgagctgggcggcaagcatctcccctattttgctataa

SEQ ID NO: 40775 - DNA, 483 bp, Glycine max
  Peptide Sequence Number=SeqID_132460
atgtccaaatcttgtggatttgggatgaccggccctctcgatgagtcgatctcttgctttctcataagggtggacccttgggtacttgtacctatcacttttagaggactacacgtcctcgccaacagagggctgcacgccctcaccttcagaggactacatgtcctcgccttgagagggctacacgccctcaccttgggactacacgtcctcgccttgagaggactacacgtcctcaccatcagagggctgcacgccctcacctccagaggactacatgtcctcgccttgagagggctacacgccctcaccttgggtactagttaccctcaccgtcagagaggactacacgtcctcgccttgagaggactacacgtcctcaccatcagagggctgcacgccctcacctccagaggactacatgtcctcgccttgagagggctacacgccctcaccttgggtactagttaccctcaccgttga

SEQ ID NO: 40776 - DNA, 381 bp, Glycine max
  Peptide Sequence Number=SeqID_132461
atgacacgcagagacaaaatttggtcattctgcacccttgtgtcatccagaggcggcgggcccgatgacacgcggagataccttacgattatccgcacccttttgtcatccagaggcggcgggcccgatgacaagcagcggcaacaatgtggtcattctgtacccttgtgtcatccagaggcggcgggcccgatgacacgcggagataccttacggttatccgcacccttttgtcatccagaaggcggcgggcccgatgacacgcagagaaccttacggtctatccgcacccttttgtcctccagaggcggcgggcccgatgacacgcggagaaccattacggttatccgcacccttttgtcatccagggggcctcgatga

SEQ ID NO: 40777 - DNA, 690 bp, Glycine max
  Peptide Sequence Number=SeqID_132462
atggcctccatgatggaggccatgttaagtatgaagcagctcatagagaagaacgcggccaccgccgccgctgtcagttcggctgccgaagcagacccgactctcttggcaactacgcaccatcctccctcaaacatagtaggacggggaagggacacactggggcacgatggtagccctcacctgggatacaaccgagcggcttacccttatggattgccgcccaactattcaccacccgtcttgcaagaagatgcgggccacattgcttctcccgtccatgaaagagagcctcctcagcatcccgacgaagtccacaaagaccctcaagattatgctcgaagggatgtcgagttctatcccccgatccccgaagggccggcaccaggcacgttgcctcaacccaacatcgcagcaccaccaatagttttgtccatggaagggccgcccccagcaactgaagaaaggaggaagctcgatctccttgaggaaagattgagggccgtggaaggatttggggattatccgttcgcagacatgacggatctttgcttagtacccgatgttgtattcccccgaagttcaaagtgccggacttcgacaagtataaagggacgacttgtcccaaaaatcatctcaagatgtactgccgtaagatgggcgcccactctaaagatgaaaagctattaa

SEQ ID NO: 40778 - DNA, 669 bp, Glycine max
  Peptide Sequence Number=SeqID_132463
atgagtcatcattcatctagtgttaatggcgagggtactagtcataaagaccctttatctagaatcttagatgagttgagtaccctcaagttatggaaagaaaaacaagagagaaaagaaaaaggaaaaaaaagagtggaagaaataagtcaagatgaaagaaagaaaataagagaggaagaaagaagaaaaataatgaaagaaatgaaaagagaaaaacatgcctcctatagtagtcataactcttgcaaaagcctaagtgaagaacttcgtgactattacgaaggaaggcataggtcacatcttagacctcactcccatagaagagaaaaggaaagaaagcctcaagaggctaacattaacctctcatacttccgtgggaaggacaatgtagaggctaacttagattgggaaataagggtagaacaaaaacttaaaaagaagtctccttcaaaatcttatggctctcactcttattcaaagaaagaccaaggtcaaggcatcttaagggtggcgccttctaagcccaaagatgataaggggaagacaatagaaaagcaaccccctaaggctagtatgcaagagaagactagctctataaagtgctttaaatgtcttggaagaggacacattacttctcaatgccccaccaagaaaccacgattatga

SEQ ID NO: 40779 - DNA, 120 bp, Glycine max
  Peptide Sequence Number=SeqID_132464
atggagaattggcgaatagcgctaggcaatgacattcgcggggctccacactcgaaggcaatcatgaagcatagctccaatctcgaaggtggaggacacatgaacagcactaggcaatga

SEQ ID NO: 40780 - DNA, 216 bp, Glycine max
  Peptide Sequence Number=SeqID_132465
acttatcaaggtaatccttgtggcgtctatcctgacttatcttccttcactggaagtggcgtctacccagacttatcttccttcaccggaagtggcgtctatcctgacttatcttccttcaccggaagtggcgtcatccaaaccttcgtagcctgtatcaaacgatccgctcctactcaggttcacatcatctggtatcagagcttcggctcttga

SEQ ID NO: 40781 - DNA, 526 bp, Glycine max
  misc_feature (23)..(23): n is a, c, g, or t
  Peptide Sequence Number=SeqID_132466
gactccatgtcctcaccatcagnagggctgcacgccctcacctccagaggactacacaggactacacgtcctcgccaacagagggctgcacgccctcaccttaagaggactacacagggctacacgccctcgccatccagaggactgcgtaagtcctcgccttgagagggctacacgccctcacctcgaggactgcgtgtacctcaccttcagaggactacacgccctcgccttcagaggtgcctgtccttaccttcagaggactacacgccctcgccgtcaaagggcatgtgccttcacctttgtagggctacacgccctcacctttagaggactacacgactcactccctcgccttcgaaaggctgacacgtcctacttcaccgtgagaggctacacgcctcgccttgagaggactacgcgtcctcaccatcagagggctcccatatccacaagaggactacatgtcctcgccttgagagggctacacgccctcaccttgggtactagttaccctcaccgttga

SEQ ID NO: 40782 - DNA, 833 bp, Glycine max
  Peptide Sequence Number=SeqID_132467
atggtgaaagttggaacctcttacgtgccgatcaacgtctcattttcgccaaaagttggcccagggcttcccggtatcaacagggacaccaggatttatttattctgcgaagtgatcttccgtcacagtggcttctgtttctatcagctgtccctccctgttcagctactgacggggtggtgcgtaacggcaaaagcacccgcccggacatcagcgctggcaagtgtagcggtcaccgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatgcgacgccgccgtcgctttcgaggaagtcgttagggttcacggctacggcggagagatcaacccgctcgggggggcccggtaccagcttttgttccctttagtgagggttaatttcgagcttggcgtaatcatggtcatagctgtttccttcgggaaacctgtcgtgccagctgcattaatgaatcggccaacgtgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40783 - DNA, 273 bp, Glycine max
  Peptide Sequence Number=SeqID_132468
atgagattgactcagtcctacaattctgtcattcttccgcaacaggtggccatcttggcatacagaggacagctcgcaaggtgcttgactacggtttctattggcccaccatcttcaaggatgcgtagagaatctgtagcacttgtgagccttgtcagagagcaggcggctcaccttcatggagatagcaaatgcctcaacaacccatgttattctatgaggtttggtatccctagagccatcgttagtgatcaaggcaccctatttttgtaa

SEQ ID NO: 40784 - DNA, 139 bp, Glycine max
  Peptide Sequence Number=SeqID_132469
atggtttccgtgaagaaaatcgaagctgaggtgcttccgtaccgcttccgagacgtttccgtgagcaaatccgtgaaggttttctgtcgttcttcaccgttcttcattgattcttcgtttgttcttcgttcttcaacgg

SEQ ID NO: 40785 - DNA, 972 bp, Glycine max
  Peptide Sequence Number=SeqID_132470
atgcctggaaaagaacctaaatttgcacaattgtatatctatgaaacagaaaatgaagttcaaaatagaattaacaccatgagccactataatgaaattgaggcacatattgtctcaaatttgcaaaaaatgctagatgaaaacaatgctcatgcaaaaagtttcaggatggcaagggatagattgacagacactgaagtgcataatgtcagactcaaattgattgctggtgatattgatgcaaattcgaacagagatattattgttgaaactcaaaatggtcaattacagaggatacatgaattacattgtagttatctagctctacaatatcctctattgtttccttatagagaagatggatataggcctgacattctacatcgtgatacattaagtgggacaaaaagaaaaaggaatcgtcttacaatgagagagtggtttgcttatagactgcaatgcagacccaatgaaggtcaaactctgcttcattctagaaaactatttcaacaatttgttgctgaaggatacacgatgattgaatctgaaagactttcctatgttagaaacaaccaaaagaaactcagagttgacaagttctatagcttgcagcagtcatcagatgctggaaatacagaaggtttaagccaaggcaagaggatcatcttaccttcaacctttgttggcaacccacgttacatggatcaactttattttgatggcatagctatatgcagtcacgtaggattcccaaatctttttattacttttacctgcaatccaaattggcctgaaattcataggctgctgacacctttgaatttgacatcaatagataggccagaaataatctcccaaattttcaagcttaaatatgagcagatgttatcagaccttacaaagaatcacttgctaggcaaagttgtcgcatgtaacttgatgctaattcctttttctgctactaacagataa

SEQ ID NO: 40786 - DNA, 418 bp, Glycine max
  Peptide Sequence Number=SeqID_132471
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgcttgacatttgtggcatttcctcacatggacacaacaatcactttccatg

SEQ ID NO: 40787 - DNA, 103 bp, Glycine max
  Peptide Sequence Number=SeqID_132472
ggtattggatagaagactccaagaggattggactagagctgttaaagaaggccctaaggttctcatgaacctaagggtagattttttgagcacatgggccaag

SEQ ID NO: 40788 - DNA, 585 bp, Glycine max
  Peptide Sequence Number=SeqID_132473
atggggacaaatcaaactggcaaaaggttttatcaagtcaagattaagggcttagatatcaccagcattaaggaattggggcagttgatgggacctctccaaatgcaagccttccgcaaggcgtacgaaaagatcttagatttgaccatagcagagatatccacagaagccattgcaacactcgcccaatactatgaccagcctttgagatgcttcacgtttggagacttccaattagtaccgaccgttgaagaatttgaggagattctaggatgtcctcttgggggaaggaaaccatatcttttcttcgggttccttccctccttgagaaaaattgcaattgtggttagggatttggcgagaggattggaccgtgtgaagcaaactcgaaacgacatagtgggcctatcacgtaagtacttagaaggcaaggcgagggatatggcgaatcaagacgagtgggtcccgttcatggatgtattagcattgttaatctttggggttgtcctattcccaaacgtggatggtttagtggacctagccgcaattgatgctttccttgcatatcaccgtgggatcctctag

SEQ ID NO: 40789 - DNA, 504 bp, Glycine max
  Peptide Sequence Number=SeqID_132474
atggtaacaagaagtacctccaaattaattaatgtactcaatgaagatagtgaccaaaagtcagaaaatgcagctgagataggttcgagaaaggatatagactacccttggaaacaagacatcataggtaatccaacaacaaatgtcataacaaattggcaagtgaaggatggtgagttaatccagtcggaattacctcccacaacacaatatcaactaccaaatatcaaagacagtaacaacaaacctgtcatggcaattccattcaagacaaaagatgtcaacgaggaagtaacctctagagacattaaaagcctaatggaacaggcaaattataccaacaaatacttacaagctttaggagaaaccattaaaactaaggtagttcctaaacaaaaatcaattgaggaagcttcgccgagtgtccccattgaaaaacctttattcaaacctttcaagttagtgataaggctaaacgaaaaattagggaacttagaaaactaa

SEQ ID NO: 40790 - DNA, 145 bp, Glycine max
  Peptide Sequence Number=SeqID_132475
atgggcgacaccgcggaaggtaaaaacatcgcgcaccaggttaagaaaatgaacatggacggcgttcgctacgtccgcgatcgtttcaacgtgccggtggctgatgccgatatcggaaaactgccgttcgtgaccttcccggaag

SEQ ID NO: 40791 - DNA, 643 bp, Glycine max
  Peptide Sequence Number=SeqID_132476
aacaagcaagacaagtgtttacgtccaagatcctggcgattcaagatattcagtggttcttcaaggcagaccaagtggtttaaatgacacacatgatggttccacacgtgatatttgtgaaactacacctttttccactaaaattccttctaccaatgactcattacacgttgatgaggtgcaagcaaatcacaatgatcatgatgaaggactatgggaaaccaataatcatggcaacaccaccagcatcccctcgcagtccaatcagcagtcagaggcgatgtctaggaatactagacgattgacacggcttaggatgttgactagaagaaccttggatcagccgcgacctattgtcaccgttgatgctgcaactggttggaaggatgtaccggacacactaaaggagctagtatggaatgagattttggccaagtttgatatcccagaagccctagatgcaaagaaaaaggtgatgtcaactatggccactagatggaggcagtttaaatcatccctgacaagtaaatttgtgtttagtatttctgaggaccaacataaagaagatccttctgtcagatatggctttgatgcacagatatgggaggaatttgcggcaacccgcaaaacccctagttggcag

SEQ ID NO: 40792 - DNA, 321 bp, Glycine max
  Peptide Sequence Number=SeqID_132477
atgccgccacctcatcaggctggcccagatgggccatttgattcagagcagtatttacgacatgtggttcgccagcaggcggccaaccatcgggcgtacatgcagactcatgactgtctttaccagctaagcctcaacctacagagccagggttttacttcttttccatgccctacttcggatcagttcagggcagaggtcgcttggcccggagattggccggaggcaccagcagaggctcccgacgaggcagatgaggcccgcgagaatgaggagatgatcgatttgcttgatttcttgggagggagcggagccacatga

SEQ ID NO: 40793 - DNA, 233 bp, Glycine max
  Peptide Sequence Number=SeqID_132478
acacttgctagcattgccacacctcttgggcttgagtttattcctcaagtaaagaagttgttggatgaggcaccactcattgagttggtgagaaaccatgttccttcatgggaagatgcccaggaaatgggtgttgagggaaggagcccaaggtatgaagaacctcggtatttgaggtcaaatcctttccaaggtggagggaatgatgcaatcctaccccgcaagggcattgg

SEQ ID NO: 40794 - DNA, 772 bp, Glycine max
  Peptide Sequence Number=SeqID_132479
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgataccaacaccaacactgaggctgtctcaaatcagcctcagtgtcggtgttggttaatggtagtcccacagctcaatttgcccctcaaaaaggccttagataggcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 40795 - DNA, 210 bp, Glycine max
  Peptide Sequence Number=SeqID_132480
atggagaatgtgcttccccttcataaacgttgtttgcctttcatcaataagatgaggcagcacgagggccaaccttttagccagaattttggccacaattttatagacacatcatatgagagatatgggtctatagtcattaagagattgagggtctttgatctttgggatgagagctataaacgatgcattgctgccttttggaaatga

SEQ ID NO: 40796 - DNA, 306 bp, Glycine max
  Peptide Sequence Number=SeqID_132481
atggtgaaaccatcgaaaagcgcaaaggaacttcgagtcatagtcagcggcattctgggacacaggaagctccaattcctccctccattccctctgggtcattattctcatcagaggaacagcgtacacgaaaaagctccatctttttctagcattcaagtctctgaaaaagttttcagaaacttcttctctcctagaaagccttattgtttttgttttcggttaaaactaaccacggtaatcgattaccataatagtgtaatcgatctacaagcagttatttctggcaaagttgctctctggtaa

SEQ ID NO: 40797 - DNA, 270 bp, Glycine max
  Peptide Sequence Number=SeqID_132482
atggagatgataaggaaggatgaattggtgttgtgggtgctccagatggtccgtggcggcgatggccagcagcagcagtggtggaggacgttccctttcgcttcttcgatgatttttccatttgatgaggttttaacgaatttcaattggtggaatctaaatatgagtgaaaatgatgaagattgggctttgcgggacgtgatttggttaagaattgagggagatatgaaggctgctgtaatcgattacaggctatctgttcttgtgtaa

SEQ ID NO: 40798 - DNA, 62 bp, Glycine max
  Peptide Sequence Number=SeqID_132483
aggaaacactgggttcaacaaaaataagagaagatcactcaaagtgtatcaatctcacacag

SEQ ID NO: 40799 - DNA, 240 bp, Glycine max
  Peptide Sequence Number=SeqID_132484
atggaacagtcttcatcagcatcacgggacagaagcatttttcagaatgctactcacaatactgtggatcttcttatccatctccgtgtctacttccctaggacttgttgcaaggctagggaacaggggcttgaccaggaatcatttgtatgggttggatatggaattcaggttgttcctggtttgatggtgctttggtggatgatggagatgatggtacagagggtgaaccagagatga

SEQ ID NO: 40800 - DNA, 702 bp, Glycine max
  Peptide Sequence Number=SeqID_132485
atggttcatggtccatgcggaattttgaggcctgcatctccatgcatgaaggaaggcaaatgcagtcgattttatccaaaaaagtttcaggccacaactattatagatggagatggttatcctgtgtatcgtagaagaaatactggtcggacaataaccaagaatggatatgatagagttaccgttgtcatggtacatgatgacaatgaaacagttccgcatgcaaacactccgaatgatgaaatgaaggaatatatggattgcagatacatttctccatgtgaatctacttggaggatctttggttttccaatacatggtagaaaaccttctgtagagaggctacagttccatcttccaggccaacatagcgttctctaccaagaccatgatgatattgatgatctcctctctaacccaagcatttatgaatcaaaatttatagcttggatgaatacaaaccaggcttttgttgaagaggaccaatctcatttgaagatatcagaacagttgatggtgttgaatattctacatatagagaagcaagttttgctatgggtttttttacaggatgatagagaattcattgctgcaatccaggaagcaaaagactggggcttagcaccttatctaaggaatctttttgcattattacttttgacagataatcaaacactccaggttggcttacatatagcttga

SEQ ID NO: 40801 - DNA, 423 bp, Glycine max
  Peptide Sequence Number=SeqID_132486
atggtgcatcaaacacaaattcaagtagactctaaaacgtcatgtgtatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 40802 - DNA, 177 bp, Glycine max
  Peptide Sequence Number=SeqID_132487
atgccgatctccccctacgaaaggatcgcgcccgcaggacacccagtggacccaaagaaagtgcccatcacccccaacaaggtcattaggccccgcattaatcgggctttcatcaagaagtactgcgcccccaggcaggcagagggcgagacaccacaacagcctggggatggctag

SEQ ID NO: 40803 - DNA, 144 bp, Glycine max
  Peptide Sequence Number=SeqID_132488
atgccggggcgttcctccactcgccaatttcccagctggaaatcaggaaggcatggtcgtaccaaatccaatgcttccttcactttcttgtctccaacgcgagctttgaccactgctcttccttcccccgatgcttcttttcat

SEQ ID NO: 40804 - DNA, 213 bp, Glycine max
  Peptide Sequence Number=SeqID_132489
atgggaccaatcacgagtagacagtttgatcttgaaggattagttgaaggtttgcctaaggtccaaaagaagcctatctcagcttttatgcgagacgaagaccaacatgttagccatcatcagcaagtacaaagaataattaaatctagccatggcccacgagcacaaagtggcagacgagtatgcccgagtgtacgcggaaaaggaggctag

SEQ ID NO: 40805 - DNA, 156 bp, Glycine max
  Peptide Sequence Number=SeqID_132490
atgggggtgcaaatagcacccaggcccatttgggccctccagaagattcctccagaaggcggggaggaaggcaagaaggaaggggaatctcgcaaagctttcaaccgttcttcgacgttcttcattcgttcttcatcgttcttcgatcttcaacgg

SEQ ID NO: 40806 - DNA, 603 bp, Glycine max
  Peptide Sequence Number=SeqID_132491
atggccctgaggaagcttgcctcaaagaggtccaggaaggataaagcggccgaaggaactagttccgctcccgggtatgacagccaccgctttaggagcgctgaacaccagcagtgcttcgaggccatcaaagggtggtcatttcttcgggagcgacgcgtccagctcagggacgatgagtatgccgatttccagggggagatagttcgccggcggtgggcatcactggttacccccatggccaagttcgacccagacatagtcctcgaattttatgccaatgcttggcctacggaggagggcgtgcgagatatgagatcctgggtgaggggtcagtggatcccgttcgatgcggatgctatcagccagttcctgggatatcctttagtgctggaagagggccaggagtgcgagtatggccagagaggaaccggtccgatggttttgatgaggaggtcatcgcccagttgctgtgtataccgggcaggattttgcccggactgctgcagggaggcgagtgcgaatcatgcgcaccaacatgaccaccctgacccagatatggatgacgttgctgctcagcaacatcctgcccagcgatcataa

SEQ ID NO: 40807 - DNA, 523 bp, Glycine max
  Peptide Sequence Number=SeqID_132492
atggaggccatgaaagagaaaatggccacaatgatggaggccatgatgagcatgaagaagataatggaagccaatgcggttacaattgccgctactagcactgttgctaaggtgaacccgatgcccccatctggcctcaaccaaatgaatcatccaacctcagctatggtaggcaagatttgggaagtacgggcggcccccatgatgtgcaaatccaaaacgagcacgccttctcgccatatggcttgccttttcaactatacaccacccaatgtggcgtacactcccaataagaatacacttgaaattccccaccacaatctagccgacttcgagccttgcctcagatatgccactaaagagcaagcagttggtggtatacccctgcaaaacactttggagggtcctcagtatcacccacaactacacctcttgcattccacaaaaagtaaaacccctcatgctatggcagaaatgggaaagttggatcatctagaggaaaggctcagagccagtgaaggag

SEQ ID NO: 40808 - DNA, 381 bp, Glycine max
  Peptide Sequence Number=SeqID_132493
atggagctggacacacaaaatgaaattctagcacaaaacaaactcttaatgcaacaaattgaggccttaacgaagcagatagccaacttcctcagcaatatcaccaagcacctggtgatggacaacaagaagatgaggcccattatctgtagaactaagccagacctcaataaaactttcaaggaagctaccaaggctataggggtggctcaggttcaaatcagccttatggctggagaccacataataatgcgtactctagtccaaataacacttcgtttgcaagtccttctaacaactcttatggaggttcttcaaataagggtccacaacaacaacaagctcaatcagatagattgcccaagatggaagatacattaa

SEQ ID NO: 40809 - DNA, 429 bp, Glycine max
  Peptide Sequence Number=SeqID_132494
atgggtgaagtagaggagatgcaagagaagatggaggccataaaagagcaaatggccacaatgatgaaggccatgatgagcatgaagaagataatggaagccaatgcggttatagttgccgctattagtgctgtcgctaaagtgaacccgatgctcccatctggcctcaagcaaatgaatcatccaacctcaaatatgataggcaaagatttgggaagtacggatgaccccatgatgtgcaaattcaaaacgagcacgccttcccatcatatggcttgcctcccaactatacaccacccaatgtggcatacactctcaatgaaaatctcaataactccactccgatactcattgagaacaaataacctcatcaggcacatatctctcaaaccatgggggagacacatgaaattccccaccacaatctag

SEQ ID NO: 40810 - DNA, 549 bp, Glycine max
  Peptide Sequence Number=SeqID_132495
gggcaatctaggtgatttacaaccctttgatcttgaaatagatagaaccattgatagattagttaggcatagtgtgcatcctggtcattttgtgcattttgagcattttgagcattctaagtattctgttgctggtgattctgaatattctaattttgagcattcaactactaattttcatactgagaacatggctcaacctccacctcgtgagaggactcttaaggagatggctacacctgatttcacttatgaaagcttgtgcattcaatatcatgatgagggtgttccacatgttctcaagattggactaatacatttgctgcccaagtttcatggtcttgcaggtgaagatcctcataagcatcttaaggagttccatattgtttgttccaccatgaagccccctgatgtccaagaagatcatatctttctaaaggcttttcctcattctctggagggagtggcaaaagattggctatactaccttgctcccaggcaacttagtggagagagcttgtatgagtactgggaaagattcaagaaatt

SEQ ID NO: 40811 - DNA, 339 bp, Glycine max
  Peptide Sequence Number=SeqID_132496
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggcgcgtcccattcgccattcaggctgcgcaactgttgggaagggcgatcggtgcgggcctcttcgctattacgccagctggcgaaagggggatgtgctgcaaaggcgattaagttgggtaacgccaagggttttcccagtcacgacgttgtaaaacggacggccaagtggaaattgtaa

SEQ ID NO: 40812 - DNA, 162 bp, Glycine max
  Peptide Sequence Number=SeqID_132497
atggggcgcttaggagtacataacaagacgcaccacacaatggtcagggtcactctattttgcgagaatgttccaaccatatgggatcatcataggcttaaaggagcactcaaaccgagtgtgtctttacccccagggcctagacttcgaagaatccgttag

SEQ ID NO: 40813 - DNA, 588 bp, Glycine max
  Peptide Sequence Number=SeqID_132498
atgtcgcgggggtcaggagaccttggggacgccaggtggggtgctattgcccaaaaccaagcttggccaatcctgacccaacccgagcatagtcagtcagtgagaacctgtgacgtacctaagcaggcgagctcctggcagtcaaccaataaaagaacaaaagtccacaaagcaagaaggcttgtgtggcggctggccagctatctatcttgtgttttatctgaaaagttccctctgggtgtttgggagaccctcgaaggcaatgagaggtgccgattccgtggcacaattcaactcactgctacttcactagtacatccggagcaacccgcatgcacacttcagcagcctttggagtggatactacctacacctacaccatatcgactagttgagcctgttcaattgatagaggtgtcattatctgaagaggattttgaagtggacccagaggagctacctcctgaacctgctatggatgcccctgacttaccagagggtgatgaggacccgctgttgattctccagaggatattatgtcagcatctgaggcaaactctacagaggagagtggccctggagggatag

SEQ ID NO: 40814 - DNA, 459 bp, Glycine max
  Peptide Sequence Number=SeqID_132499
atgggaacaaatcaaaccggaaaaagattctatcaagtcaagattaagggcctagatgtatccagccttaaggagttggggcggttgatgggacctctccaaatgcaagccttccacaaggcgtatggaaagattttacatttgaccatatcggagatattcacagaggccgttgtatcactcacccaatactatgaccagcctttgagatgcttcacgtttggagacttccaattagtaccaactgttgaagaatttgaggagattctaggatgtcctcttgggggaagaaaaccgtatcttttctccgggtttcttccctctttgagcaagattgcaattgtggtcagggattcggcaagagagttggatcgtgtaaagcaaactcgaaacggcgtagtgggcctaccacggaagtacttggaaggcaaggcaagggatatggcaaatcaagaatag

SEQ ID NO: 40815 - DNA, 54 bp, Glycine max
  Peptide Sequence Number=SeqID_132500
cctcgagggtccgtcccatcctctgaaaaatgctatgagggtggttgggaaatg

SEQ ID NO: 40816 - DNA, 270 bp, Glycine max
  Peptide Sequence Number=SeqID_132501
atggtgaaagttggaacctcttacgtgccgatcaacgtctcattttcgccaaaagttggcccagggcttcccggtatcaacagggacaccaggatttactcttttctgacgagctcccctccttcacagcgttgcgctcactcacacccgccgcgcttatgcgccgctacagggacgctgtctgccatcgctgcattcaaggtgaatcgccaactgtgcgcgaagggcgatcggtgcgggcctttcgcgtattacgccagctggcgctaa

SEQ ID NO: 40817 - DNA, 267 bp, Glycine max
  Peptide Sequence Number=SeqID_132502
atggctgatgagcaacctagacgagtaacccttgaagactactcaatcagaattgctggagtgccagaagatgtagttaggatcaacttattttcattttcactatctggagaagccaagaggtggctacattcattcaaaggtaatagcttgaggacttgggatgaagttgtggaaaagtttctgaagaaatatttctcagagtccaagactgcagagggaaaggctgtcatctcttcctttcaccagttcccagataaatcttga

SEQ ID NO: 40818 - DNA, 279 bp, Glycine max
  Peptide Sequence Number=SeqID_132503
ggcgcgtcccattcgccattcaggctgcgcaactgttgggaagggcgatcggtgcgggcctcttcgctattacgccagctggcgaaagggggatgtgctgcaaggcgattaagttgggtacgccagtgttttcccagtcacgacgttgtaaaacgacggccagtgaattgtaatacgactcactatagggcgaattggagctccaccgcggtggcggccgctctagaactagtggatcccccgggctgcaggaattcgatggtccaacgccttaaatga

SEQ ID NO: 40819 - DNA, 417 bp, Glycine max
  Peptide Sequence Number=SeqID_132504
atggtgaaagttggaacctcttacgtgccgatcaacgctctcattttcgccaaaagttggcccagggcttcccgctatgttcttggtgacgcttatcgataccgtgcgacctcgggggtgagcccgctaactcaccacacccgccggcttaattgcgcttgcgctacagggctgctcccttcgccattcggctgcgcaactgttcgggaaggacctgatcggtgccggtggcgaattggagaaaaaagctcgcaccgcggtggcggtcgctcagaactagtggatcccccgggcgacaggaaattccgatttttcactcctcatttgactccctacgctcggtcgttcgatgcggcgagcggaaatggcttacgaacggggcggagatttcctggaagatgccaggaagatacttaa

SEQ ID NO: 40820 - DNA, 369 bp, Glycine max
  Peptide Sequence Number=SeqID_132505
atgacaacgcaattgatccatgatcgcgtggtaatggagtgcctagagggtgtttgggagaccctcgaaggcaatgagaggtgccgattccgtggcacaattcgaatcactgctacttcattagtacatctggaggaaccagcacgcacacttcagcagcctgtggagtggatactacctacacctactccatatcgactagttgagctggttcaagtgatagaggtgtcatcctctgaagaagatcttaaagaggacccagaggagttacctcctgaacctgctgtggatgctcttgacttcccagaggatgatgaggacccactccctgatgttgattctccaaaggatgttcatgtcagcatctga

SEQ ID NO: 40821 - DNA, 228 bp, Glycine max
  Peptide Sequence Number=SeqID_132506
atggtaaacaatcctagtgagttcaacatacataggaaggttgaaagtaagcgcaaggcaatcaatataccatgcttaaaaaaagaaaaaatcgctggtgctggcagcttggacatacaaacttggaattggaaaggaggattggtgtcatcccttgaagaatttgagtcaataagcaaggggccaaccaccttaagagctattggactaagaagcactccaaattga

SEQ ID NO: 40822 - DNA, 381 bp, Glycine max
  Peptide Sequence Number=SeqID_132507
gggggcggagcctatggaaaaacggctttgccgcggccctctcacttccctgttaagtatcttcctggcatcttccaggaaatctccgccccgccttttccattctgccacatagtgaagtcgtattacaattcactggacaccgcttacaacgtcagtgccaacatacactccccctttcgccagcgttggccgattcataatagcgaaggcccgcaccgatcggcccttcccgaacagttgcgcaccgaatggcgaatgggacgcgctgtagcggcagcattaagcgcggcgggtgtggtggttagctgcagcgtctgcaccccaggctacacttgccacgctgatgtccggcgtgtatgcttgtgtgccgaattgtga

SEQ ID NO: 40823 - DNA, 519 bp, Glycine max
  Peptide Sequence Number=SeqID_132508
atggtttcaagggacgctttaaatcagattgcttctgaggttgaccgtctacgttatctcgacaccaatccctcttcttgtggttgtgtgatgagaagcacgcacggtcttccttgcgcatgtgagctttctagcaactctccagtcaaacgtagtgcatcatgttttgaaccgcctcagcctacaaggatcatcccgatgttggatcaatttgcgccattcattcaaggtttcattcgtgatgttgtggatgtcaaagcggacattaactatggatatcggtccattgccgctttattaggtatgagggaagattcgtggccgttagttagtgtggacaagtggatggatataacggagatgggatatgtgattgcatcacggtataacgtattccttgtatcgttgtcccgacaacaaagcatgacattttttcctcttagaagtcaaccaccacctgattcttctgggcaccgcatgatatgtgtcggtcacgtgtttggaaatcattttgttcag

SEQ ID NO: 40824 - DNA, 369 bp, Glycine max
  Peptide Sequence Number=SeqID_132509
atggcgaatcaagaggagtgggtcccgtttgcggatatactagctttgctaatctttggggttgtcctctttccaaacgtggacggtttggtggacctagccgcgattgatgctttccttgcatatcaccatagcaaggagagcccggtggtagctatcttggcggacttatttgatacatttgaccgaaggtgcgagaagaacagtgcacggattgtctgctgcttacccgctctttgtgtgtgccttgattcaagatttcttcaagatcaagccttgcctcacaatgaaaggtttcaagtcattcaaggcacatgcaatcgattaccaatacatgtaatcgattaccaatggtttgaaagtgtgtaa

SEQ ID NO: 40825 - DNA, 843 bp, Glycine max
  Peptide Sequence Number=SeqID_132510
atggccaagtttgatccagaaatagtccttgagttttacgccaatgcttggccaacagaggaaggcgtgcgtgacatgaggtcctgggttaggggtcagtggatcccgttcgatgccgacgctatcagccagctcctgggatatccgatggtgttggaagagggccaggaatgcgagtatggccagaggaggaaccggtctgatgggttcgatgaggaggccatcgcccagctgctatgtataccggggcaggattttgcccggactgctgcagggaggcgagtgcgaatcatgcgcaccaacatgaccaccctgacccagatatggatgacgttgctcctcagcaacatcctgcccaccgatcataattccgacctccccatgcccaagtgccagctgggcaccctttggacccagataagtccaacaggggctcctgggattccccgcactgatcataggactctgccagtcggtcagggtgatgctccacaggccgcaggcgcgcccccaccacctcatcaggctggccaggctggggcatttgacatggagcagtatttacggcatttggttcgccagcaggcggccaaccaccgagcacacgtacggacccatgattgtctgtatcagatgagccttagcatgcagagccagggcttcgctcctttttcatgccctactccagaccagttcagggcagaggttgcatggcccggagattggcccgaggcccaagcaggagaggcacccccagaagctcccggcgatggagaagaagcccacgaggatgaggagatggctgatttgcttgacttcttgggagggagtggagacacgtga

SEQ ID NO: 40826 - DNA, 894 bp, Glycine max
  Peptide Sequence Number=SeqID_132511
atggctacctcatcaaaagaaactgcagcttctggttcaccatctgtcccatcatcttcacaccaggaacaacctgaactcaacatccaacccatccaaataattcctggtcaagcctctgtccctgagaaactggttcccagaagaccacagggagtgaagattgctgaaaaccctagccctgcaacgagtcctagggaagtagacacggagatggacaagaaaatacgcagcattgtgagtagcatcttgaaagacgcctctgttcctgaagctgatgaagatgtcccaacatcgtccaacccaaatgtttctgtgcctgatgtcaagaaagatgttccaacatcttccgctccaaatgctgaagcactcccttcacccagtgaagagggatcaactgaggaagatgatcaagccgcagaggagactcctgcaccaagggcaccagaacctgctccagaaaggttacaaagcagaaagggaaaaactccccttaagaggtctggacgaatcaagactatggcccagaagaagagtactccaatcactcctgccacatccagaagaagcaaggttgctatcccctccaagaaaaggaaagaaatttcctcatccgattctgatgatgatgtcgaactagatgtctcgacatctaagagggccaagaaatctgggaagaaggtgcctgaaaatgttcctgatgcaccattggacaacatctctttccactccattggcaatgttgaaaagtggaaatatgtgtatcaacgcagacttgcggttgaaagagaactgggaagagatgccttggattgcaaggagaccatggacctcatcaaggctgctggactactgaagacagtcaccaagttgggagactgttatgaaggccta

SEQ ID NO: 40827 - DNA, 870 bp, Glycine max
  Peptide Sequence Number=SeqID_132512
atgtcagactccttggtccgtgtttcaagacgggccgaatggggagcccacaggccgacgccaggagcgcgcaggtgccgaggcacgccaagggcgcgcgctgccatccacaatcgcgatgatgacgttctccacgagcatatcaacagcccgggcttgggccaccatcgcaatccgcgtcggtcaatgtcccgagtcgatcggcggaccggctctcaccgttccacatctgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggctttcccggtcgctcgccgttactaagggaatccttgttagtttctttcctccgcttatgatatgcttaaactcagcgggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcgtgacgactcccgcgggacaccgtctccgggcccccgggagtcgcacttaa

SEQ ID NO: 40828 - DNA, 513 bp, Glycine max
  Peptide Sequence Number=SeqID_132513
atggctactccacctgcctcgcctcctcctcctcctttagacacatcagcgtctccatctacgttgaagcggacacgcaaagcgacacggctacgatcattggtcactataccacttggggcagaaagacatgtggtcaacgtcgatcctgctaccggcaaggccgacggtccccacaagaagaaattaagaacatatttggggattgtcgctcgtgataaggtcgacgtgacatatgacacctggaaggaagtccctactgctcagaaggatttgatatgggaggatattcaggcggaatttgaaatccctgaagcttctgacagtaggacaaagaagaaaattcttcagattgtcgacgagcgctggaggcagtttaaatctgacttgactaggaaatgggcacttgcagcagacaaggacggtgtagacgacattgtctgtgaaaaatatgacattagcaaggagaaatgtacccagttttgtcagacccgcagagacccctcatgggag

SEQ ID NO: 40829 - DNA, 342 bp, Glycine max
  Peptide Sequence Number=SeqID_132514
atggacccttgggtactagtacctattgccttcaaaggactacacgtcctcaccttcagacggattcacgtcctcgccttcagaggactgcacgtcctcgccttcagaggactacacgtcctcgccttcagaggactgcacgtccttgccttcaaagggctacacgccctcaccttcagagggctacatgcgcccgcctttagaggactacacgtcctcgccttcagagggctacacgccctccccttcagctacacgcccttgccttcagaggactacacgtcctcgccatcagaggattgcacatcctcgccttcagaggactgcacgtcctcgccttga

SEQ ID NO: 40830 - DNA, 921 bp, Glycine max
  Peptide Sequence Number=SeqID_132515
tgatcttccgtcacaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatccaggcgcatgccgacgtgccgtggcgcagcatgcgcaatatgcgtaatcgcatggctcacggctatttcgacatcaacctcgatgtggtgtgggagacggtacaggaatggctgccggcgttgctccagcaattgcccgccgtgcgtcaggatgccgacgatgaagaccgtaacgacaactggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40831 - DNA, 174 bp, Glycine max
  Peptide Sequence Number=SeqID_132516
cgctgttcatgtgttctccattatcaagtgcgaagcttctggtgactgggaagcacgttattctgttgttttccagatcggttccttcgccaatcctgagacgtctcagaaatctaaaggaagcaggcttgcgcgatccgtgaaatttcgtaatgtggaggaagtcgaaaagag

SEQ ID NO: 40832 - DNA, 303 bp, Glycine max
  Peptide Sequence Number=SeqID_132517
atgcacacacaaagtttcacaattccacactttcctagaataggcctaactcacaaaaacaatccccagtggagtcgccaactgtcgcaacctacccttttacgggcgagcgaggcgaggctcacgggtgcgtcttccgaaggaggaaaatgtgtggagtcgccaccaacgtttatttgtggaaaacgtcagaaaaaccgaaggaaaccagtcatgaagaatattccagattcgggagttgtatttacgtttgaggaaggtattagcacctctcacgtttgtcccaaagaacaacagccttaa

SEQ ID NO: 40833 - DNA, 528 bp, Glycine max
  Peptide Sequence Number=SeqID_132518
atggaagaggtagagaaggagatattggaaagatttagaaaagtagaggtaagcatacctctattggatgcaataaagcaaattccaagatatgctaaattcttgaaggagttgtgcactaataagcggaagcttaaaggaagtgaaagaattagtatgggtagaaatgtcttcgcattgattggcacactatctatggagtttggtgatataactgttcattttaatattcttgatgctatgaaacacccatctgaagatctttctgtattttgtgttgaaataattgaccatattgttgatgaatacatgactgatcttcatcctaatctgcatgcatgtcactcttcatgcattgaatctgaatttgcacatgatcatatgtctaaatttgatgctgagagtgaatctgaatttgatattgattacatgtctggtgatgttttacctcttgagattgattttatagagtcagatagaactaaccatgtttcaggaagtacacatacctttgactttctttatgag

SEQ ID NO: 40834 - DNA, 50 bp, Glycine max
  Peptide Sequence Number=SeqID_132519
acccactttgatcctttcgttggtgaagaccatatcatcaaagcttgaag

SEQ ID NO: 40835 - DNA, 408 bp, Glycine max
  Peptide Sequence Number=SeqID_132520
atgggtgaagtagaggaggtacaagagaagatgaaggcctacatggaggccatgaaagagcaaatggccatgatgatggaggccatgatgatcatgaagaagataatggaagccagtgcagttgcagttgtcgctaccagcactgttgctaaggtgaatccgatgccccaatctggcctcaaccaaatgaatcatccaacctcagctatggtaggcaaagatttgggaagtatgggcgccccccatgatgtgaaaattcaaaacgagcacgccttcccgccatgtggcttgcctctcaactatacgccacccaatatggcgtacactcccaataagaatgtcaataactccactcctatacccattgagagccagcaaccccaaactgatcatgcacatgtctcttaa

SEQ ID NO: 40836 - DNA, 171 bp, Glycine max
  Peptide Sequence Number=SeqID_132521
atggggagggggagggggaggggtagaaggaagaagggggagagggaaggggagaggcaagagaaagaagaagaagggtacactaaagctgagagtgaatgttgggagagaagaaagtgggaatacacgtgtacggcactgcccccattccttctcctcctcacattttga

SEQ ID NO: 40837 - DNA, 234 bp, Glycine max
  Peptide Sequence Number=SeqID_132522
atggatatgaccggcatgggaggctgtggaaaagctgtgtggcggaagatttcttgttttgaatggttttgcgtttacagcctcattcttgatttggtggtctctactccctggattctgatttatcagattctgcctttcgtttctacttttgggaagataagcaacggatgtgactggcatgggaggctgtggaaaagctgtgtggcggaagatttctgtgtgaagccttag

SEQ ID NO: 40838 - DNA, 66 bp, Glycine max
  Peptide Sequence Number=SeqID_132523
atggcgctaagacgggatagagcagggctagataattgtgtctggacacgaagtgcaaggatttag

SEQ ID NO: 40839 - DNA, 294 bp, Glycine max
  Peptide Sequence Number=SeqID_132524
atggctaagggaatcagaaacctaagttcgtggatggaggttgccccggcaccaataattttcccaacaaagccttctaattcgcctgctttggagaccatcacagaagaagttgctgaggatgatgaagcttccatgaatacccttctcaagagatactcagttatgtttatgcagaataagtatgtgtttgttttagcctatgtttggtttaaaagaaaggggaaggaaagaaagtcagaggaaggaaagatggtggaaagtgaatctttccactgtttggaacaatcttaa

SEQ ID NO: 40840 - DNA, 198 bp, Glycine max
  Peptide Sequence Number=SeqID_132525
atggtgtacgtgtgttgttcaggaatatacgatgaattttggtcagttttcgttgccggagaagaagagatgcatgaagatcagtggatgtatgatagtatgatgtctgaagaagttgatatgaatgttgaaaatgaggaagatgctggtgttaaagtagaacacgttgattgttctgatgcctttaatacttctcag

SEQ ID NO: 40841 - DNA, 1044 bp, Glycine max
  Peptide Sequence Number=SeqID_132526
atgggatcactagaaagatcaagaaagaaagtcatgttatggaagaaagccatggtgcacttttctctatgttttgtgatggggttcttcactggctttgctccaacaggtaaatctatatttcacagccatgttgattattcaaataggtcagaatttgcaccacaacctattgaaatgtcacagaagacattaacaaatgtcaatagaagttggatagctccaacagcaaggtctttagtacacaagcaaaatacaaaattacatgtaaaaatagtgccccagttgaagcctagaagacttataatcattgtaactccaacaagcacaaaacatcctttccaaacagtgattttgacaaggttggcaaacactataaagctggttcctcaaccattgctgtggattgttgtggaagggcaaacagattccacggaactttggaagatgcttaggaagactggcatcatgtataggcatttggtttccaaggaaaacttcacggacttggaagctgaattgaatcaccagagaaatcttgcactcaagcatattgtgcatcacaggctaagtgggatagtacactttgctgagctttccaatgtttatgatcttgaattcttccaacaactaagacatattgaggtatttggaacgtggccaacagcattgttagcagcaaacatgaagaaagtgatcatagaaggacctgtgtgtgattcttcacaagtcataggatggcatttaaggaatatgaacaatgaaactgatacaattactcctccaattcatatttcaagttttgcattcaatagctccattctctgggacccggagagatggggtcgcacttcctctcttcaagacacctctcagaattcaatcaaattcgtgaaggaagtagttctagaggatgaagcaaagttgaagggaattcccccagaggactgctccagaatcttgctttggcgcttcaattttcatgctcgcacgacttcaaatcataaatttctgactactacatctggtgttatccgaaaataa

SEQ ID NO: 40842 - DNA, 147 bp, Glycine max
  Peptide Sequence Number=SeqID_132527
atggcatctatgaagagagcagcagagcacactgacatggtactacggacctatgatgcctgtgaaatagaactgatttgcggtggtgcacgtttcgaggtgaaacgctgtttggaggatgccaccggatactcaaacatagcttag

SEQ ID NO: 40843 - DNA, 168 bp, Glycine max
  Peptide Sequence Number=SeqID_132528
atgacaattgatctcaaatatagaaaagaattcgaacctgatccttgtgaattcgttctcgcctttttcgtcggatctgaaaaaaaaaaccccgcatctttgagaagccagcaaaacaacaacaacaacaacgaagatattgctgaggatgaggaaagaatatcttga

SEQ ID NO: 40844 - DNA, 177 bp, Glycine max
  Peptide Sequence Number=SeqID_132529
atggagacacacgctgagataagggtgtcaaagttcaagagggtttgtgtcttctgtggtagtagccctggcaaaaagagaagctaccaagatgctgccattgaacttggcatgaattggtggaaatgtttaaactttatcatatatgacgtcttgaacggtctggttccattgtga

SEQ ID NO: 40845 - DNA, 312 bp, Glycine max
  Peptide Sequence Number=SeqID_132530
atggacatggactataaaccagatgaagcatggatcaaagatgagaaaggttcaaaaaagggcataggaaaaaggaagagcgtaccattgtcgggatcggaccaagggaaaaaaccgaaggaatcgtcgccggagatgttaccggagggggaggctttgggagcgaaatggagaagacgcggtgcggaagaaggagagaaagggaacgagttgttgaagaagaaggtcttggaaggagaacgggacggagcgaaagagaatctgaatgtggagaagcatattgcagcagcagaggtttccgccattggaacg

SEQ ID NO: 40846 - DNA, 216 bp, Glycine max
  Peptide Sequence Number=SeqID_132531
atgtctttcaaaaaggcctttctagaagtacatttgcatacttttggaaagttgttagagaaggtgttgatggcggctgtgtcggaggggaaggggctggtggagggggtcggtggtggtgcaggaatatttgtgtccattcaagtctgttttggggctacaagaagcaaaaaggtggtgcaggaagtaaaatctgccactgagttgggtaactag

SEQ ID NO: 40847 - DNA, 334 bp, Glycine max
  Peptide Sequence Number=SeqID_132532
gaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccacatccataaataaacaaaaccagcaaagcaaatgcgtggagaaagaacaaacttacctcgatggtggagcagcacgaatgctggtcgtcaatggcaccgaaagcaggagaagaagaagcgtggaggagaatagcagcgcagaagaagaagtgtatggcaatagtgctgggtgcacctag

SEQ ID NO: 40848 - DNA, 4272 bp, Glycine max
  Peptide Sequence Number=SeqID_132533
atgggaaccggttcgaccttggccgggaaagaagttccaatcgtcggaagcgacgccgttcgctggatcgatctctccgttccatcttcgtccaacattgccgccgtcgacggcgtcgccgcccttcccaccaccgacgaccgcgcctcctgcttcgtcatcggagatcctcctacttatctaatctggagaattcacaaagctcaacctcagtctctcgagttgctcgaactcgccgcttcgaaagagtttccacgcgtgggactcagattcacgttccccgacgcgctctgccccttcgctttcatcggcaaaaatgagatttctggtgcttctagattcccttacttgctttacgtgttgactgtgtctggcgtggcttacctattgaaaattcgaaatgtttctgcgtatacgtccgtttctgttttccccgtggatgaacttttggaggttaatgtgcgtgattacattcccaatcacgccacggcgataaccaccgtgatggcaaccgttggaggtcttgttgttggcacgagtgatggttctgttttctgtttccagctgggtgtagttgaccctagtgctcccggtttcatgcatgagctgagagatgaagccggaatcagtcgcttgtggggtttaatatcacgggggaaaatggtgggtactgtacaagagttggtaattttggagttgcacgagaaaaagtttgtgtttgtgcttcatttggacgggacgttacggatttgggatcttgcatctcgtagcagggtttttagtaataacatggggactgtgacaatggcagcaggcttaattgtgaaggatgaaaacttggagatgatctctttatatagtatcctatataattttggggacagaattgttttctctatggacccttcagtgcaaagcattcccctggaggagggacgatgccttgatgttaaattaacattggataagatatggatactgaaggatgatgaattagtctcacacacgttctctacaaatattgatgagcttcttcttcctggtgttcatcataatgctactttgtatgcaactctacttgagtatagcaggcatttgggtgaatctgagttgcaaacattaactgctgatgggctaaaaaaggagatactttcactcatagaacatgaggttggatctgaaaaagtgtctttattgcactgctggaaatgttttttcacccgctatttccataattggtgcaagaacaatgcattatatggcttgcttgttgattcctcttctgacgccattggtttaatcagaaaaaattccatttcactttttcggtctttggaagatattgaacggattgtggaggtaggctcttcagaagaagttagtgagctcacaggccttgtggatatatttaacgatgatctggattgtgatattctaattgaattgctcagatgtgttataagtttcagccaacagttgggcaaaactgcttcttctatattttatgaatctcttttaactacatcagtgatctcttctgaagatattgttcgctatattgttaagattctggaaactggatattgtatgtcaggcccagtgcttcaaacttctacttctggggatcatatagttgttctggagaaggagctagcagatcataaaagtttgaggaaactttccattgatatgtttttatcgcttcaaggcttgcacaaaaaggcttctgcatggggcaggattttaaaaattgcaaaggtgatgtttgaatctgcctgggactttcttctatttttaagctatttggtggacatcagtggtcagtcatggcttactgaattgaatgcatatacttctgatgttgtgttaacctttttgggcatggtacagataacaacatggggaaacgattatggaatgagaagcttggcagatatgactttacattggcttatacattcttgctcaacgttggaaactggaggatcttctactttcttgacccgttctattgatcttgcatttatacttttcaagcatgaccagtatggtgctgctgagcaattgcttatgattgcggaagcacatttactaaaggagaagacatcccaaagtattcaagatgatgatggtggatggtgcatacgtcatcatcttctaggatgttgcctacttgcccaggtgcaatgtggattacatgcaacccagaaggataaaaaagtttctgaggccattcgctgcttttttaggtcttcatctggaaatggtgcatctgaggctctgcagagtttatctgatgacttaggaattccatatcttggttttagtgagtattgctatggttgtacatcaattgctgcatggaagcttcaatactatcaatgggcaatgcagttatttgaacgttatagcattagtgaaggtgcttgccagtttgctcttgctgcacttgagcaagttgatgaggctctatatatgaaagatgacaagtgcacaaacaactcagttaatgaatcagtgacaactatcaaaggacgactatgggcaaatgtttttatatttgtgttagaccttggtcgttattatgatgcgtattgtgcaataatttcaaatccagatgaggagagcaaatacatctgcttgagacgtttcataattgttctttatgaacaaggagctataaagattctttgcagtaataaacttccccttattggtttagtggagaaagtggagcaagagcttgcgtggaaggctgaacgatcagatatttctgcgaagccgaacttgtataagttgctttatgcatttcaattgcaccggcataattggcgacgagcagcaagttacatgtacttgtattcagctcgtttgagaactgaagcagctttgaaagatagtgtaggcagttccttgatgttgcaagagaggctgaatgcactctcttctgcagtcaatgcactgcatcttgttcatcctgcatatgcctggattgattcattggctgagggaagttatcttgtgaatgaatattatccaagtaagaaagctaaaagaaccccagatgaacattcagcagctgataatgatgctgagcctcaaggttggcagtcctctattgatattgaaaaacttgagaatgagtttgtgctaacttcagcagagtatatgctgtcactggtaaatttcaagtggacattttctggaaaacatggagctctatcagacttggctgatcttcttgtccaaaacaatttatatgatatggcttttacaatccttctcagatttttcaagggttcaggactgaagagggaactggaaagagtgttgtctgctatctcattgaaatgctgtcttgacaaagtggaatcctcttgggttgaggaacacagtcatttattgacctcatcaaagcatgagatggttgcccatggttcacctgctacagtttccacaactccacaaactgacagaaacagttgttgggcaacactcaagctttaccttgaaaagtataaggaatttcatggtagattacctatcattgttgctgaaactcttctacgcacagatcctaagattgaattgcctctttggcttgtacaattgttcaaggagggtcaaaaagaaaggttgtgggggatggctggcagggaatcaaatcctgcatctttatttcagctttatgttagttatgatcgatatgcagaagctacttatcttttgcttgactgcatagactcatttgcttcgatggggttcaagatgtatgaggaaagtttttgggttctattttgtgttaatgggacacaaggaaaggttgtgtttcaggaaggctattcttccctttattatcctatgaacgaccaagggtgccatcagcttgcaacagagtgccttggacagtctttctggccattgccagacttaggtgcaaccaaggatgtcacagactctgttcttctctatggagtgctgagtttctcttatggtgatagcttcctattaaaatgggttgcaatttcttctcctgttatgttgatatttatgacaagaccagcagatataattagaaggaaaagaccattagctgtttggttcccgtacacaactattgagcggttactataccaactcgatgaattaatcagaatgggtcgcatggtagatcactgtgacaagctcaaaaaaatgttacatgattctttacagaatcatctgaagatgttgaaggtggactcagatgatgctgtttctgtatcttcttga

SEQ ID NO: 40849 - DNA, 159 bp, Glycine max
  Peptide Sequence Number=SeqID_132534
atgtctgtgttgatgcatgtgatgatgacaaagatacaccctgttgggaaagtttaccacttccgggctaagcgtcaaatggccgagagtttaggacagattgctaagttcagacgccgcttcgggctagaaaattcagagggcaatgaaaaaaaatga

SEQ ID NO: 40850 - DNA, 219 bp, Glycine max
  Peptide Sequence Number=SeqID_132535
atgtctatatacttctacgaatttaattataagcggcaagaaatcaagggtgaggaaacaaaaaggtttattgttggtttagactatttgcatgatcctgcattcttgggacttttggacaaagctcaagaagagtatggtttcaggcaaaagggagctcttgcactcccttgtcgccctcaagagttacagaagattctagatggtcccaaagcatag

SEQ ID NO: 40851 - DNA, 399 bp, Glycine max
  Peptide Sequence Number=SeqID_132536
atggatttcaagatgcttaggtcttttgttgagaagattgaaaagggtctatcactaattgctcccaaaaagccaggactcaactacttcaatgaaaatcaagtggaaactacaacgaatgttgtgcccgaagatgttgttagtaaagggtattttgctgttgttgcaataaaagatggagaaatcaaaaggtttgttgttgagttagactacttggctaatccagcattcttgggtttgttggatcaagctggagaagagtatggcttcaaacagcagggaactctagcagtcccttgtcggcctcaagaattacagaagatcttagatggctggagagtcataccggacaacagcaaaggtgcaggaagggctatttattttcctaagttcctatga

SEQ ID NO: 40852 - DNA, 372 bp, Glycine max
  Peptide Sequence Number=SeqID_132537
atgtgtatgtgttcagcaagcattcaaatcaatcaaaatcttgcagagaaagacaacattaagggcatattattatacgaaaagggtgtttcacacttcgttcacaaaaatcccccactgaggtacttgaatgaagccacaaccacgagtgtggtgccagatgatgttagggaaggatattttgctgttcttacaacaaatggtggagaatccaaaagattcattgttggcttacattacttgaatgatcctgctttcttgggactgcttgatcaagctgaagaagagtttggtctcaggcaaaagggagctcttgcaatcccctgtcagtctcaagaattacagaagattctagaatgttgcagagtgtaa

SEQ ID NO: 40853 - DNA, 864 bp, Glycine max
  Peptide Sequence Number=SeqID_132538
atgatgtttgaggctggtttgggtttattgcttaaagtggaattaatggcggcagatgccaaagccgacgtcgtaggtgaagggaagatgatgatggctcattctcattatcttcttcacattccatcgttatcatctttatctgcatctctcacttccccgcctcgctcgcttcttcctgttcggacattacaacctaagacgctgtcgtgtcgtgtcccttcatttccaacacgcaccccgtggcacttcaagcctcttcattttgctctctctggggcactctcacttgggttattattcggagtcgtagaattgaaactcaaagtctcaaactttgtaggaattggcgtggctgaggctgcaaaagttggtgtgaacaagccagagttgctccccaaggagtttagtactgtcattgatgttgctgggttcctatccgatggacaggagaaaagactagcagaagagattgctgctcttgaagcggatactggattcaagttaagagttttggcccagaactatcctgttacgccaggtttggctattaaagatttctggcaagtagatgacagaacagttgtttttgttgctgatcccacatttggcaatatattgaatttcaatgttggtgctacggttgatttggatgtcccacgtagcttttggaatcgcttggctgggaagtatgggaacattttctattggaaagaaaagggggaagatgcatctattgaagcagcagttatggcaatttctagttgcttgagagaaccagttgggcctaataattgttctgaggaagttactggatttgtgatcctagttagtagttggaaggtgaccgatacatggaattag

SEQ ID NO: 40854 - DNA, 411 bp, Glycine max
  Peptide Sequence Number=SeqID_132539
atggtggaagagcccgaaaacaatccagcgccgccgaaacctccaatcccctccgcaccggatgccgcgaaggaaattgcagctccggcaacaacgtcacagccaagtgccgaggtcgccgatcctctggcgctagcttcgaagcggcagcgccatccgagtgttcacttgggggagatcggcgaccaacacaagggtttgttgaagattacggaggaagagttttcagggcctcctttgaatgtggtgattgaggtgactctagggttagttttttgcatgtgggctgcactaaccgtgccaggaaagtttttgtcaatccaccctcactctgaagagaacaggaccagcaaagatccaatgaaagatgatatgcttcctttgactttgggaatgaacatagtgatttag

SEQ ID NO: 40855 - DNA, 1950 bp, Glycine max
  Peptide Sequence Number=SeqID_132540
atgagggagcgagacggagatgtcatcgcgggggtggccgtcgagggagggagatgctgtcgtgaagggtggctgccaaaggagatgccgtcgcaggggggtgttaaaattgagagaatgaagaagggaggtgttaggattggtagatgggaagattcaagtcccaaacttttgtcacagttgaaactagtggagttagatagaaaccgggctagaagtagccgcattccacaggctatggaattcgccaggaccatgttctgttcttctccaccgttccctccaagaactcatcacccttggagcactctcccctcgtcctcttctacttcttccgcacagaattttcctgcctcagttcttttaccagagcagcgtgatgaatataggcctcttctgcacatgtctaaggaagacaagacatcacaggcaatgttaagtacaaggcagatggatacagtcacggttcatgaagagaataacacggaaaatgctgatcaggtagtgcttgactttaggaagcacctgcatcactggcctaatttacagtacttattaacttcctcacaaataggggaagttgctgcttcttcaactttagagcatgtttctgttgacttggagaggcgtccaaatggtgtgcaatttaatggagtttctcttgctaagaaagctttgtctacctcgaaacaagaatcctcagtagttgaagacttgaaatcaattaaagctgatgatgattcaattccttttggtctggcctctactagcttggctgatccttcaattggaagaaataaaactgtgaggtcaacacggcttctagagagacgatcaaaacaaagaaaagtacctaagtcgaaagttatagacgatgaaacctaccttgcaagaaaggatgatgcacaagaaaagctacgtgcagaaaagaagaaaaatgaagaacttgatcaagatgatcccctgcgcttgttcttgtggggtcccgaaacaaaacaacttttgacacttgaacaagaatctcaactgatatctcagatacaggacttattgagattggaagaagtgaagaccaatcttcaatctcaatttggaagggaaccaactatggctgaatgggcagagggtgcaggacttaattgtcgattgctgcaatcacagcttcattctggacttactacaggtagccttttagaaattaaagaccttcctttccctgtagcaaaggctgttcagtgcttacatggttttcctgtaaaccaagattcttggcttttcttaaatgtgaaagagatacaccaggataaaaagactatagatgagggaagtatgggtcttatgaagagtgttgaaaaattcaatcccctagccggtagtcgatttggtaattatgcattctggtggataaggcaagcaataaggaaggcagtgtttcgacattccaggacaatccgtctaccggagaaggtatttatcctattgggcaaggtaatggaggctaagaaattgtacattcaggaaggaaaccttcacccaactaaagaagaattagcaagaagggtaggagttactgtagaaaagattgacaaattactattttctgcaagaattccaatttcaatgcagcaaactgtgtgggctgaccaaaatacaactttccaggagattactgcagaccccactgttgaggccacagatgtgactgtcgaaaaacagcttatgagaaggcatgttctcaatgtcctaagtgtcttacacccaaaagagaggagaattatccggttaagatatggttttgaggatggtgaacagaaatctttatcagagatcggagacatatttggtttgtctaaggaaagggttcgtcaattggagatccgagcactatacaagctgaagaagtgccttgtcaaacaaggacttgatgcttatgtagacttgcttctatag

SEQ ID NO: 40856 - DNA, 407 bp, Glycine max
  Peptide Sequence Number=SeqID_132541
ctttattgcctaacaagccaacttacaacagcaagccccaagagactcagcataaggatgcacaagccaaagttgagtatgtgaaaagattgtatgaccaagtgaaggtgcaaattgcaaagaagaatgaaagctatgccaagcaagccaacaagaacaggaaggaagtggtacttgaacccggtgatgatcctggacatttgagggcaaatgctttccaagaaggagggaatgatgagaatcctgaaactgcccaaatacaggctaaaggcccaagtggaaaaggacgaaggcccaagtggagaaggatgaaggcccaagtggagaaggatgaaggctcaggggcagagacactatcaagactattaattgttgctgaaggcccagatgaatttgaaggcccataa

SEQ ID NO: 40857 - DNA, 378 bp, Glycine max
  Peptide Sequence Number=SeqID_132542
atgaagtcaagatttcttagagggtgccttaacaagtgcaagaaaatgtgccttaacaagtgcatatcttgtgaggactgttgtgaatgggctttgtggtcttcttctaattttcatgaagcttgctccaacaatattccaagtgatgttccaaagggtcatttggttgtgtatgtgggagagaaccacaagagatatgtgatcaaggttgcattgctccaccatccactcttcagggccttgttggatcaagctcaggaagagtatgatttcattgctgattcaaaactatgcattccttgtgatgaacacctcttccttagtgtacttcgatgtgctagctccccacagaaccaacgagtgtgtctttgtctttga

SEQ ID NO: 40858 - DNA, 123 bp, Glycine max
  Peptide Sequence Number=SeqID_132543
atggtggggataaagggtggtaaagatgcacaagggggggttggtggagaagtaattgcagtcgttcgattacggggcaggatcagcggttctccttgcgcaacgtggcattttcagatgtga

SEQ ID NO: 40859 - DNA, 237 bp, Glycine max
  Peptide Sequence Number=SeqID_132544
atgactgtcactacctctgtcggcatgaccattgctattgtcatcaccatcactgtcatgaccgtcatcgttgtcattactgtcgctgccaccaccgccaataacaatgttgatgatggtggtggcgacaacgacaatcatgatgattattgcaacggtagtcatggtggtggcaacgacggtgacgaaggtcatgacagcaaaggtgacctcaaatgtcattacatgaaacactaa

SEQ ID NO: 40860 - DNA, 318 bp, Glycine max
  Peptide Sequence Number=SeqID_132545
atggatcaagatgaagttcaaaatcaaccaatgcaaaaagaaattaaaagaaatcttattcgccttgccaacattgcgaaaagaaaggtcatcctccatttagatgctggaaaaaacctgatgctaagtgcaatgagtgcaatcaaatgggatatgaagctattatttgtggaaacaagaatcaaccacatggtgaagttacaaggactactgatcaagaggaagaggacaacaaagggacaagaaaaatctactttggagatagcaggagcatacaaacaagaagatacaattgagagagaaaaatgcaaaaattga

SEQ ID NO: 40861 - DNA, 284 bp, Glycine max
  Peptide Sequence Number=SeqID_132546
atggaggcttggaataggttacatgatatattccaagataacaaacactcttgtgtcgttacacttgagtatgatttcacccacacaaccatggaggccttttcaagtgtctctgcttactgtcaacatcttaagtcattgtcggatcaactcaagaacgtcggctttccaatcgataacagtaggttggttctgcaattggtgtctagtctcactgaaccctacaagggagtgaccacactcatccgtcaaagtgatcccttgcctcaattttatcaagcacg

SEQ ID NO: 40862 - DNA, 606 bp, Glycine max
  Peptide Sequence Number=SeqID_132547
atgggtaacataggaagcagcggctccaacagccgctggagacacggcggaggcggtggcagcgggaggcggattcacccgccgcctccgccggtgatgtcgccgccggaggtaacggcgaaccgattcgtgtaccctccggccgccacgccgtatcacaactaccccgggtactacccgccgccgaccaccatgccggcgccgttgccggcgccatacgaccaccaccaccgtccggcggtggacccgatgtgggtgaggtatccgccggcggcaccgccggcaccggcgccgtacgtggagcaccagaaggcggttacgattaagaacgatgtcaacatcaagaaggagacgcttaggattgagcctgatgacgagaatcctggctgttttctcgtgtcgtttacgtttgatgccaccgtttcgggaagggaggtgaagaaattgcttattctattttgcatggggttttgttaccttttagagattgaaagtgaagttgatcagtgcactttaatggcaaatgaggtcgttactgtaattgattggctaagaatggaaggaggccatattagaggagaaagtgataactttgtagtagtttga

SEQ ID NO: 40863 - DNA, 213 bp, Glycine max
  Peptide Sequence Number=SeqID_132548
atgcaagtgtgtgcacgacatgaaattggctctcaaatatgcatgaaatggctccgaaaaagcttttcgcgaagagatctagaagagtcaccgtttgatagccaccgtttccaaagcgtcatgcaccagcagcgtttcgaggccatcaaaggatggtcgttccacagagagaggcgtgtccagctcagggaggatgagtacaaaaatttttag

SEQ ID NO: 40864 - DNA, 219 bp, Glycine max
  Peptide Sequence Number=SeqID_132549
atgcatgaatcgttaatattagtacctgctttacagtcccattggttaatgatgcacgtgactcttttagaggatcccactttattcagcgcaatctatttttacggggaattcaagaaactacaatacaaacgtaagccgctatgggctgaaattggtagacacgctgctcttaggaagcagtgctatgagcatctcggttcgagtccaaaggagtaa

SEQ ID NO: 40865 - DNA, 764 bp, Glycine max
  Peptide Sequence Number=SeqID_132550
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggctatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40866 - DNA, 159 bp, Glycine max
  Peptide Sequence Number=SeqID_132551
atggaatacttacttgttggtgatgaacaaaagcgcaaaacggaatcaaaaatgcgaaaaatgatgacccctagggctgcaaactcgggtgtgtcataccctaatttcgtccggggacctttgcttgatgacatgcgaccattctttggtcctcgtgag

SEQ ID NO: 40867 - DNA, 198 bp, Glycine max
  Peptide Sequence Number=SeqID_132552
caaaagaatgtttatacggataaccactcgggtatttccgcccgtcagcgtgactcaaaagtcagtatgacagatcttgtgagcgcggaagatgatgtaaatctccgcgtgtcatcgggcccgccgcctctggatgacaaaagggcgcagaatgaccataatttgtctctgcgtgccatcggacacgactgtgtctga

SEQ ID NO: 40868 - DNA, 297 bp, Glycine max
  Peptide Sequence Number=SeqID_132553
atgagtgtggcgtggtgcgcagtggtgccactcatttgtttccatgttgtagagtggcaccaacccgatagagtattgcgacaatttggaatgcaacaacctattccggagtctccttcgcaaccacagaatatccatgggctaacgctgaaaggcaaacaagatgaaaattggttccagttgttggccccaatgatcagtcagtggaataatcgagctgactttagggtcgacatttatcctcgacaggagggcctatttagttttaactcagattacatgagttttaaacaataa

SEQ ID NO: 40869 - DNA, 561 bp, Glycine max
  Peptide Sequence Number=SeqID_132554
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatctcatacagattacgtgatcccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 40870 - DNA, 357 bp, Glycine max
  Peptide Sequence Number=SeqID_132555
atggctcttgcaagagcctcagtgaagaacttcgtgactattatgaaggaagacataggtcatcttagacctcactcccataggagagaaaaggaaagaaagcctcatgaggctaacattaacctcccatacttctatgggaagaacaatgtagaggcttacttagattgggaaataagggtagagaaacaacttaaaagaaagtctacttcaaaatcttatggctctcactcttatccaaagaaagaccaagccaagatgaggctactacttcaccttcctatagttaaagtgaagaagcaaaaggggaagaatccagtgaagaaatctactcccaagaagaaggacaacctttaa

SEQ ID NO: 40871 - DNA, 330 bp, Glycine max
  Peptide Sequence Number=SeqID_132556
atggacgtgtggggtgctaataccttccccgtgcgtaaatacaactcccgaacctttcacttaaaagttcgtagatcgcgtcttttccggtttttccgacgttttcctcaaataaacgttggtggcgactccgcgcgtattcctttcgtggaacacgcatcccgcgagtcaacgcgtcgccctcccgccgaagggaacgacagtcacagcataggttcatccctccttctcattctcttcatttgcctcaagcttcctattcatcaaagcaggataatcaaatttgcctcttctcaaacgcacttcgatcctttcgtcggtgaaaactaa

SEQ ID NO: 40872 - DNA, 633 bp, Glycine max
  Peptide Sequence Number=SeqID_132557
atggagagaagtatgatagatgctgccagtggtggagcccttggagacatgacccctgctgaagccagaaatttaattgagaagatggcttccaattcccagcagtttagcaccagaaatgatgccatagtcataagaggagtgcatgaggtagctacaaacccatctgcatcatctgaaactaaaaagcttgaaggcaaactggatgcattgaaatctgtacctgtcgcaaaggtttgtggtttgtgctcctctgctgaccaccatacaaacctttgcccttccatgcagcaacctggagcaattgagcagcctgaagcttatgctgcaaatatttacaatagacttcctcaacctcagcagcaaaatcaaccacagcagaataattatgacctctccagcaacagatacaaccctggatggaggaatcaccctaatctcagatggtccagccctcagcaacaacaacagcagcctgctctttccttccaaaatgctgctggcctaagcagaccatacattcctccaccaatccaacaacagcaacaaccccaaaaacaaccaacagttgagacccctccacaaccttccctcgaagaacttgtgaggcaaatgactatgcagaacatgtag

SEQ ID NO: 40873 - DNA, 1577 bp, Glycine max
  Peptide Sequence Number=SeqID_132558
atggagcacgccgagcagctgctggtcgaggccggcatactcgacggcgagaccgaaggcctgtacgcgccgcagaacctgaccgtggtccaccacctcaacgccgcactgcgcgcgcacgcgatctaccagcgtgacgtggactacatcgtgcgcgatggcgaagtggtcatcgtcgatgagttcaccggccgcaccctgtccggccgtcgctggtccgatggcctgcaccaggcggtggaagcgaaggaaggcgtgccggtccagcgcgagaaccagacgctggcgagcatcaccttccagaacctgttccgcatgtacaagaagctgtccggcatgaccggtacggccgataccgaagccttcgagttccagagcatctacggcctggaagtggtggtgattccgaccaaccgcccgaccatccgcaaggacagcccggatcaggtgttcctcaaccgcaagggcaagttcaatgcggtgctggccgacatcgaagagtgcgccaagcgtggccagccggtgctggtgggtaccacctcgatcgaaacctcggaaatgctgtccgagcacctgcgcaaggcgggcgtgaagcacgaagtgctcaacgccaagcagcatgaccgcgaagcgaccatcgtcgccaatgccggccgtccggcggccgtgaccatcgccaccaacatggccggccgtggtaccgacatcgtgctgggtggttcgctggaagcggagatccacgagctgggcgaagacgcgaccgacgagcagaaggccgcggtcaaggccgaatggcagaagcgccacgaggccgtcaaggctgccggcggcctgcacatcgtcggtaccgaacgccatgaatcgcgccgtatcgacaaccagctgcgtggccgttcgggccgccagggtgacccgggttcgtcccgcttctacctgtcgctggaagacaacctgatgcgcatcttcgcctccgactgggtgcagaaggccatgcgcatgatgggcatgaaggaagacgacgtcatcgaggaccgcctggtcagccgccagatcgagaaggcgcagcgcaaggtcgaggcccacaacttcgacatccgcaagaacctgctggacttcgacgacgtcaacaacgaccagcgcaaggtgatctacgcccagcgcgacgagctgctggacgccgagtcggtgaaggacaacgtcgacggcatccgcgacgacgtgatcttcgacgtggtggcccgcttcgtgccgccgaactcgatcgacgagcagtgggacctgcgcggcctggaagcgaccctggagtcggacttcggcctgcagatgtcgctgaccgacctggtcaagtcgcacgaagagctggacgccgaagccatcgccgccaaggtgcaggagcgcgtcaaccagcacttcgccgagaaggaagccggcgtgggcgaagagaccatgcgcgcactggagaagcacgtgatgctgaccgtgctggaccagagctggaaggagcacctggcccgcatggattacctgcgccagggcatctacctgcgtggctacgcgcaaaagcagccgaagcagga

SEQ ID NO: 40874 - DNA, 435 bp, Glycine max
  Peptide Sequence Number=SeqID_132559
atgagtctacactggaagagagggtctgggcacttcatgtttcttcatcatccgttgctcctctataacaattttttcctcctccttttgttgatgggcaggctttttggtttggacctttcccttctgctccctaaggatgcttttaacctttatagcaaggccaaaagtttccaaagccttgtctttattagcaatagccttggccagtttcttctgcctcttttgctgaatgtcatcctagttcactggaggaataatgatgaagttgcccttgttgataatggactgctaggagtcatcatccattcctttgaagacatggaagacttagtattccaaaagaactttgttgatgagggtggcatagtagatgtcatccactcctcccaaagtcttcatattcctcaagatgttgatttagattgtgtgtaa

SEQ ID NO: 40875 - DNA, 338 bp, Glycine max
  Peptide Sequence Number=SeqID_132560
cttgggaggattgatggggacctagtgttgagagaaacgaggataagggctacgtgggagtacgtgagctcagttgaaggtgggcaacaggggatggtgggtttatatgtgatttgtggatgtggagaattgttttgcaccatcgcccgaccgccacctagtaccacatgtgatggagtggtacctagagatatgtcgcaggggtcaagagaccttggggacatcaggcgagctcctggcagtcaacagataataggaacaaagaccacaaagcaaggaggcttgtgtggtggctggccagctgtgaactttgagtgttatatgggatatggcctctg

SEQ ID NO: 40876 - DNA, 569 bp, Glycine max
  Peptide Sequence Number=SeqID_132561
gtatatgatgaattcggttataacaatcttgtatttcaatggaagggtatacgaagagactgatggtgtaatctttgaaggcagtaaaaaagcgattcagattaaacgtggaattagtttcaatgctttgaaaaaaattggagataaggtaaagttagaagataatgaaattatttctgctatcagttgtagatttttagattttgaaaaatatgttgctttgcaaatttgtgatgacgaagatgttgaaaccatgctcgaaagttttcaacaacaaaatcaaatgtcaattttggaattgtacatagaaaaggatgtggctggtggttctatgtttcattctgcaaattctcttaaatcatgcgaaaataatttatctaataatgaggcgcaaccgccaacaaatgtgagcaacttacatggtgatgaagatgatgatgattatcttgtgtctaactcatacgttgaagagtctttagacgaagatgatagtgttgacggtatatctgatactgacaatgaagtcactgacatgattcaaccagtaagaattgttcacccaacagaag

SEQ ID NO: 40877 - DNA, 359 bp, Glycine max
  Peptide Sequence Number=SeqID_132562
ctttaaagtacttgttgcagaaggctgattcaaagcctaggttgatccgatggattcctgcccgcttcaagagttttgactataggaggagctttcctgtgaatgccctggaccttccagcagtgcatgatcaacgatgcattccagatcatagacgactcagttttaaagtagccttcgcattcttccacacatcgaggaggtcacctgggttgttcaaaggacagctcgcaaagtgcttgactgtaagagcttttattgacccaccatctacagagatgtgtggaagatttgtagcacttgtgagcaggtcagagagcaagaagtgcattggtgactgtccttgctcagaaaattga

SEQ ID NO: 40878 - DNA, 213 bp, Glycine max
  Peptide Sequence Number=SeqID_132563
atgatagttaagaaggccttcatgtttgggcaaaaagtgttattttataattctaggcttggactcatgagtgttggaatcaaaagcgactccacaaacaagagcttcaaggtcaatggacatcgacttaagctattcctcccgaacctttttttagtggccgtagtggtggaaaagacttccttcctccaccctcctcttcctccaccatga

SEQ ID NO: 40879 - DNA, 333 bp, Glycine max
  Peptide Sequence Number=SeqID_132564
atgggtaaggatcgcacccacaagacacccagtggacccggaaaagtccaacagggccctggggtttccagctctggttacgggcctctatcagtcctacagggtgcccgtacccccccggcaaagttatgtcatcatagttctacggagtacctgtcacctccagcaaggtcatcaggccccctactaatcgagctttcatcaagaggtactgcgccctcaggcagacgcagggcgagacaccacagtagcattaggatggccggtagcggggcaatagacgcaccgccaccacctttagagttcacctctgctcatccacaaaaaagttaa

SEQ ID NO: 40880 - DNA, 217 bp, Glycine max
  Peptide Sequence Number=SeqID_132565
atgggagatttcatcagcagactctccttccccggtagacgcattgtttttcactcaaaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagg

SEQ ID NO: 40881 - DNA, 258 bp, Glycine max
  Peptide Sequence Number=SeqID_132566
atgacagatgacaggtggatgcatttctcggactacgtagtagctgtgggtgagctttgtgtagtgcctgggcaggatgattacgaaggctatgaggtgattacagaaaggttggagtgtgtgctcaaccttaggacggtcattgtagggatagagttacatgatatcatgcaagattgcctgaggatcgctaggggggtgccagtgcagatggaagtgttagggctcgacaaagacgacgcacagagcattgatgat

SEQ ID NO: 40882 - DNA, 198 bp, Glycine max
  Peptide Sequence Number=SeqID_132567
atgatgatgcaatcctaccccgcaaggtcattggatagagatccaagggaaggccctagggttctcatgagccttaggctaagctctagcttctttaggaatcttcttaaggaagcttctcaaggaggtgagcttagttatgagaagaagcttctcaaggaagttttctcaagaaagcttctcaaggaagctacctag

SEQ ID NO: 40883 - DNA, 426 bp, Glycine max
  Peptide Sequence Number=SeqID_132568
atgacgttgctacttagcaacattctgcccagcgaccgcaatgccaatcaccccctgcaaaagtatcagttggtctatgtcgtcccgacatggggatcgcacccacaagacacccagtggacccggaaaagtccaacagggccctggggtttccagctctggttacgggcctctatcagtcctatagggtgcccgtacccccccggcaagggatcgcgcctgcaagacacccagtggacccgaagaagtccaacagggtcttggagttgtcaagctctaattacgggtctctgtcagttctacggagtacctgtaacctccagcaagggcatcaggccccctactgatcgagctttcatcaagaagtactgcgtccccaggcaggcgcagggcgaaacaccacagcagcattgggatggccggtag

SEQ ID NO: 40884 - DNA, 315 bp, Glycine max
  Peptide Sequence Number=SeqID_132569
atgggattaaaatcaagaacccacatgagcaatcaattaaattttaagatatgcacaaattcaaaaacaaagggggagaatttatatgatgacaaaggtgatgacaaaaagctcaaagatcaatcaaagaacaactcaagtgaatcaaagatcaatcaaagaacaactcaagtaaatcaagaagaattcaagactcaagaagaaagtttagagtcaagaatcaagattcaaggttcaatatctcaagaatcaagatcaagattcaagactcaagattcaagaataaagagaagactcaatcaagataagtattaa

SEQ ID NO: 40885 - DNA, 612 bp, Glycine max
  Peptide Sequence Number=SeqID_132570
atggacgacgtgggcgccagctcacagtcgtccttgcccactgtgaacccaacccctgacccagccgccccagcagagcctcaagcccctgaccctgacctttcccttcctttactggatgacaacgctcgtcgcgccgaactaaatgagcgcggggggtttcttcattttggggacttgtcggatcagcagaaagacaaagtgctaaacgcacaagtcaaaatcgaaagggccattgagaaagctctgctctccgacgggtattcccgggatgagctttctcaaaggaacaaaagggatgagattaggggctttttgttctaccgtaatgggaaacttctttcgatgaaaacatatgactcatatgtaaaagaagtcgaattagggacccaccggagccaaccctataagtttttatttgagcgggggtatcctcaaataataacgaggcccgtcccagaaatggggcggggaaggagaagtgggcatgtgggtctcccttcacttgactatttaggctgccctttcggatttttaagtaaattaaccaatccaatcaatgttcataagtcgacctatgctttccatacttaccctgaaacagccacttag

SEQ ID NO: 40886 - DNA, 618 bp, Glycine max
  Peptide Sequence Number=SeqID_132571
atggttgagccgcacgttatcaagcagctgaccgaggccggcatcgtggtctccgccggccactcgaacgccacctacgatcaggcgcgcaccggcttcgccgccggcatcagcttcgccacccacctgtacaacgccatgccgtatatcaccggccgcgaaccggggctaatgggagcgatcttcgacacgccggaggtctataccggcatcatcgccgacggccatcacgtggcctgggcgagtatccgtaacgccaaacgcctgaaaggtgataaattggtattggtcaccgacgcgaccgcaccggcaggtgcagatattgaccaatttattttcgccggtaaaacaatatactatcgggatgggctgtgcgtggatgagaacggcaccctgagcggttccgcgctgaccatgatcgaagcggtgcaaaacagcgtcgagcatatcggcatcgcgctggacgaagcgctgcgcatggcgacgctgtacccggcgcgcgccatcggcgtcgagcaccgtctgggcaccatcgaagccggcaaggtggctaacctgaccgccttcacccgtgattttaaaatcaccaaaacgctcgttaacggtaacgaggtttaa

SEQ ID NO: 40887 - DNA, 407 bp, Glycine max
  Peptide Sequence Number=SeqID_132572
atgacagggctgcctggggagttttctgatgacatggagagttccaataatgagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggcggagatttcctggaagatgccaggaagatactttaacagggaa

SEQ ID NO: 40888 - DNA, 357 bp, Glycine max
  Peptide Sequence Number=SeqID_132573
atgaccggccctctcaaagagtcaatctcttgctttctcataagggtggaccctagggtactagtactctcacctatagagggctacacgccctcaccttcggaggactacatgtcctcaccttcagaggattgcacgtcctcaccttcagaggcctacgcaccctcgccttcagaggactacacgtcctccccttttgagggctgcatgccctcgccttcagaaggctacacgtccttgccttcagaggactacacgtcctctcctttagagggctacacgccctcgccttcagaggactacacgtcctcgccttcagagggctacgtgtcctcacctttagtggggatcctctag

SEQ ID NO: 40889 - DNA, 336 bp, Glycine max
  Peptide Sequence Number=SeqID_132574
atggaaatttatgtgagtgatcgactaggaaaaattgtcatcatcgaaaagggggagattgtagaagcaaagcttcatgaagaatcaagattgattcaaagatgttttgatgataacaaagatgatgacaaaggtgataacgaaaagctcaaaggtcaatcaaagaatgagttcaagatgttcaagatagaatcaagcacacttcaagattcaagaggaaagttgatttcaagaatcaagaatcaagattcaaggatcaagcttccaagaatcaagatcaagattcaagaatcaagagaagacttaatcaagataagtatgaaacggtttttttaa

SEQ ID NO: 40890 - DNA, 231 bp, Glycine max
  Peptide Sequence Number=SeqID_132575
atgcatttacgtgatcaaggaagccttcttaacaacaaagagaagaacaagatgaaagattgcaaaaatacaagtggtgaggatgtctccttcatctctaggatctcacaatcactcacaaactcatctcaagctctcaaaccggctcctgcttcaagctctggtctctataggtcttcacacaacaaaatctctcaaaactctctagaacttggacctttctatctctag

SEQ ID NO: 40891 - DNA, 360 bp, Glycine max
  Peptide Sequence Number=SeqID_132576
atggttgttccctcaagtcctcgtgtcagcataaaggagatttgtgttgatccatcagggaacgatcctaagacggatgactcagacaagtgcaggttgtacatcgaagcaaatcctccctgcttggttgccctaggaagagtttttgagggatcaacaattcacaacattcctttgttacctggccatgtgaaggttggtgttgaggaggttaaagatgcacaagctcccgttcctgtacccactgatgaggcaactgtttctccagcaaaacctccacaaaggccggatcctgaggtcgatgatccgctatatctgatgacattgaccatcccagagcttttcttgaagcctttctag

SEQ ID NO: 40892 - DNA, 234 bp, Glycine max
  Peptide Sequence Number=SeqID_132577
atggatgttaagctagctcgatcgcaggaaatgatggaaaggttgaagccccagtggcaagaagaacaaggggatttattgaaaccattaaattcagaatatggtaaagtagctccggggtggggaactactcctttgatgggtgttgcaatggctctatttgcgatatttctatctattattttggagatttataattcgtccattttactcgacggaatttctatgaattag

SEQ ID NO: 40893 - DNA, 249 bp, Glycine max
  Peptide Sequence Number=SeqID_132578
atggagaattcatccctaacagtcaaccacttaattcaaccctatttcaatttactaagcgaaaatcaacttagggttgtcaatacgcgattaggcaccacatacaccaggaaaactgccaggaaaccacattacaagcgaaacctcaaagagagttgggcttcatcctcaaaaggaaacaacaccagaaaatctagccttccatggattcaaacagaaaacgcaatgaaacatgaagcagaaacgtaa

SEQ ID NO: 40894 - DNA, 264 bp, Glycine max
  Peptide Sequence Number=SeqID_132579
atgccggatggggacatcaggttcaccttagcaacaacactggtagcagcaattgcaaccgcattggcttcaattatcttcttcacgctcatcatggcctccatcattgcggccatttgctctttcatggcctccatgtcggcctccatctactcttgtacctcctccgctttacccattactctagctctagcacaggagaggggggcaatgagcaatgcaaccaatgagggaaatggatgtatgcgaatgatgcagaattga

SEQ ID NO: 40895 - DNA, 210 bp, Glycine max
  Peptide Sequence Number=SeqID_132580
atgtttgcacattcgattaaaggctgccgtcccttgggacgggacgtgtggggtgctaataccttccccggaaaactgccaggaaaccacattacaaacgaaacctcaaagagagttgggcttcgtcctcaaaaggaaacaacaccagaaaaactagccttccatagattcaaacagaaaacgcaaatgaaacatgaaacagaaacgtaa

SEQ ID NO: 40896 - DNA, 87 bp, Glycine max
  Peptide Sequence Number=SeqID_132581
atggcttctgtggatatctctgctatggccgttaatcttgacttgataaagccttttgccagtttgatctgtccccatgtttactaa

SEQ ID NO: 40897 - DNA, 123 bp, Glycine max
  Peptide Sequence Number=SeqID_132582
atgccgcttagccgtgatgttcctaaagaagatgaacattcaacaacatggatgaactcgcttagtgcaggcatgcttgctaacgcatcatacgcgcttagtgagttcatcgtgttttcctga

SEQ ID NO: 40898 - DNA, 363 bp, Glycine max
  Peptide Sequence Number=SeqID_132583
atgggttatggcctctggcagcaggttgtagaggcctctggtaatcgattaccagtctgtgtaatcgattacacagaggaatgggtcactggtaatcgattaccagatgaaccggcgcgtacgcttcagcgcactgtggagtggatactacccacgcctacaccatatcgtctagtggagccagtccaattgattgaggtaacgtcgtccgaggaagaccctgaggaagatcccgaggagctacctcctgagcctgctgtggatgctcttgactttctagagggcgatgaggacccacttcctgaggtggattctcccgaggaagtcatgtcggcatctgaaggcaggactctacgaagataa

SEQ ID NO: 40899 - DNA, 549 bp, Glycine max
  Peptide Sequence Number=SeqID_132584
atggctccgaggaagctttcctcaaagagatctaggaaggaagccgcggccgcagggactagtgccgctccggagttcgatagccatcgtttcaggagcgctgagcaccagcagcgtttcaaagccatcaagggatggtccttccaccgagagagacgcgtccagctcagggatgacgagtacacagatttccaagttcgatctagatatagttctcgagttttacgccaatgcttggcctgcagaggagggcgtacgggacctccggtcatggtattggagcagggccaggagtgtgaatacggccagaggaggaactgggccgatggatttgatgagaaggccatcgctcaactgctatgcataccaggtcaagattttgcctggaccgctgcttggagacgggtgcgaatcatgcgcaccaacatgactaccttgacccagacatggatgacgttgttgctcagcaacatcctacccagcgatcataattccgacctccctctaccgaagtgtcaactggtatgccacctatcaggcaccctctag

SEQ ID NO: 40900 - DNA, 207 bp, Glycine max
  Peptide Sequence Number=SeqID_132585
atgcgtgagcatcgagggatcggcgatgatccaggtggcggtggttccaatcggaacggtgccatcgaacgtgctatgggacaactactctatgctgctcccgctgaacacgatcccactctccgcgatcagctccttctacaccaagcaccaaaagtctcccttcgccgtccagccctgggatttatgacaaacttgtatagctga

SEQ ID NO: 40901 - DNA, 351 bp, Glycine max
  Peptide Sequence Number=SeqID_132586
atggtggattccggcatcatcgaagagtctgcttactacgaatcactgcacgagctgccgctgattgcgaacaccatcgctcgtaagcgtctgtacgaaatgaacgtggtgatctctgataccgcagaatacggtaactacctgttctcttacgcctgcgtaccgctgctgaaagagtttatgaccactctgcagacgggtgatctgggtaaagcgattgcagaaggtgccgtggacaacgcgcagctgcgcgatgtgaatgaagcgattcgcagccaccagatcgagaaagtgggccacaaactgcgtggctacatgaccgatatgaagcgtatcgcggtagcgggttaa

SEQ ID NO: 40902 - DNA, 321 bp, Glycine max
  Peptide Sequence Number=SeqID_132587
atgttcgtgggtgcgtcttccaaaggaggaaaatgcacggagtcgccaccaacgtttatttgtggaaaacgtcagaaaaaccgaaggaaaccagtcatgaagaatattccagattcgggagttgtatttacgtgtgaggaagtttttgaggtcgacaaaagcggggctcttgctcttacgtatcctccatcgaagaggaaatcagacctacgtagttctttctttaagggtgaatcaagcgattctttttacttggaatgtggtctttttaaggcgttggaccttaaaaatgatccatttttacttggtaagaaaaactga

SEQ ID NO: 40903 - DNA, 684 bp, Glycine max
  Peptide Sequence Number=SeqID_132588
atgccttggattaaagaagtacctaccattgttcaatcctggtatctgggttctgaagcaggaaattcgattgcttctatcttagcaggcgacgcaaacccttcaggaaaattgccatttacttttccggttaagctggaagacaattctgcgcaccaattaggggaatatccgggccaaaaagatcaactggcagcaggaaaaggaaaagatcaaaagaatccgatcaacattacttataatgaaggaattttcgtaggataccgttggcatgatacaaaaaacatcaaacctttattcagcttcggacacggactaagctacacgactttcgagtttggaaaagctaaagcggataaaacaacgatatcccaggatgataaaattacatttaccgtaccggtaaaaaatacaggaaagaaagcaggtgccgaagtcgttcaattgtatatcagtgaccttaaatcctctgttccccgtccggcaaaagagctcaaaggttttgaaaaagtatttttaaatcccggagagcagaaagaagtaagcattagcattgacaaaacagcactaagctatttcgatggcgataaacatgactgggtagctgaaccgggagattttgaagccttgattggaaattcttcagatgccattaaaactaaagtgaaattcactctaaagtag

SEQ ID NO: 40904 - DNA, 126 bp, Glycine max
  Peptide Sequence Number=SeqID_132589
atgacccaagagtccggtggcatgcggagacacccaatgcgacccgagagtccggtagcatgcggagacaccttacggttatccgcacctcgtcattcggagaccccaagtccgattgacaagtag

SEQ ID NO: 40905 - DNA, 594 bp, Glycine max
  Peptide Sequence Number=SeqID_132590
atgggatcgagtcaggcgccttcgcttaaaaagaggttctatcaagtcaaggtcaagagtctaggagaaatcctgggatgccctttgggaggaaggaaacaatacctcttctcgggattctatccctctttagctagaatttctaagatagtccaaatctcgacacaggaattagaccacagaaagcaagtcaaaaagggggtggttggagtaccaaggaaatgtttggaagcaaaagcaagagtcttggcaggtaaaggcgaatgggccccgttcatggacatcctcgcacttttccaaatgtggatgggttggtggaccaggcagcgattaacgcttttctcacctttcatgaatgcaaggaaagcccgtcattcttatttcgtgcagaggatttccaacaccaacgcggaggcacttcagaaggtccgcaaggcatgggagatggtggaaaagaaggataaggaactcagaggcagtagcaacgggggctaccataggtggttgaaagcctacacgcaagttctggattggctcccgaatttgagaaccactaagggggtggcagttgaagctccggaggagggcaaagag

SEQ ID NO: 40906 - DNA, 231 bp, Glycine max
  Peptide Sequence Number=SeqID_132591
atgtgggataccttacaagtaacccatgaaggaacaacatacgtaaaaagggaatggcaaccaaaggtaacgactattacaaaatcaagagatcttactaacatgtcttttgcaactttgtttggaaagcttcaggaacacaaaatggaactaatgagactgaatcaacatgaggagaatgataagaaaaagaaagcaatcacacttaaagcttcatcttcaattcaataa

SEQ ID NO: 40907 - DNA, 880 bp, Glycine max
  Peptide Sequence Number=SeqID_132592
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgtcatagtggaagaaactacaaatgcagtcgaactaatcgaattggtcatcaacagctacttattaaactgtcgcagtttgaatgggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtttccccctggcggctcctcgtgcgctctctgttcctgcctttcggtttaccggtgtcattccgctgttatggccgcgtttgtctcattccacgcctgacactcagttccgg

SEQ ID NO: 40908 - DNA, 288 bp, Glycine max
  Peptide Sequence Number=SeqID_132593
atggggaaggctgttgcttctggaggaagcaacctggctcgcctgggcgagctgggcggcaaccacctcccctattttgctatagataggggaggaagtgaagaagaaaagggtccagcccttaggcacttctctctcttcgaatttgcttggaaaattgtttccgtgaagaaatctaagccgaggtgcttccgaacgttccgtaacgttttccgtgaggatttcgtgagatttcaaccgttcttcgacgttcttcattcgttcttcatcgttcttcgatcttcacgg

SEQ ID NO: 40909 - DNA, 429 bp, Glycine max
  Peptide Sequence Number=SeqID_132594
atgcatatcagctcatcagctgtgcgatggggcattcacacctcatgtgttagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 40910 - DNA, 198 bp, Glycine max
  Peptide Sequence Number=SeqID_132595
atgggaagaatcaaaagaattctcagactgtgtcgttttgaattctttgacaagggagaagggagacacaaaagaattcaggcgggagaagagaatgaaaagatgaatagcacaagttttcaagctttggaaaaccagaaaaattcagaaagcttttggtacaaagaagaagaagaagttcaaagagattcaaggctt

SEQ ID NO: 40911 - DNA, 207 bp, Glycine max
  Peptide Sequence Number=SeqID_132596
atgggagcaagtcagcataggacaccggaattgggtgaattctacaggctttttcactgcaaaattcatttcttggttggtgttttgacaggctttgcggttgatttagggatggcctttgtggataactgggtggtgggtaaggagaaggtttgttattggctgagtaatgacattgttgggttggtgggaaacttggctgtatag

SEQ ID NO: 40912 - DNA, 173 bp, Glycine max
  Peptide Sequence Number=SeqID_132597
atgaagagaccgacaaaaggaaaaaaaagcatagcactcaaagcctcctcctcaatgcaagaagaagaagaagaagaagaagaagaagaagaagaagaagaagaagaatctgatgatgaagaagacttctcactctttgtgaagaagtttcagaaattcatcaaaaatagaat

SEQ ID NO: 40913 - DNA, 120 bp, Glycine max
  Peptide Sequence Number=SeqID_132598
atgacacatggccgactagcaggctaccaagtccaaagccaaaggacgcacctagttgctcatgatcctagggatttaaataaaacaagcgcaagctcggaaggtagtgaaataccttag

SEQ ID NO: 40914 - DNA, 264 bp, Glycine max
  Peptide Sequence Number=SeqID_132599
atgaagaacgtcgaagaacggttgaaacctttcgcgggaaattcctcagcggaaaacgttacggaaacgtttcggaagcgcctcggcttagattttcttcacggaaacaatttttccaagcaaattcgaaagagagagaacaaaataggggaggtgcttgcacgcccagctcgcccaggcgagccaggttgcttcctccagaagcaacaaccttctggagggcccaagtgggcctgggtgctatttgcaccccctttttactaa

SEQ ID NO: 40915 - DNA, 824 bp, Glycine max
  Peptide Sequence Number=SeqID_132600
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatctatttgctgacacaggtctctctagctggaaaagactgtttcctgcattcagaccacaggagcagcctcatttctgccctcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 40916 - DNA, 292 bp, Glycine max
  Peptide Sequence Number=SeqID_132601
tctgggtaggtgacccagaagatgatgatgttgtcttcttgattactggctctggtagagccaggagaacttcctttcctttgctaactatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 40917 - DNA, 420 bp, Glycine max
  Peptide Sequence Number=SeqID_132602
gagcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgctagcctctggctcacctaggccaccaaataacttcatggtgaagaaaccaacttgtctgggcaagctacaactgccccaaagtgaccctttgcctataaataggcgtcctagaggtgttttaaatggctccaaggttcagaagttgagggaattgagagaagaaagaaagaagaagaaagaagaggaaacgaagctgaggcgctaccaaatcgcgactgggatcatttcctacatcgttccttgtccagtgttcttcgtgcaactgttg

SEQ ID NO: 40918 - DNA, 532 bp, Glycine max
  Peptide Sequence Number=SeqID_132603
atgcatagatctcccaatggcaacctagttcctctggacttggaaattgaagtctccttaagaaggagcagagttgagaggagaaggaagttgttgcaagataggacaatagcttccattatagaagaagaagctcaatcttctgactctacatcatctgattcactagcatcaagggaatcagctatatatttatcagaagcctctgtcatggctgatgaacaccaacaaaggattacccttgaggattattctagtagctcagtgtcgcaattctttacaagtatttcacgtcctgaagtccaagatcacaacataaactatcctcattctttgattcatctgatacaggggaacttatttcatggattcatcagactcatcttattttcattttctttggaggaagttgttgagaaatttctgaagaaattcttccccgagtcaaagactgtagaagggaaagttgttatttcatcatttcaccagtttcctgaagaatccttgagtgaagcattggagaggtttcggg

SEQ ID NO: 40919 - DNA, 249 bp, Glycine max
  Peptide Sequence Number=SeqID_132604
atggctagcgggcagggcaagtaccacaggtgggccatggctatactcgtggatgataaagacttccgctcgagagggagactaccatgtggaagagactcacacttgagggggagatgtgttgggttacaagtgtctccttatgtagtggctcgtggtccacaggtgtacccctcgaatccccccaacaggacttgcatgagactttttgattctaagatttttgagggtaacctattgattaggtag

SEQ ID NO: 40920 - DNA, 333 bp, Glycine max
  Peptide Sequence Number=SeqID_132605
cttcctgcgctaagcgcgcccagctcgctcagcagattttcactaacttgcgctaagtgcgaaaatgccgctaagcaagccttcgaggatagaaagctctttttaaggctgaagttggaaaaatcaagcaagtcgtctaagagagaggctaattcagagcgtagaaagcagaacaaaggcgcaaaacagagcaaggaagccaaaaacctcaactttcaagaggaccttaggtttaggggtgttgccttgcgatggaaggctaagtatctctgttgggaaattctgctaaaacttgatgctaacttcgacgagacatctgagaacgaggtttaa

SEQ ID NO: 40921 - DNA, 318 bp, Glycine max
  Peptide Sequence Number=SeqID_132606
atgatgcatcttctgaggccaccatctctaaagccattcatttttgaagcaggtgagacacaggtaaggcaggaggctgctactccagagagatcaccacagatttcaccaaatccatcctctccaatggtagatcaatcttctcttcagcagccagcagaccttcctacaccagtgcatgagatgccagcagacccttctacaccagtcctgggattgactaccactccttcggccactcctgtgctacatcttacagatgaggaggacactcaagatgaggatactcagtcacaagacctgtcacaggaattttaa

SEQ ID NO: 40922 - DNA, 441 bp, Glycine max
  Peptide Sequence Number=SeqID_132607
atgatacgcggagataccttatggttattcgcacccttttgtcatccagaggcggcgggcccgatgacaagcagagaccaagtttggtcattctgcacccttgtatcatccagaggcggcgggcccgatgatacgcggagataccttatggttattcgcacccttttgtcatccagaggcggcgggcccgatgacaagcagagaccaaaggcggcgggcccgatgatacgcggagataccttacggttattcgcacccttttgtcatccagaggcggcgggcccgatgacaagcagagaccaagtttggtcattctgcacccttgtatcatccagaggcggcagggccgatgatacgcggaaatacccgagtggttatccgtataaaacatttcttttgctatctgtaagacagaacgctttgatagcatgcagaggctga

SEQ ID NO: 40923 - DNA, 516 bp, Glycine max
  Peptide Sequence Number=SeqID_132608
atggacgacgtgggcgccagctcacagtcgtccttgcccactgtgaacccaacccctgacccagccgccccagcagagcctcaagcccctgaccctgacctttcccttcctttactggatgacaacgctcgtcgcgccgaactaaatgagcgcggggggtttcttcattttggggacttgtcggatcagcagaaagacaaagtgctaaacgcacaagtcaaaatcgaaagggccattgagaaagctctgctctccgacgggtattcccgggatgagctttctcaaaggaacaaaagggatgagattaggggctttttgttctaccgtaatggaaaacttctttcgatgaaaacatatgactcatatgtaaaagaagtcgaattagggacccaccggagccaaccctataagtttttatttgagcgggggtatcctcaaataataacgaggcccgtcccagaaatggggcggggaaggagaagtgggcatgtgggtctccttcacttgactatttag

SEQ ID NO: 40924 - DNA, 324 bp, Glycine max
  Peptide Sequence Number=SeqID_132609
gggcaagacatttatagtagccaagatgaggctactacttcaccttcctctagtgaaagtgaaaaagcaaaaggggaagaatctagtgaagaaatctacccccaagaagaaggacaaccattagtggttaaagagaagtgtaaggaggcacttgctagcattgccacacctcttgggcttgagtttattcctcaagtaaagaagttgttggatgagggtgttgagggaaggagcccagagtatgatgaaactcgggatttgaggtcaaatcctttccaaggtggagggaatgatgcaatcctatcccgcaagggcattggctag

SEQ ID NO: 40925 - DNA, 231 bp, Glycine max
  Peptide Sequence Number=SeqID_132610
atgaagcaggcacgcaaagcctcacgtctacgatccttgtctactagaccacctagtgctgaaagaccagtggtccatgttgatcctgctatcagcaaggccgatggtccccacaggaagaaattaagaacatatttggggattgtagcgcgtgataaggtggacgtcacggacgagaactggaagaaggtccctactgctcagaaggacttgatttgggaggatattcag

SEQ ID NO: 40926 - DNA, 417 bp, Glycine max
  Peptide Sequence Number=SeqID_132611
atggcaagagctggtgacaatggtggtgtatatcatcaactggacggatgtcagcgcttatttctggacgggatgagtacacaaatgcaacgtttgtttaaccgcaacaaagaagatctctacagacgaatagccaaatcttccttttttactcttaaacctctatcccctagagaagtgtgtgatgaccaaatcagaatgagagaaaagagagaacaagagaaagaaaatagtgaggcaccacaaaagaatatgaaaaagaagagtgatacacccaaagaaaagagtgatacacataagagagagagtgatacacatgagagaaaatttaattattttgcagaggcgagtgaagtgaggaaagtgttacctgctcatgaaccactcaatctacagtattgcaaagacagaatttaa

SEQ ID NO: 40927 - DNA, 408 bp, Glycine max
  Peptide Sequence Number=SeqID_132612
atgaatggagacgctgccttcaacaacaacaacaatagatacaatcccggatggaggaataaccttaatctcagatggtctagccctcaacaacaacaacatcagcctgctccttccttccaaaatgttgctggtccaagtagaccatacgttcctcctccagtgcaacaacaacaacagcaacaacaacagcatcaacagagacaacaatccacaactgaggcctctcctcaaccttcattggaagaattagagactagagcctcaattcagagtttaacaaatcagatggggcagatggccacccagctgaaccaagctcaatcacaaaactctaacaagctgccatctcaatctgtccaaaatcccaaaaatgtgagtgccattacattgaggtcaggaaagtag

SEQ ID NO: 40928 - DNA, 255 bp, Glycine max
  Peptide Sequence Number=SeqID_132613
atggctggtatattcttccttttgaaacagcaaagtaatttagagaattatgagcgggaatgggaagaatcaaaagaattctcagactgtgtcgttttgaattctttgacaagggagaagggagacacaaaagaattcaggcggttagtcctttgttcttttggaaaagggagaagagagacacaaaaagaattcaggcggttagtccttggcgaattctttttggcaaagggagaagagaatgaaaaaggatga

SEQ ID NO: 40929 - DNA, 201 bp, Glycine max
  Peptide Sequence Number=SeqID_132614
atgatggtggcccgggtgatgttggggcatggctacgagtccagaatgggtttgggcaagaacaatggcggcaggaccagcctgcgagccaaagagcccccgccgtgccacaacagtaggagcttcataagtgcgggtttaagacacgaaggtcaagtcgccgggatatgcaatgatgactccacaaggagatcggatttg

SEQ ID NO: 40930 - DNA, 66 bp, Glycine max
  Peptide Sequence Number=SeqID_132615
atgctgacatctccggaaagggcgcagatgaccacattgggctctggtcaccaatcacactttggg

SEQ ID NO: 40931 - DNA, 336 bp, Glycine max
  Peptide Sequence Number=SeqID_132616
atggggatcgcacccacaaagacacccagtggacctgaagaagtccaacagggtcctggggtttccagctctggttacgggcctctatcagtcctacagggtgcccgtacccccctagcaagggatcgcgcccgcgagacatccagtggacccgaagaagtccaacagggtcctagggtttccagctctaattacgggcctctgtcatttctacagagtgcccgtcgaccccagcaagttcatcaggcccctattaatcaggctttcatcaagaagtactgcgtctccaggcaggcgcagggcaaaacaccacagcagcctggggatggtcggtag

SEQ ID NO: 40932 - DNA, 519 bp, Glycine max
  Peptide Sequence Number=SeqID_132617
gaacgtcctgatttgaagttagtgtcacatgggaggaaggtgacactgattgggaggccagtgcctgagattgaagacctagtggctgccacaggattaagtccactgatagattgttcagttattactggcgatcctggacttatatccgcatttgtggagaggtggcacagtgagactagcaccttccaccttccttttccacgctctttctacggaggaggccagatttttgctgacgaagttgctggaagtgtctgccgaggaggccagagccgagacaacactcacatgtggagcatatctcgcgcttatctgctgcaccttgtcggttgtactctttttgctaataagagtgcaacatacgtgcatgtggttcaccttgacgctttccgggacctcgctcgtagtagtggttacgcttggggagttgccgcgctggttcatatctatgaccagttagatgaggcttgtaggaccaccacccgacaacttgcggggtacttgacgctacttcaa

SEQ ID NO: 40933 - DNA, 78 bp, Glycine max
  Peptide Sequence Number=SeqID_132618
atggtggtgcaaatcgccattggaatgggcgatttccttgtgtgcaaatcgccagaccaaatggcaactctcccctaa

SEQ ID NO: 40934 - DNA, 168 bp, Glycine max
  Peptide Sequence Number=SeqID_132619
atgaatttaagaggaagacaagtggagatagctgatccattgtgcccgttctgtaacaatttggatgaagatgcagcgcaccttttcttcaactacagcaaggaaccatatctatgggatcctatctatgtacaaagtacctctggtacttcatcactatttacataa

SEQ ID NO: 40935 - DNA, 727 bp, Glycine max
  Peptide Sequence Number=SeqID_132620
gggtcagtggatccctttcgatgcggatgccctcagccagttcctgggataccctttagtgctggaggagggccaggattgcgagtatggccagaggaggaaccgggctgatgggtttgatgaggaggccatcgcccagttgctgtgtatactgggacaagattttgcctggaccactgccgagagacgggtgcgaatcatgcgcaccaaaatgactaccctgactcagacatggatgacgttgctgcttagcaacatcctgcctagcgatcataattccgacctccctctgccaaagtgtcagctggtgtattccatcctaacacggatgagcgttcatgtggctcagtttatcgctgatgccatttatttatttgcaggtacgccacctaccaggcaccctcaagacccagataagtctaacagtaaggtaattcgaccgccgatcacccgggctttcatagagaaatactgcatagctagacaggcacaaggtggcgacccgcaggccccagacgcaccgccaccacctcctcaggctgatccagctaggcggccaaccacagggcgcacgtgcagacctactctctctaccagcttagcctcagcctgcagagccagggcagcagaggcacccgcaaaggctcccagcgaggtagatgatccccgcgaggacgaggagatgaccgatttgcttgatttcttgggagggagcagagccacatga

SEQ ID NO: 40936 - DNA, 213 bp, Glycine max
  Peptide Sequence Number=SeqID_132621
atggcttccaactcccagcaatttagtgccagaattgatgctattgtcattagaggagtgcataaagtagccacgaattcatcaggtgagactaagaagcttgaagacctccttaacctcagcagcaaaatcagccacaatagaataattatgacctctccagcaacaggtacaatcccgaatggaggaatcatcccaaccttagatggttga

SEQ ID NO: 40937 - DNA, 574 bp, Glycine max
  Peptide Sequence Number=SeqID_132622
atggtgacacgggtgatgctcaagcacgaatatgagcccgggatgggtctaggcaaggtaggcctcgggaatgccgatgtagtcaatattaagggaaatccgtacaagtgtggattagggtatgaacccgggatccgggaaggaggaatgcgccgtcaagattccgggcggataggtcatggcccggccacgttagccaatgtttcaccagtgccagaatcctattcgacgaagaggtggcagcaatcggagaggagtgcctcaagacccgccaagtttcgtgcagccatgccatcccgactcccaagtggggaactggcgtgtgataagccagtcagagatatgagggtcgattctttgagtatcctaacgacgagggaagcgccttggcatattatttggcccagcaacccctctaggattatctgccgatgcaccccgagttcccagatgaagatatcatggccattgggggctatccttgtatccctggatgatgagtgtattcctttcacggtcaggctaggtttcgattgtacctacaatatggccgaatatgaagcatgcgctcttg

SEQ ID NO: 40938 - DNA, 807 bp, Glycine max
  Peptide Sequence Number=SeqID_132623
gcggaatttgatatcccagaggcttctgacaacctcacgaggaaatgggcccttgcagccgatcaggacggtgtcgaggacactgtctgtgacaaatacggcatcagcaaggaaaagtgggcccagttttgccagactcgcagagacccttcttgggaggatgtgcgcatgaaggcacaggccatccagaagcagaatactgcccccacgttttgtctcatgggcgttgatggcgtcatcgaccctccatccccggtcagacgccacgtgaagtggaagatggcccgcatgaagaagacaggggagatgacgactgaggccgcaaaggaaatcgctgagaagattgattcgtttgaggagcaggccacacagggatcgttcgtcccccatggatgtcaggatgttctggccgctgctattggacgtctagagcaccctggacgtgtccgtggtattggagccggtgtcaccatcaagcaatactttggatcggctccacggacgtcccgcagtgcttcctccctgcctcctgacgaattacaccagctgactcagcagatcagggaccagctagaggagtccatcatagagaaagtgacgaggcaggtcatggcatccttcagccaccttcagtcgcagatgcaatctcagggacttgcagtgcctcttgagcctctggttggtcttggtccctccggtcctcgagtgagcacaaaggggagttgtgttgatccctcaggaaatgatcctgagaccggtgactctgacaggtgcggcttgtacatagaagcagatcctgcccgcctg

SEQ ID NO: 40939 - DNA, 510 bp, Glycine max
  Peptide Sequence Number=SeqID_132624
atggccctgaggaagcttgcctcaaagagatctaggaaggataaagctctgctcccgaatatgacagccaccgttttaggagtgttgagcaccagcagcgctttgaggccatcaagggatgctcatttctccgggagcgacgcgtacagctcagggacgacgaacatagtcctcgaattttacgctaatgcttggcctatagaggagggcgtgcgagatatgcgatcctgggtgaggggtcagtggatcccgttcgatgcggatgctctcagccagttcctgggataccctttagtgctggaggagggccaggaatgcgagtatggcaagaggaggaaccagtccgatgggtttgatgaggaggattttgcccggactgatgctgggagacgggtgcggatcatgcgcaccaacatgaccaccatgactcagatctggatgactttgctgctcagcaacatccagcccagcgatcataattttgacctccccctgccgaagtgtcagctg

SEQ ID NO: 40940 - DNA, 242 bp, Glycine max
  Peptide Sequence Number=SeqID_132625
atggcattaaacactccccctccatggttggcgagcggggccagacatttttcgatggaatggcctggggttttcccatggtacgcgcaagtggcattaggatcataccactttaggaaagggggttggaagatcttcccgggagttattacagagtacccgcggagtcgccaccaacgtttatttgaggaaaatgtcggaaaaaccggaaaagacgcgatctacgaacttttaggtgaaag

SEQ ID NO: 40941 - DNA, 273 bp, Glycine max
  Peptide Sequence Number=SeqID_132626
atgctctctgacatagagatcaactctacacactcaggtcacactgatgttaggatttatgtgtccagtattttcgggcaggatgtcctggacattgtatccgacatcgtggatcctgcacaatctgttaaagatataacagatttatgtgtccagtattttcgggcaggatgtcctggacattgtatccgacatcgtggatcctgcagcttcaattcttcatttgacttttatcttgccttgtgcattgtgcagcccgatctggttccttga

SEQ ID NO: 40942 - DNA, 201 bp, Glycine max
  Peptide Sequence Number=SeqID_132627
atggcggtgagctgcgatatgaatctggcaaataattccgagcgacccagaaaacctcggacttgctctctgtcacgggttctggcttttatctcaaggatgtttcggggctcctctatccttctcagttttggctttacacggggaaacatctcgggatttgaccccaaggtaatcggtgttgtactaattgtcaagtaa

SEQ ID NO: 40943 - DNA, 278 bp, Glycine max
  Peptide Sequence Number=SeqID_132628
atggtgcgaaacggcacaagcaccgtcggacatcagcgctggcaagtgtagcggtcacgctgcgggtaacctccacaccagccgcgcttaatgcgccgcttcagggcgagtccccttcgccaatcaggctgcgcaactgttgggaagggctatcggtgcgggcctcttcgatcttacgccagctggcgaaagggggatgtgctgcaaggcgattaagttgggtaacgccagggttttaccagtcacgacgttgtaaaacgacggccagtgaattgtaa

SEQ ID NO: 40944 - DNA, 216 bp, Glycine max
  Peptide Sequence Number=SeqID_132629
atggcaatgaaatggagaaggaagagagagaggagatgccacttcaaggagaagatgagtctagaagaagttcgccactataggcagccatggataagagcttggaggaagaaggagatgaatgaagggagaggaagagaagagcacgaaattttatatatggttcagcccactaatccaagatcaagtccaagattctccactaagtgtgcttag

SEQ ID NO: 40945 - DNA, 518 bp, Glycine max
  Peptide Sequence Number=SeqID_132630
atggataatgaagagggcgtgcaggaacagatgaaggccgatctatcggccttaaaagatcaaatggcttccatctcggaggtcatgttaaaactccagaaaaccatagaggataaagccaccgcaaccgcctccagtacagttagggaagcggagccggtgctgcaacccgccttgaatccgggcctagggagaaacacggccgtgttcggtcgaacgtatagtccgcaagcttatccttatggcctgcctccagacttcaacccctgtgccaccccggaagatttaagccaagcccttacttttgaggggcaactcccaccttatgaagactatcccgggcaagacgatggggaaggagatacccatcttggccccctgctccacctcaaagatccatccccgcatgaactaccccagccaaacatagtccgccatatcccggcctcacccacacccgtaaaagaatctgttcccttcgcggaagataagggaaagattgaggtgcttgaagagag

SEQ ID NO: 40946 - DNA, 729 bp, Glycine max
  Peptide Sequence Number=SeqID_132631
atggttcaaagaaagcattgcttggagataatggagatagaggagatgcaacaagggttgctaaggctttcaagaaatcatcaccaaggatatgtaaatactggatcaacaacaattgtgtacatggtgaacaatgcctgtatctgcattcatgtcatagagttttataatgttatcactggcatcgcacttcctgttggatccgacaaactttattctggcagcactgatgggacagttaggatatgggactgccatactggtcaatgtgctaaagtcatcaatcttggtgctgaggcttggaatatccagaccatgttagagtttactcttgatggacccaaaggccgagtccgtgccatgactgttggcaacaatacactctttgctggtgcagaggatggtgtcatttttgcttggagaggaagctctaaagccgattctccttttgaactggttgcgtcactcactggccacactaaagcagtggtttgtctggcggttggatgcaagatgctgtactccgggtccatggaccaaagcataaaggtctgggacatggatacattacagtgtacaatgacactaaatgatcatactgacgcagtcacatcccttatctgttgggatcaatatctgttgtcaagttcatctgaccgcacaattaaagtctgggcttgcattgaagcaggatctttggaagtgatatatacacacaccgaagaaaat

SEQ ID NO: 40947 - DNA, 228 bp, Glycine max
  Peptide Sequence Number=SeqID_132632
atggcacgcaacgtgtttgctccgtgcccctatttaaggggacctataagggagagagctaaaaaggcttttagtgataactcccaaggtggtcatatttctcttgatgtccccagtggagtcgccaactgtcgcaatctacccttcggcgggagggcgacgcgtgactcgcgggatgcgagttcctcgaaaggaatacgcgcggagtcgccaccaacgtttatttga

SEQ ID NO: 40948 - DNA, 474 bp, Glycine max
  misc_feature (449)..(449): n is a, c, g, or t
  Peptide Sequence Number=SeqID_132633
atgtccatgagcgagcaagctattcgtttaacgcaatacagccacggagccggttgcggttgtaaaatttcccctaaagtgctggaaaccattctgcatagcgagcaggcgaagtttgtcgacccgaacctgcttgtcggcaacgaaaccagcgacgatgcggcggtctacgatctgggtaacgggacgtcgatcatcagcaccaccgattttttcatgccgatcgttgataatccttttgattttggccggatcgcggcgactaacgcgatcagcgacattttcgcgatgggcggcaaaccgattatggcgattgcgatacttggctggccaatcaacacgctggcgccggagattgctcgcgaagtggttgaaggcgggcgttttgcctgccagcaggccgggattgcgctggcgggcggtcactccatcgatgcgccggaaccgantttcgggctcgcggtgactggcgtg

SEQ ID NO: 40949 - DNA, 144 bp, Glycine max
  Peptide Sequence Number=SeqID_132634
atggaggtgggttttgttgtcgatttagggatggcctttgtggataaatgggcggtaggaatggcagtcacagcatgggtttctccctcatccctcaccctccttcatttgccccagttttctcattcgtcccaagcaggatga

SEQ ID NO: 40950 - DNA, 492 bp, Glycine max
  Peptide Sequence Number=SeqID_132635
atggatgagccgcacgaacgagccaagggttacatccagatagaagaaatgtccaaattctggaatgaagcacaagctagacaagtgccaacctctctccaaaaggcccggtatgagcgttacatacccttgacggccaatcgtaccacgattcttgaggaagccttcgacctggaggtacctgtccggctaccccaaatgaaatctctgaggccagggtcagacgcaaccaagtactgcaagtttcaccgcagtattgaacacaacaccaaagattgttgggccttgaacggcaagatcgaagaacttatacaggctggatacttagcccagtttgttaagagaccagaccactaccaggcaggagcaaggcctaaaggacatcaagaggagcaacacaagaaccaagaagtagacaggagaagagtggaagaccgaggtagacagagacaacaaccacagcggcacgagcgaccaccttcaccagaatag

SEQ ID NO: 40951 - DNA, 429 bp, Glycine max
  Peptide Sequence Number=SeqID_132636
atggataatgaagagggtgtgcacaaacagatgaaggccgatctatcggccttaaaagatccaatggcttccatctcggaggtcatgttaaaactccagaaaaccatagaggataaagccacggcaaccgcctccagtacagttagggaagcagagccgatgctgcagcccgccttgaatccgggcctagacagaaacacggccgtgttcggtcgaaggtatagtccgcaagcttatccttatggcctgcctccggacttcaccccccgtgccaccccggaagatttaagccaagcccctactttcgaggggcaactcccaccttatgaagactatcccgggcaagacgatggggaaggagatacccatcttggccccctactccacctcaaagatccgtccccgcatgaactaccccaaccgaacata

SEQ ID NO: 40952 - DNA, 543 bp, Glycine max
  Peptide Sequence Number=SeqID_132637
atggcgaggacgcgtagccctctaaaggtgagggcgtgcagacctctgaaggcgaggacgcgtagtcctctaaaggtgagggcgtgcagccctcaaatggcgaggacttgtagccctctgaaggcaagggtgtgcaaccctctaatggcgaggacgtgtagtcctctaaaggtgagggcttgcagccctctgatggcgagtgcatgtagtcctttgaaggtgagggcgcagagccctctaaaggtgagggcgtgcaaccctctaaaggtgaggacgtgcagccttctaaaggtgagggcgtgtagccctgttatgtcgaggatgtgtagtcctctgaaggcgaggacgtatagtcctatgaaagcgaggacgtgtagccctctgaaggcgaggacgtgtagtcctctgaaggcaaggatgtgtagtcctctgaaggcgagggcgtgtagccctctgaaggtgaggacgtgtagtgctccgaaggtgacagcgtgtagctttctgaaggtgagggagtgtagtgctcaaggacagaacgtgtag

SEQ ID NO: 40953 - DNA, 474 bp, Glycine max
  Peptide Sequence Number=SeqID_132638
atggaaaaccttgagattgacttgatggtagagagtgtgtgcatcccaagtgagcgtgagacacttttgaagtttaagaataatctcatagatccttccaataggctttggtcttggaatcataataataccaactgttgccactggtatggagtcctctgccacaacgtcacttcccatcttcttcagcttcacctccacacttcaccttctgctttctatcatgactatgattaccagtatctcttcgatgaggaagcttataggagatggagctttggtggagagataagtccttgtttggctgatttaaagcatttgaattacttggacttgagcggcaatagatttcttggagaaggtatgtcaattccttctttccttgggacaatgtcctccttgactcacctagacctctcttatactggattctatgggaagattcctcctcagattgggaatctctcaaatttg

SEQ ID NO: 40954 - DNA, 366 bp, Glycine max
  Peptide Sequence Number=SeqID_132639
atgtttgcattttcgtgtattttaattttccagactttttcaagtctcacaagttatccagaactacgtaggtctgagttcctcattggaggatacgtaggagcaggagcctcgcttttgtcgaccgcaccgctttttgttaccatgacccaaaagatggtagcccgcggagacaccttacggttatccgcacctcgtcattcaatgaccccaagtgtgattgacgagcagaggccgacgagcagaggccaatgtggtcatctacgccctttccggaggtgtcagcattttccggtggagactttttcaagtctcacaagttatctagaactacgtaggtctgagttcctcattgaggatgcgtag

SEQ ID NO: 40955 - DNA, 294 bp, Glycine max
  Peptide Sequence Number=SeqID_132640
atgactcatgcaaaatgggaatgtgataacggacaaatgcgggaacgatatgttcattatgatgctgaagagatgttttatgcggtgcatgatatgaatgcattttacggacacgagagcccggaaaattgtctcttcttacttgcgcatttgggggcgcagtgccccatgtgtacaattaagaaggtgatatggaccttccggcttcccgtgacaaaggacgagaccaacatacaatgcatgctagagataaaatgcgggagtgacttgattcacactgatttttgggagtaa

SEQ ID NO: 40956 - DNA, 420 bp, Glycine max
  Peptide Sequence Number=SeqID_132641
atggataatgaagagggagtggaagaacagatgaaggccgacttatcggccttaaaagatcaaatggtttctatcacggaggccatgctaaagcttcagaaaactatagaggataatgccacggcgactgcttccaatacagctagggaagcggaaccggtgctacagcccgcaataaacttgggccgagatagaaacacgatggtgttcggtcggaggtatagtcctcaagcttacccttatggcttgcctccggacatcactccccgtaccgttccaaacgatttgagccaagcccctaccttcaaggggcaactcccaccttatgctgactatcccctgcaagaagacgatgaagaagatgcccatctaggccctctacttcccctcaaggatccggccccccatgaatttccctaa

SEQ ID NO: 40957 - DNA, 183 bp, Glycine max
  Peptide Sequence Number=SeqID_132642
atggggcctgacattgcttttgcagttggaatgttaaaggctttaagatatcagagtaacaggtcattaggaccactgagagctgctaagaaagttgttgtaggatcaacatctgggtacattttcatgatggctggatttcatggaggagtgttaagcagtttatatgaaacaacctgctaa

SEQ ID NO: 40958 - DNA, 549 bp, Glycine max
  Peptide Sequence Number=SeqID_132643
atggctgaaagtgaccatgcaattctgcgtgatagagcccatattcctaccaagagaagcctgctagagctttcatcacaagatgcatcgttagcacaaaacaagctgctgtccaagcaattgacagaaacactaagtaagctgccaactcaattaaattatgtacaaccttcaccctatactattttgcaggttgcaagttgtgtcatatgtggtggagcacatgagtctggttgttgtattccccaagaagaaacaccacatgaagtcaactacatagggaaccagccaagacaaaatttcaatgcaggtggatattctggatttcagcatggccagccatataattcacagcagggacagtggaggaatcaccctggaaaccagttcaacaaagaccaaggtggtccatctaacaggccacaacaacaagggcctagtctctatgatcgaacaacgaagctggaagagactcttgctcagttcatgcaagtatctatgtcaaaccataaaagtacaaagtctgccataaagaatctggaagtctag

SEQ ID NO: 40959 - DNA, 174 bp, Glycine max
  Peptide Sequence Number=SeqID_132644
gtcgactctagaggatcccacatcatcaagaagcttccaatagggacaaatttcaggctcacaaattgcaagtccacccccgcaaagcctccaccctacaccctcacagatctggttgtcgatgtagaggcatccatcggaggaagaggcagtggtgcacagtgtcagggttga

SEQ ID NO: 40960 - DNA, 252 bp, Glycine max
  Peptide Sequence Number=SeqID_132645
atgtatattgttgtggtaaaacaggggcaggatcaccttgggctaccttctggagtagagacaaaacatgaacggcagaaaccaatcaaggtacttaaggacgaatgcgagcggggatggggtcacgaccgaccgatcgttgcccttctctgtgcgaaacaagcagagaatgtcgctgcaaggcagccccgtatcctttgtattttgcagctttcttttactatttgtttgtttcaaaaagaaaaaatataa

SEQ ID NO: 40961 - DNA, 570 bp, Glycine max
  Peptide Sequence Number=SeqID_132646
atgagtcatcattcatctagtgttaatggcgagggtactagtcataaagaccctttatctagaaccttagatgagttgagttccctcaagttatggaaagaaaaacaagagagaaaagaaaaaggaaaaaaaagagtggaagaaataagtcaagatgaaagaaagaaaataagagaggaagaaagaagaaaaataatgaaagaaatgaaaagagaaaaacatgtctcctatagtagtcataactcttgcaagagcctaagtgaagaacttcgtgactattacgaaggaaggcataggtcacatcttagacctcactcccatagaagagaaaaggaaagaaagcctcaagaggctaacattaacctctcatacttccatgggaaggacaatgtagaggctaacttagattgggaaataagggtagagcaacaacttaaaaagaattctacttcaaaatcttatggctctcactcttatccaaagaaagaccaaggtcaaggcatcttaggggtgacaccttctaagcccaaagatgataaggggaaggcaatagaaaaagcaagcccctaa

SEQ ID NO: 40962 - DNA, 315 bp, Glycine max
  Peptide Sequence Number=SeqID_132647
atgcgtgttccacgaaaggaatacgcgcggagtcgccaccaacgtttatttgaggaaaacgtcggaaaaaccggaaaagacgcgatctacgaactttttagtgaaaggttcgggagttgtatttacgcacggggaaggagagaaacgttaaggcatttgaccattaacgatctcttgggttttgaaaggagagaaacgttaaggtgttggaccattaacgatctcttggtttttgaaaggagagaaacattaaggcgttggaccgttaacgatctcttggggtggtcgacaaaagcggggcttttgctcctataa

SEQ ID NO: 40963 - DNA, 261 bp, Glycine max
  Peptide Sequence Number=SeqID_132648
aatccgatttgaagacaaatccttctcaagagggagagaatgatgaggacatgaccaagagcaagggcaaggatccacttgatggacttggagggcctatgacaagggctagagcaaggaaagccaaggaagctcttcaacaagtgttgtccatactatttgaatacaagcctcaaggagaaaagtccaagggcccaattggcaacctaggcatcagccttttgggagaccaaatggtggctgacttgttggctgttgggg

SEQ ID NO: 40964 - DNA, 342 bp, Glycine max
  Peptide Sequence Number=SeqID_132649
atgaactcgctaagcgagaatgctgcgctaactttatctgaagaactcgccaagcgcacttactgcgctaagcgagttcatcccttaaggatgaacattcatcctcttgctgaactacctgtggctaaacccagatacacagacaatgttttggggagaaacattttacctgagaggaaggtagagctctatcacactgagctagatgactttaaggttgaattggaaaggcgtaatttccataaatgcctcaccaatttagccgataggagcatagacctggctttggtgaaagagttccgtgcaaatttatacagttctgatgaccgtccaccaaagtag

SEQ ID NO: 40965 - DNA, 297 bp, Glycine max
  Peptide Sequence Number=SeqID_132650
atgtacagtaattttaatttaaacagtatgtgtttgaacagtattttctggaagcatagcagtctgatattttacttgaatgatactgtagtagtgagtcccgtggttgagaaagggcaactattgcgatctttttcccgtatctcttttcgatcaaactcctcctcatcatcttcttcaagaaactccaatttattaaatgatcaagataaccagacccaagaggtcgcccccaaacacaatctcttcgatgaggaagtcttattcgaagatatcaatcaaaacatggatgactga

SEQ ID NO: 40966 - DNA, 219 bp, Glycine max
  Peptide Sequence Number=SeqID_132651
caagggaatgggggcaatgcagcatgccccattatctcagaatgcaccatagacctagggccatcccctacaacccctcaattcaacaaaaacaagcaacaattcaaggataaatccctcacgtttttgagcaaatacatgcaacttagagcaccaaaatacatcaatggaaagctagagagcccaagaatgaggtgcttacatgttggagatgaataa

SEQ ID NO: 40967 - DNA, 498 bp, Glycine max
  Peptide Sequence Number=SeqID_132652
atggagaaaacatcttgggcgtgcaccgttatcacccaggtgtgtctctgctttgctctatacatagctctcaacttgggtcaacctcagacttctgatctttacttcatcagtgtcaaaggaggtttcagaccctttacccaacaattgcatcttctcaagcaggttttcttatttgtggatattgccaactatgttcttttaatgttcaatcttgatggtttgaaaatggataaggtggcaaaagcttacaacgcaagttttgttgtgagcagcagtgagctgggggaatatgattcactcatgcagaatgctactcaacattttccgtctctgagactaccctggtacaccacatacactactactacatcttcaaaaacaaaaggacaagaagtggggtgcttttcaaagaagatcacgacatctaacaggataacctcaggtgtcatcggtgtggatactgaattattgaaatggattcagaggctaaagtaa

SEQ ID NO: 40968 - DNA, 1323 bp, Glycine max
  Peptide Sequence Number=SeqID_132653
ccacagcagcatcgcatccggcgcgctgaagcacagccgatcaatctgctgatgcatacgttcaatcatgccaaccgggcgatagcgtgcgctgaccatcacctgcggccggcaccagatccacagcgtcgcattttgcgtgctgcgctcctctttactgaaggtgacgtcattcagcaccgccagcagcgcatcgttttgctgcgccagtcgggtgcgcggcgaggccgaatgaatctcatcgaaaaaatcgtcatctacgctgaagtggtcctgaacccagcgctcggcgcgggcatgattcaggttaatgtgcagccagagaaagcagccgtcggcggtcagatccacagcctgcgacaggcctgttacagcatgatgacagcccgcgctggcatcatcattctgtcatacaaaacccgtatcacactgcagttaacgggtgccattcgtgcatcgttaattcaccccggggggtgtgttatggctgaaaacagtttccctgcatcatcgtccgaccgcggacggcccaatctgcacccgcgcagcggtcgcgcgtcgcgcgtgctctttctgctgctgctggtggccgggctgctctttaccggcatcaacctgtttaacgacgtagaagagaccggcgcggtcgtcaccagttatacgccgttcctgctgctcggcgtggcgctgctgattgcgctcggcttcgagtttgttaacggcttccacgataccgccaacgccgtcgccacggtgatctacactcactcactgtcgccgggcgtggcggtggtgtggtccggcttgtgtaatttccttggcgtactgctctccagcggcgtggtggcgtttggcattatttcgctgctgccggtggagctgattctgcaggcgggcagcggtcacggtttcgccatggtgtatgcgctgctgtgctcggcgattgtctggaaccttggcacctggtatttcggcctgccctcttcctcttcgcacacgctgatcggctcgattattggcgtgggcgtggcgaatgcgctgctgcacggccgcagcggcaccagcggcgtcgactgggatcaggcggttaaagtcggttacgccctgctgctgtcgccggtgataggcttcatctgcgccgccgtgctgctgctggccatgaaggcattggtgcgcaatcgccagctgtatcaggcgccggaaggcaatcagccgccgccagcgtggattcgtggcctgctgatcctcacctgtaccggcgtttcgtttgcccacggctcgaacgacggtcagaaaggcatggggctgattatgctgatcctg

SEQ ID NO: 40969 - DNA, 888 bp, Glycine max
  Peptide Sequence Number=SeqID_132654
atgttacaacaggaagaagaaggttcatcctcaaagaaggaagaaacaagttctgctgaagaagaagaagaagaccccttttaccaaaataaagatgattgttttgccattaaagtcccgatcaaaactacttgtcttgtaacaaacagtcaaatagttctagtcaaaactaccggcaactaccagtctcagatttttggctatataaggagtcctcaaccatgttgtgaggaaacccttaggaaagatttttattctccggagaatgagcctcaaaggagatggtttttccaacattgcaagggtacaaacagaaaacaaatccaagacaagttctacgaatttgtcgaaagagtcaaaattaatgtccttttctttgattggtttcatgcttataccattagaaaggatatagattacccttggaaacaagacatcataggtgatccaacaacaaatgtcataacatattgtcacgtaaaggatggtgagttaatccaatcggaattacctcccgcaacacaatatcaactaccaaatatcaaagacagtaacaataaacttgtcatggcaattccattcaagacaaaagatgtcaacgaggaagtaacctctaaagacattaagagcctaatggaacaggaaaattataccaataaatatttacaagctttaggagaaaccataaaaactaaggtagttcctaaacaaaaatcaattgaggaagcttcgccaagtatccccattgaaaaacctttattcaaacctttcaaagttagtgagaaggctaaacgaaaaattagggaacatagaaaaactaaatccttaattgaaggcgtaggtgacaatcatagtgaattactaaacaagattggtagtttacttaag

SEQ ID NO: 40970 - DNA, 234 bp, Glycine max
  Peptide Sequence Number=SeqID_132655
atgagaaactttcccccgaagccaattccagaattcaccccgatcccattgacgtacgaagacctcttgccatccctcatcgccaaccaaatggtcgtaataactctcgggaagatctaccaacatcctttcccaaagtggtatgatcctgacgcaacttgcacgtaccatgggaaaaccccgggccactccaccgaaaatgcatggcccttaaatacaaggtccaacatttga

SEQ ID NO: 40971 - DNA, 254 bp, Glycine max
  Peptide Sequence Number=SeqID_132656
atgaccataatttgtctctgcgtgccatcggacacgattgtctgcaaatggcgaaaaggtgtgcggaatgaccataatctgtctctgcatgccatcggacacgattgtctccaaatggcgaaaaggtgtggaatgaccataatttgtctctgcatatcatcgggctcgccgcctctggatgacaaaaaggcgcagaatgaccataatttttctctgcgtgccatcggacacgattgtctccgaatggcgaaaag

SEQ ID NO: 40972 - DNA, 315 bp, Glycine max
  Peptide Sequence Number=SeqID_132657
atggtcataagcttttcactcggggttcgattcacgcgcataatatatcgagtatgcacgaaattgaacacgaaagctgctcaagaaattcaaacggtcataccctttcactcgggaaagtcgattcaggcacataatatatcgagatgcaacgaacgaacggggagaggcggttctcgtaaattcaaatgggcgtctaacgtttcactcgcgcgctcggttcgattcaggcgcaggcgagcggtatcagctcactcaaaggcggtaatacggttatccacagaatcaggggataacgcaggaaagaacatgtga

SEQ ID NO: 40973 - DNA, 642 bp, Glycine max
  Peptide Sequence Number=SeqID_132658
aggatcccacctcttagggtgaggacgtgcagtcctctgaaggtgagggcgtgcaaccctctgaaggcgaggacgtgtagtcctctgtcggttagagcgtgtagccctctgaaggtgaggatgtgtagtcctctgaaggtgagggtgcgtagccctctaaaggtgaaggcgcgtactcctctgaaggtgacgacatgcagtccgttgaaggtgaaggcgtgcaaccctctacagtcgagggcgtgtagtcttttgaaggtaacaacgtgtagccctatcaaggtgaggacgtgcagtcctctgatggtgagagtgtacaacactctgaaggtaagggcgcgcaacactctgaagttaagagcgtgtagccctctcaaggtgaggacgtgtcgtcctctgaaggtgagggcgcgtagccctctgaaggtgaggacgtccagtcctctgaaggtgagggcgtgcaaccctctgaaagcgaggacgtgtagtcctctgtcggttagagcgtgtagccctctgaaggtgaggatgtgtagtcctctgaaggtgagggtgcgtggccctctaaaggtgaggacctacagtcctcttaaggtgagagcgtgcaaccttctgaaggcgaggacgtgtagtcctctgaag

SEQ ID NO: 40974 - DNA, 1165 bp, Glycine max
  Peptide Sequence Number=SeqID_132659
ctgcgcggcggcaaaagatggttctaactactctcgctggtgctacaagccgtttgaagacctgatccagccggcgcgtgcgaccgacgatcacaacaaacgtattgaactgtacaagcaggcgcaggttgtcatgcacgatcaggctccggcgctgattgttgctcactccaccgtgtacgagccagtgcgcaaagaagtgaaaggctacgtggttgatccactgggcaaacaccacttcgaaaaccgtcacccggcagcagtgctttattccctctctgaaaggagaggggataagatttgtgagcaatacagacgccacgccactggtcgtgcgtcatcagagagaatccgggttatgttgcagttcatcctccgacgtctgggacttgttatccccacgtttatcggtatcacccttctcacttttgccttcgtccatatgatccccggcgacccggtaatgattatggcgggcgagcgtggtatttcccctgagcgccatgcacagctgctggctgaactcggcctcgataagccgatgtggcagcaggatttcgtgaaaagccgtcttccggtgtgggacgagttcgtgccgcgttttaaagcgacactggagcttggcgtctgcgccatgattttcgccaccgcggtgggtattcctgttggggtactggctgccgtcaagcgtggctctatttttgaccataccgccgtgggtctggcgctgaccggctactccatgcctatcttctggtggggcatgatgctgatcatgctggtctcggtgcagcttaacctgacaccagtttccgggcgcgtcagcgatatggtcttcctggacgactccaacccgctcaccggctttatgctgattgatacggctatctggggtgaagagggcaacttcatggatgccgtcgcgcatatgatcctgcctgccatggtgctgggcaccattcctctggcggtgatcgtccgtatgacccgttcatcaatgctggaagtgctgggtgaggattacatccgcaccgcccgcgccaaaggcctgacgcgtatgcgcgtcatcatcgtccatgcgctgcgtaacgccatgctgccggtagtgaccgttatcggtctccagcgccgtgactatccggttgtgcagggcggtgtactgctg

SEQ ID NO: 40975 - DNA, 479 bp, Glycine max
  Peptide Sequence Number=SeqID_132660
acccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttagtcaacacaggctctgcctgttgctttggatgattcatgataactcgtcggatcgcacggcctttgtgccggcgacgcatcattcaaatttctgccctatcaactttcgatgggagcctgaggggacgctaccagataccaaggaaggcagcaggcgcgcaaattacccaatcctgacacggggagttaaaaagctcgtagttggaccttgggttgggtcgatcggtccgcctccggtgtgcaccggtcggctcgtcccttctgccggcgatgcgctcctgtccttaactggccgggtcgtgcctccg

SEQ ID NO: 40976 - DNA, 774 bp, Glycine max
  Peptide Sequence Number=SeqID_132661
atggagagagtttatgagagatccactgttgttcataacactccttttttgtctggccaagtaaaggtgagtgtggaggaggttacagatgcagatgctccagttcctgtacccactgatgaggtttccttagtggggcaggtacttcacaccttccttgcttggccgacacatctggtcaagtctttatcacagcaggtagctgagtctccgccaaaaccacctccgaagcccgatccggaggtcgatgatccgctttatctgatgacattgaccatcccagagcttttcttgaggccttatcaagttagatgggatgccactgtggtcaatgtcttctacataaagcacgaagacctcttcgaaattgcacacggtggtcaatgtcttagcatatcagtgttacaattgttgattctgcatctcactgaaacatgtatgcgagtggggaattctgatatctatggattcctcgagccacagttcattcagaggtctgggcaatcacagtttgagtctgaaagttacataaagagttggatgcagagttcacaacgtgatgtctatcttggagcctacctaaatgggttccactgtaaccgacactggcagatggtggtcatcctgcccaaggaacacctagttgtctggttttgttcattgcataacaggccagacaactaccttaaggggattattaatagtgctatcaagggtcttgatgatgctccacagcctaaatcaaaggcttctgctaggtggattgtcgtcaag

SEQ ID NO: 40977 - DNA, 318 bp, Glycine max
  Peptide Sequence Number=SeqID_132662
atggcggttccaaaattagggtttcgttctctaccgaaaccgcaagccaagttggaagattccgcttcggttgaagggttcctcttagtgtggggtttcaatgaagaacaactatggtttgtggtggctaatggtggctgtgggagatggagaaagtgcttggaacttttagaaatggctttggaagaaagaaagaagaacgaaatgacgtttttcctaagctacacgaaagcaaaggctaaaatgcttaaatcagagatgctcttgggaacggaagcttctagcacattccagacatcttctcaaagatcccaatag

SEQ ID NO: 40978 - DNA, 144 bp, Glycine max
  Peptide Sequence Number=SeqID_132663
gagcatgaatgcgccatggcaatgacattcatggggctccgagaaaaagtggagaatggagaattggcgaatagcgctaggcaaagacattcgcggggctccagactcgaagatggaggacacatgaacagcgctaggcaatga

SEQ ID NO: 40979 - DNA, 1119 bp, Glycine max
  Peptide Sequence Number=SeqID_132664
atggcccgcacgaagaagacaggggagatgacgactgaggccgcaaaggaaatcgctgagaagattgattcgtttgaggagcaggccacacagggatcgttcgtcccccatggacgtcaggatgttctggccgctgctattggatgtccagagcaccctggatgtgtccgtgctgctggagccggtgtaaccatcaagcaatactttggatcggctccacggacgtcccgaagcgcttcctccctgcctcctgacgaattacagcagctgacccagcagatcagggaccagctagaggagtccatcacagagaaagtgacgagacatgtcatggcatccttcagccagcttcagtcacagatgcaatctcaagcaccttctgagcctctggttggtcctggtccctccgatccttgggtgagcacaaaggggagttgtgttgatccctcgggaaacgatcctgagatgggtgactctgacaggtgcggcttgtacatagaagcagatcctgcccgcctggttgccgtggggagagtttatgagggatccactcttgttcataacactcctttgttgcctggccaagtaaaggtgagtgtggacgaggttaaagatgcagatgctccagttcctgtacccactgctgaggtttccttagtggggcaggcacttcacaaccttccttgcttggctgacacatctgatcaagtagttgtgtctccgcaaaaaccacctccgaagcccgatccggatgtcgatgattcgctttatctgatgacattgaccatcccagagcttttcttgaggccttatcaggttagatgggatgccaccgtgttcggggtcgttaatccagatttccccctgtacataaagcacgaagacctctccgaaatcgcacacggtggtcaatgtctcagcatatcagtgttacagttgtggattctgcatctcactgaaacatgtatgcgagcggggaattctgatatctatggattcctcgagcctcagtccattcagaggtctgggcaatcgcagtttgaatctgaaagttacataaagagttggatgcagagttcacaacgcgatgtgtatcttggagcctacctaaatgggtaa

SEQ ID NO: 40980 - DNA, 471 bp, Glycine max
  Peptide Sequence Number=SeqID_132665
atgaaagataagagggatgaggaagaaaaactagaaaaacaaaagaaaaagaaggatattaatgccttgtcttcaaaggccaaggggaaggaaaaggtggaaaaggattcctccaagaagattgttaagaaggaaaatcattttgcaacaaaaggtgatattaaaagagcactccttcttaaacaatctttctaccttctcctatcaagggaaacatcccttagcaccaccatacctcttgagcttgaggttattcctcaagtaaaggagttgttggatgagggtttggttcgcaagagcttaaatccttgtgctttgttggtgcctaaaataggaataatcaacatgaaatttatagaaaaaggtgccgagggaagaagcccagagtatcaagaacctttggatttgaggtcaaatcctttccaagggggaggggatgatgcaatcctactcccaaaggatattggataa

SEQ ID NO: 40981 - DNA, 567 bp, Glycine max
  Peptide Sequence Number=SeqID_132666
tgtacgactagaggcaatccatctgacttacaaccctttgatcctaagatagataggacatttcatagattagttaggcatcattttataccttttgatcattctgagcattccataactggtgaatctgtgcattctgttattggtgattttgaacatcctgatcttgagcattataattttgagcattataattttgagcattctgattctgagcattctgattttgcacattctgagaacatggcacaacctccacctcgtgagcggactctaagggaaatggctgcacctgatttcacctatgaaagcttgtgcatccaataccctgatgaggatgtcccatatgttcttaaaactggactgattcatttgcttccaaagtttcatggcctcgcaggtgaagacccgcacaaacatttgaaagaatttcacattgtctgctccaccatgaaacccccagatgtccaagaggatcacatatttctgaaggcttttcctcattcattagagggagatgtccaaggtccatcacgagctgggatgaccttaagagagtattattag

SEQ ID NO: 40982 - DNA, 507 bp, Glycine max
  Peptide Sequence Number=SeqID_132667
atgaagctgctaagggtccaacacaagaaacaaaatcaaggtgacaattgtttcttttgcagtaagcctggacatgtaaagaagaaatataccaaatatcatgcttggcgtgcaaaaaagggtatgttccttactttggcctgttctaaggtcaatttaacttcagtacctagaaacatttggtggttagattctggtgccactactaacattagtgtttcaatgcagggttgcctaagctaccggaagccaattgattatgaaagatggatctatgttggagatgcttcctatggtgaatcctttaatacagaattgtgtggtactaagcgtagaattgataatacaaactcaggagcattatggcacaagcgcttaggtcacatttctaagaacaagaaattgaacgacttgggtcaaacaaaatcttggattccattgatttcacaagctttgatgtttgtgttgaatgcattaaaggtaaacagatcaaaagcaagaaattaa

SEQ ID NO: 40983 - DNA, 576 bp, Glycine max
  Peptide Sequence Number=SeqID_132668
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatgtggagccctctgaaagtgaggatgcgtagccctctaaaggtgagggcgtgcagccctctgaaggcgagggcgtgcagccctctgatggtgagtgtcgcaacctacccttctgcgggagggagacgcgtgactcgcgggatgcgtgttccacgaaaggaatacgcgtggagtcgccaccaacatttatttgaggaaaacatcggaaaaaccaaaaaagacgcgatctatgaacttttaagtgaaaggctcgggagttgtatttacacgcggggaaggtattag

SEQ ID NO: 40984 - DNA, 318 bp, Glycine max
  Peptide Sequence Number=SeqID_132669
atgtccgttgaccttgaagctcttgtttatggagtcgctttcatatactcaatgcaactttctttcctcaccaaaggcttgatcaaaggaattcaagtttcactgcccagtaagtccatttgtgctcaaactttccataagaacaaaattgccctttccaaatacgccgatggaattaggacgcatcaacaagaatcaagccaaggctattgtgcaagcaatcagatgtgcccagagagcaacaacacggtactcaatgacttatcgatgatggatggctcaaatcttctcacaaaggtaaacatctcgtcaaattga

SEQ ID NO: 40985 - DNA, 441 bp, Glycine max
  Peptide Sequence Number=SeqID_132670
atgggtaaagcagaggaggtgcaagagatggtgaaggccgacatggaggccatgaaagagaaaatggccacaatgatggaggccatgatgagcatgaagaagataatggaagccaatgcagttacaattgccgctactagcactgttgctaaggtgaacccgatgcccccatctggcctcaaccaaatgaatcatccaaccttagatatggtaggcaaagatttgggaagtaaggacggccctcatgatgtgcaaacaagcacgccttcccgccatatggcctgcctcccaactataggccacccaatgtggcgtacactcccaataagaatgtcaataactccactcctatacccattaagagccaacaaccccaaattgatcatgcacatgtctcttaaaccgtgggggagacacatgaaattccccaccacaatctag

SEQ ID NO: 40986 - DNA, 648 bp, Glycine max
  Peptide Sequence Number=SeqID_132671
atgatagatcaaggtcgactggaagtcggcagtgagggaagagaagagcagcatatctgcatgcagtccgcgagggagagcagtcttgcgaagcccaaacctttggtaatatatttcaccaagggcgcagcttcgcaaaaaccccgacaccctttggcacctaagcttgtccctttcccataccaaaatagccacacaatcccatggaagtacacacctccgaacaaagaggaagaagaaaccaccgacatcagttcattgttggccaaagtaaccaatatcacggggctgagcggtgtgacccgcagcagtcgtgtatttgtgccccccgacctaccaattcagcccacgaacgtcaaggggaaggcaaaggttgtggaagaacaagatgataaaaccccccacactccgaacgaggatattctggcaaaaggtcctccggagaaaagggatggttatggcaagaaggaggtgtcactagaggaagccagcgagtttctccgcataattcagcagagcgagttcaagggtctcgctgttggaattactcatgagctcggaacctcatcgggctttgcttgtaaaggttttgaacaaggcccacgtagcccaagatatctcggtggaaggcttcggagggcttgttaa

SEQ ID NO: 40987 - DNA, 111 bp, Glycine max
  Peptide Sequence Number=SeqID_132672
tctcccagttatccagaactacgtaggtctgagttcctcattgaggatacgtaggagcaagagcctcgcttttgttgggcgctccacaatctctgttatactggccctgag

SEQ ID NO: 40988 - DNA, 231 bp, Glycine max
  Peptide Sequence Number=SeqID_132673
atgatattgcaagagattagaaggcctaactctctaaaaacagtccccagtggagtcgccaactgtcgcaacctacccttcagcgggaaggcgacgcggggctcatgggtgcgtcttccatgggaggaagatgtgcggagttgccaccaacgtttattcaaggaaaacgttggaaaaaccggaaaggtattagcactccacgcgtccgtcccaagggacggtagcctttaa

SEQ ID NO: 40989 - DNA, 204 bp, Glycine max
  Peptide Sequence Number=SeqID_132674
atgttggcaacccattctggataccgagcgacggccagaaatccaacgtcaaattgcttcttcacttcttcttttatcttcaaggatgttttgggcttcatccttctcagtttctactttaccgggggacactcgggatttagagataggtgcggtaatacctgtgcctatctttacttccctttttccactgccaattcctaa

SEQ ID NO: 40990 - DNA, 576 bp, Glycine max
  Peptide Sequence Number=SeqID_132675
atgccgctgcatatcatagataccgcagacaagcgtgacgacagtgatgaagtggagagcatcggcattgaacgcgcctggcaggaaattgaacaggcggatcgggtgctgtttatggtcgacggcaccaccaccagcgccgttgacccggcggagatctggccggactttatcgagcgcctgcccgctaagctgccgattaccgtggtgcgtaataaagccgatgtcaccggcgaagcgctggggctcagcgaagtaaatggccactcactaatccgcctgtcggcgcgtaccggtgaaggggtcgaggtgctgcgcaaccaccttaagcagagcatgggcttcgataccaacatggaaggcggcttcctcgcccgtcgtcgccacctgcaagcgctggaaacggctgcggaccatctgcagcagggcaaagcgcagttgctgggcgcctgggccggtgaattactggcggaagagctacgtctgtcgcaacaggcattaagcgaaatcaccggcgaatttacctctgacgatctgctgggccgtattttctccagtttctgtatcggtaagtaa

SEQ ID NO: 40991 - DNA, 201 bp, Glycine max
  Peptide Sequence Number=SeqID_132676
atggtttccggggcttccgtcgctttcgtaaaatttccgaaaaccttgggaggaagcaactgggcggcaagctcctccacgtttttgaaaaatggtttccgggtgatgcaatcctaccccgcaagggcattggatagaagactccaagtagattgggccagagatccaagggaaggccctagggttctcatgagccttagg

SEQ ID NO: 40992 - DNA, 426 bp, Glycine max
  Peptide Sequence Number=SeqID_132677
atgacaatgatagtagacacattactagtattcaactatggaaaaaggtgggctaccccccttcaaagctttgaggatttggtcttcgctagtgaaaggatcgatgtgggtccggaaagaggcaaatttgatcatccgaataggacgactgagaaaactggggcaaatgaagagggtgagaaagagggagaaacccatgctgtgactgccattcctatacggccaagtttcccaccaaccccaacaatccataaccctagccaaggttcatcaacctccatttctccgagaatacgatcgaacgcaacgtgtgcttgtcacggagaagccccggggcgttccattgagcatggtagggctctgaagcgtaaggtgcaaggtctaattgatgcgggctggctgaaatttgaggagaaaaacgtgtaa

SEQ ID NO: 40993 - DNA, 942 bp, Glycine max
  Peptide Sequence Number=SeqID_132678
atgccttcgcttaaaaagacgttctatcaagtcaaggtcaagagcttaaggatcaccagtctaaaagagttagggcaattgatgggtcagctccagcggcaagcttttcgcaaagcttacggtaaaatctgggacctagccatggtagaagtctccaccgaggccattgcttccctcgcccagtattatgatcagccgttgaggtgcttcacctttggggacttccagctatcacccatggtggaagaatttgaagagatcctaggatgtcctctagggggaaggagaccatacctcttctcaaggttctatccctcattagctagaatttctaagatagtccaaatctcggcacaggaattagaccacagaaagcaagtcgaaaatggggtggttggaataccgagaaaatatttggaggcaaaagcaagaatcttggcaggtagaggcgaatgggccccgttgatagacattctcacactattgatcttcggaggagtcctctttccaactgtcaatgggttggtggacttagcagcgatcgacgcttttctcgcctatcatgaccacaaggaaagcccggttatcgctatgctagctgacctatatgatactttcgaccgaagatgtaaggcatgcatagagaaaggaggcgcaaattgggaccaactcttagcaaaaaaagaaggagcgtctatcaactggttccctcgatggaaagaaggaagaatcagagttcttattttgtgcggaggatttccgaatgttcccttgatggggacaaggggttgcatcagttacaatcttgttcttgctataaggcaacttggctacactatgagaagggcaccactagaggaagagatcgcgcctgtcatttcacgaggtttcaataagaccaacgtggagacacttcagaaggtctgcaaggcatgggaggtg

SEQ ID NO: 40994 - DNA, 375 bp, Glycine max
  Peptide Sequence Number=SeqID_132679
atgtcgctaagcagtagtgtttattttgtgaagatggcctccaggaaacataagagcattggggcgaggccaactgctcaatatgatactagacgatatgacttggggaagaatattttgctagaaagaaaggttgagatataccacacggagttcgacgacttcaagacagagttggagaggcgtaatctttacaaacgcctcaccaacttggctgatgggactattgatcttgctttggtgaaggaattttatgctaatctctacagctttgagggtccttcaccaaagcaagctagagttagaggctacctggtgaagatagatgcagacaaccttaacacatttttagagacacctgtagtcctagagtag

SEQ ID NO: 40995 - DNA, 282 bp, Glycine max
  Peptide Sequence Number=SeqID_132680
atgacggagcgagtcttgagcgatctaagggctgcaaggattcccactctgtacaccgtcgattggagaagtgatgcatcggctctgaagcccccagtgcccaccgcgatctggattagcatggaagcactcgatcgatgtgggagcgggcgtgatcgacgcggattgcagggggttgcacagatgataatccagcagatcgtgatgccggaggttgttgaggttcaggatttggattctacactcagagctgaaggtggcttcggatccactggagtttag

SEQ ID NO: 40996 - DNA, 465 bp, Glycine max
  Peptide Sequence Number=SeqID_132681
ctcagcttcctcattttcgcccccccaaaaggagtgaagctatcgtacggcactgggggccttcagagccgatgcatcacttctcaatcgacggtgtacagagtgggaatccttgcagcccttagatcgctcaagactcgctccgtcattggtctcatgatcaccgcctcacacaacaaagtctccgataatggagtcaaaatcgcttacgcaagtggcggcatgctctctcagcattgggaacctttcgtcgacgccctcgccaacgccccttctccccaacacctcctcctgttgataaatgaattcgtggagaaagaaggaatctcggtggatggggactggcaagtcgaagtgcttttggggagagacacgagaccaagtggagagatgctttgcttcaagcagctaaacaggcatgagcaaggttttaaattacaatcacagtttctttgcgctccttga

SEQ ID NO: 40997 - DNA, 377 bp, Glycine max
  Peptide Sequence Number=SeqID_132682
ctcgtgggggttatgactatttcgggagcagaagctccttggctgagaagacgaagaagaagctggaggaagctgcacagtcaggaagcgttgatggcatcatcgagcctccatccccggtcagacgccacgtgaagtggaagatggcccgcacgaagaaaacaggggagatgacgactgaggccgcaaaggaaatcgctgagaagatcgattcctttgaggagcaggccacacagggatctttcgtccccgatggacgtcaggatgttctcaccgctgctattggacatccagagcaccctggacgtgtccgtgctgctggagttggtgtcaccatcaagcaatacattgggatcagctccacggacgtcccatag

SEQ ID NO: 40998 - DNA, 252 bp, Glycine max
  Peptide Sequence Number=SeqID_132683
atgaaaggtgataattataaggtttggaaggaaataattctccttcatttgggctggatggataataactatgctataaggaggaatgagccaccgggtattactgaaactagcgaacctgatgttgttgacctttatgaaaagtgggagagatctaatcgtctctccgttatgttcataaaaaccaacatatccgctagtatctggggttcatttgaccagtatggtcagagatctgttgaaagccattga

SEQ ID NO: 40999 - DNA, 581 bp, Glycine max
  Peptide Sequence Number=SeqID_132684
gggaagaatctagtgaagaaatctacccccaagaagaaggacaaccattagtggttaaagagaagtgtaaggaggtaagtgtctcctccaagagtttagctaagaaggaaactcattttacaataaagacaaacattaaagaaactttccctcttagacaacctccacattttctcttttgtaaaaaggcacttgctagcattgccacacctcttgggcttgactttattcctcaagtaaagaagttgttggatgagggtttggtttgcaagagcttaaatccttgtgctttgttggtgcccaaaataggtggtatgatgaatgttttgagtggtgcaaccctcttttgtaaaatcactcgtacacctaacatcttcatggtgtgtgtacatagggacccattaggtagtgatcaaggggttcccatgaaccctaagagaataaaggtcattcctgagtggcccactccaccaagtgttgaggaaaaaggcccagagtttcaagaacctcgagatttgaggtcaaatccttttcaaggaggagggaatgatgcattcctaccccgcaagggcattgggtaa

SEQ ID NO: 41000 - DNA, 423 bp, Glycine max
  Peptide Sequence Number=SeqID_132685
atggcagacttcatggaataccaagctagctctaaaggttattattattctatgcaacagcagggaactcaatttgaaagggactattcttctgcagattatcaagagggaccagagttacaaccttactatcaaaatgaagcagaaagagaggttgaagctcaaaaggaaagccctgtaaaagaacatgagtcaagagaaaaagatgagaaacatgcacaacaacaatgggagaagtactcaacaaaaagaagacaaggagagcatgaggaaaccttaagtgccattctttctttaatcactaacacttctcctgaaatgatttggaatgtacttccagactacatgaagttcatggaatttctagctaaaaggcgaaactgcaaggaagatgtgttctatgtgactttcatgccaccttga

SEQ ID NO: 41001 - DNA, 123 bp, Glycine max
  Peptide Sequence Number=SeqID_132686
atggccgaccagcaggctaccaagtccaaagccaaagataagcaaaagacgcacctagttgctcatgatcctggggatttagataaaacaagcgcaagctcggaaggtagagagataccttag

SEQ ID NO: 41002 - DNA, 441 bp, Glycine max
  Peptide Sequence Number=SeqID_132687
atgcagctaccgcaagagcccttgaataagaaaccaagaaggatcgcaaggaagagcatggccgagacaaattctgtggagctttgtggggcagcaacacatttatacgagacagagaccaacatgttagccatcgtcagcaagtaccaagaagaattaaatctagccatggcccacgagcataaagtggcagacgagtatgcccaagtgtacgcggaaatggaggctagaggaagggtgatcgactcgttacatcaagaggcaacaatgtggatggaccgatttgctcttacattgaacgggagtcaagaacttccccaattgctagccaaggtcaaagcaatggcggacacctactccgcccccaaggagatccatggacttctcagctattgtcagcatatgatagacttaattacccatataattagaaaccgctag

SEQ ID NO: 41003 - DNA, 632 bp, Glycine max
  Peptide Sequence Number=SeqID_132688
gaacaaaaggtgcagaaggctgtgtcagcccctgcatgctatcaagcgttctgtcttacagatagcaaaagaatgggtgcgaataaccataaggtatctccgccgtatcatgggtgcagaatgaccaaacttggtttctgcgtgccatcggacacgactgtgtctgaatggcaaaggggtgcggataaccgtaaggtatctccgcgtatcatgggtatctccgcgtatcatgggtgcagaatgaccaaacttggtctctgcgtgccatcggacacgactgtgtctgaatggcaaaggggtgcggataaccgtaaggtatctccgcgtatcatgggtgcagaacgaccaaacttggtctctgcttgtcatcggacacgactgtgtctgaatggcaaaggggtgcggataaccgtaaggggtgcggataaccgtaaggtatctccgcgtatcataatgaccaaacttggtctctgcgtgccaacggacacgactgtgtctgaatggcaaaggggtgcggataaccgtaagggtatctccgcgtatcatgtgtgcagaatgaccaaacttggtctctgcgtgctcatcggacacgactgttgtcttgaatggcaaagggtgcggataaccgtaag

SEQ ID NO: 41004 - DNA, 354 bp, Glycine max
  Peptide Sequence Number=SeqID_132689
atgatggtggcccaggtgatgctggggcacgactacaagccaggaatgggtttgggtaagaacaacggtggtaggaccagcctggtgcgaccagaagaaaccgcgggaagtttagaaaggaagaacaaaggccagggcctgcggttgggacaacgagccaaagaggccccgccgtgccacattagtacgagcttcataagtgcgggtttaagacacgaaggtcaagtcaccgcgatatgtgatgattactccccaaggagatcggatttggtacggccatgccctcccggtttcaaactaggaaattggcgggtggaggaatgcccagacgtttacgcaacaagcctaatgtaa

SEQ ID NO: 41005 - DNA, 477 bp, Glycine max
  Peptide Sequence Number=SeqID_132690
atgagcaactctttacctgacacagcctcccctcttctgcccatcccgccggaacatccggtgaactggccgcagggcgatctgaactgtgccgcaatcaaggcgcacatcgataccttccagcactggctcggagaggcatttgataacggcatcgccgcagagcagctcatcgcggcgcgcaccgagtttatcgaccagctgctgcagcggctgtgggtcgactatggttttgaatccgtctgcgacctggcgctagtggccgttggcggctatggccgcggcgagctgcacccgctctccgacgtcgacctgctgattctgagccgtaaaaagctgccggacgagcaggcgcaaaaggtcggcgagctcctgaccctgctgtgggacgttaagctcgaagtcggccacagcgtgcgcaccctcgaagagtgtttgctcgaagggctttcggatcttaccgtcgccaccaactaa

SEQ ID NO: 41006 - DNA, 237 bp, Glycine max
  Peptide Sequence Number=SeqID_132691
atgaacttaggccgggacagaagcgcaatgggtttcaatcagacgtatagtcctcaagcctacccttatggtttgcctccaaacttcactcctcgtaccgctccagacgatttgagccaagcccctaccttcgaggggcaactccctcctcatgtcgactatcctctacaggaagatgatgaaggagatgcccatttaggccctctacttcccctcaagggaaccagccccccatga

SEQ ID NO: 41007 - DNA, 318 bp, Glycine max
  Peptide Sequence Number=SeqID_132692
atgttagccatcatcagcaagtaccaagaagaattaaatctagccacggcccacgagcacaaagtggcagacaaatacgcccgagtgtacacggaaaaggaggctagaggaagggtgattgacttgttacatcaagaagcaacgatgtggatggatcggtttgctcttactttgaatgggagtcaagagcttccccgtttgctggcaaaggccaaagctatggtggacacctactccgcccccgaggaggtccatgggctcctccgctattgtcagcacatgatagacttgatggcccatataattaggaatcgttag

SEQ ID NO: 41008 - DNA, 258 bp, Glycine max
  Peptide Sequence Number=SeqID_132693
atggcattagcgcgtggttttcgtagggaaacaacccgtggggcattttggaaattgccccgaggaagcttgcctcaaagaggtccaggaaagataaggcgactgaaggaactagttccgctcctgagtatgacagtcaccactttaggagcgctgtacaccagcagcgcttcgaggccatcaagggatggtcatttctctgggagcgacgcgtccagctcagggacgatgagtataccgatttccaggaagaaatag

SEQ ID NO: 41009 - DNA, 325 bp, Glycine max
  Peptide Sequence Number=SeqID_132694
ggaggaaaaggaccagtcgcgagcacatagcatggttttgaaagaggagttagttgcctgttcaaggtccaaaagaagcttgtctcagcgtttatgcgagacggagaccaacatgctagctatcatcgccaagtaccaagaagagttaggtctagccacggcccacgagcatagaatcgcggatgagtatgcccaagtatacgcggaaaaagaggctagaggaagggccaaggcgatggcagacacctactccacccccgaagagattcatggggcttctcggctattgtcagcatatgatagacttaatggcccacataattag

SEQ ID NO: 41010 - DNA, 336 bp, Glycine max
  Peptide Sequence Number=SeqID_132695
atggcaccagtgactatgggattatgtactgtcattgttcagattcaatgctggttgggtattgtgatgctgattgggctggaagtgcagatgacagaaaaagcacttctggaagcagaactgtgtgtccctatctactgcagaagccgagtatattgcagcaggaagcagctgttcacaactagtttggatgaagcagatgctgaaggacatgttgacactgaggaacaaatagcagatattttcacaaaggctttggatgcaaatcagtttgaaaaactgaggggcaagctgggcattgttgctagaggaattatagcagctactgcaatctga

SEQ ID NO: 41011 - DNA, 653 bp, Glycine max
  Peptide Sequence Number=SeqID_132696
atggaggccatgaaagagcaaatggccacaatgatggaggccatgatgagcatgaagaagataatggaagccaatgcggttatagttgccgctactggcgctgtcgctaaggtgaacccgatgctcccatatggcctcaagcaaatgaatcgtccaacctcaaatatggtaggcaaagatttgggaagtacggataaccccatgatgtgcaaattcaaaacaagcacgccttcccgccatatggcttgcctcccaaactatacaccacccaatgtggcgtacattcccaatgaggatacacatgaaattccccaccacaatctagccgacttcgagccttggctcggatatgccactgaagggcaagcagttggtggtataccccttgaaaacacttcggaaggccctcagtatcacccccagctacacctcttgcattccacaacaagtaaaaaccctcgtgctatggcagaaatggaaaagttagatcatttagaggaaaggctcagggccattgaaggaggtgaagattatgcctttgctaacctaaaagagttgttcctagaacccaatatcatcacccctcccaagttcaaggtgttggactttgacaagtacaaggggactacttgccccaagaaccatctaaagat

SEQ ID NO: 41012 - DNA, 171 bp, Glycine max
  Peptide Sequence Number=SeqID_132697
atggaaggctttggttgcttcaaatccaatggtgctcctaggatggttgatgtaatcctccctaggaagggaccagtcaccagagccatgagcaagaagctccaaaaggattatgctagagttgctgaagaaagccctaggattcttatgaaccttagggtagatttctga

SEQ ID NO: 41013 - DNA, 351 bp, Glycine max
  Peptide Sequence Number=SeqID_132698
atggatgaactcttaatggatttgcaagattcctttgaggagcaggcgacacagggatccttcgtcccccatggacgtcaggatgttctcaccgctgctattggacctccagagcaccctggacatgtccgtgctgctggagccggtgtcaccatcaagcaatactttggatcggctccacggatgtcccgtagctcttcctccctgcctcctgaagaattgcagcagctaacccaacaaatcagggaccaactagtggagtccatcacagaaagagtgacgcggcaattcatggcatccttcagccagatgcagtcccagatgcaatctcagggacttgcactgccttag

SEQ ID NO: 41014 - DNA, 81 bp, Glycine max
  Peptide Sequence Number=SeqID_132699
atggaagcctctggtaatcgattaccagcctgtgtaatcgattacacagaggaatgggtcactgatcgtgatggcggctga

SEQ ID NO: 41015 - DNA, 321 bp, Glycine max
  Peptide Sequence Number=SeqID_132700
atgtctcttatagaagtcatgactcttgcaagagtttatgtgaagaacatagagactattattgagggcaccatagatcacatactaaacatcgttccaaaagaagagaaaaggatagaaggcctcaagagattaacattagcctcctatatttccatggaaaagataatgtttaacaactctttgcttgcaatcatattgccaaagagagaaaagttctattggctacccttagctttcaagggtatgccctctattggtggacttccgttgttagggaacgaaggattcatgggatccttcagtagagtattggaataa

SEQ ID NO: 41016 - DNA, 141 bp, Glycine max
  Peptide Sequence Number=SeqID_132701
atgtgttctaaaagttggttatggaattcagagaatgcaggttctagatcaattgaagaatcaacttttactgatgagattgaatccaatgatgaaggtggatctttggtcagtaacattactcaatgtttgcaagattag

SEQ ID NO: 41017 - DNA, 789 bp, Glycine max
  Peptide Sequence Number=SeqID_132702
atgagggagtccttttctcatgtgggagggtacccaaacattccgctgataggaacgaggggttgtattaactacaatcctgcgctcgttataagacagctagggtaccccatgaggggagcaccgatggaagaaagcatgtctcctttccttgtgagggatttcggcgcgcaaaatttcaaggctatacaaagaatccataaggcatggggcattcgtaatggcatcattggtggttaccatgaatggctgaaagttcatatacgaggtttagattggctcgccaagttaaaagtcgttagcgaagagagttttgaagcaccggaagaggacgaagaagtccaagctctcaaaagcgagttaggaaaggcgaaacttgccaaggagaagttcaagttggcagctacacacatccggaaggagtgtgccagattacgggaagagaatgcaactaccgcaagagcccttgaacaagaggccaagagggctcgcaaggaagagtatggccgtaacaaatttcgcggagctctgtggggtagcaacaatgaactcaagctgcgaagggaagagagggaccagtcgcgagcacatagcatggtcttgaaagaggagttagttgcctgttcaaggtccaaaaggagcttgtctcagcgtttatgcgagacggagaccaacatgctagttatcatcgccaagtaccaagaagagttaggtctagccacggcccacgagcatagggtcgcggacgagtatgcccaagtatacgcggaaaaaaaggctagaggaagg

SEQ ID NO: 41018 - DNA, 129 bp, Glycine max
  Peptide Sequence Number=SeqID_132703
atggataagagcttgaagataggagaaaatgagtggagggagaaggagagaaggagcacgaaattttatgccccaaatgagcccactagtccaagatcaagttcaagattctccactaagtgtgcttag

SEQ ID NO: 41019 - DNA, 495 bp, Glycine max
  Peptide Sequence Number=SeqID_132704
atggctccgaagaaactctccacgaagaggtgtagaagagacgccacaagagatgggtccagtaccaccccagagtttgatagtcatcgtttccggagtgccgagcaccagcagcgcttcgaggccatcaggggatggtcgttccacagggagaggcgtgtccagctcagggaggatgagtatacggactttcaggaggagatagctcgcagacgttggacaccgctggtgactcccatggccaaatttgaccctgagatagtcctagagttctatgctaatgcttggcccatggaggagggagttcgagacatgcgttcgtgggtgggggggaggtgggtgcggatcatgcgcaccagcaagaccactttgacccagacatggatgacactgctgctcaacaacgtcttgcctagcgatcataactctaatctccctctacctaagtgccagttggtgtatggcgcccaccaggcaccttgtggacccagataa

SEQ ID NO: 41020 - DNA, 246 bp, Glycine max
  Peptide Sequence Number=SeqID_132705
atgagactttttcgcaatctcggccgggaagaccctgatatcttcggggaaggtgctagtgatgacacatctctgggagaggtgctggtgacaacattagtcactgcatgctatcgggctttgagtctcacggatagcaaatgcgatttttcgcagtctcggtcagaacacactaatatctccgggaaaggtgttggtgacggcgttagtcactacatgctttcgggctttgagtgttacggatag

SEQ ID NO: 41021 - DNA, 304 bp, Glycine max
  Peptide Sequence Number=SeqID_132706
gtcgactctagaggatcccttggaattagcacaattcgcagaattagaagcttttgcccaattcgcttctgatctcgataaagctactcaaaatcaattagcaagaggtcaacgattgcgcgagttgcttaaacaatcccaatcagctcctcttaccgtggaagaacagataataactatttatactggaacgaatggttatcttgattcattagaaattggacagacattcactggggaagcagaagtccttttgaaggaagctattcaagaacagatggaactctttttactacaggaacag

SEQ ID NO: 41022 - DNA, 186 bp, Glycine max
  Peptide Sequence Number=SeqID_132707
atggacctagtactttgcttacctttggctttggacttggttgcctattggtcggccatgtgtcgtaggcaacgccctaacctttttatggatgagctgagcccgtctgggggcgcagtacttcttgatgaaagcccggttaatgcggggcctaatgaccttgttggggcaatgggcactccgtag

SEQ ID NO: 41023 - DNA, 756 bp, Glycine max
  Peptide Sequence Number=SeqID_132708
atggcttcctcaccaaaagaaacttccgctcctggttcacccgctgtaccatcatctccgcaccaggaacaaccagagttcaacatccaacccatacaaataattcctggtcaagcttcagtccctgagaaactggttcccagaagacaacagggagtgaagattgctgaaaaccctagctctgcaacaagttctagggaagtagacacggagatggacaagaaaatccgcagtattgtgagtagcattctgaaagatgcttctgtgcctgatgctgagaaagatgttccaacatcttccaccccaagtgtttccgtgcctgatgctgagaaagatgttccaacatcctccgctccaaatgctgaagccctcccttcacccagtgaagaggaatcaacagaagaagaggatcaagcctcagaggagactcctgcaccacgggcaccagaaactgctccaggtgacctcattgacctggaagaagtcgaatctgatgaagaacccattgccaacaggttggcacctggcattgcggaaagacttcaaaacagaaagggaaaaaccccccttaagaggtctggacgaatcaagactatggcacagaagaagattactccaatcactcctgccacatccagaagaagcaaggttgctatcccctccaagaagaggaaagaagtttcctcatctgattctgatgatgatgtcgaactagatgtctcgacatcaaagagggccaagacatcaggaagaaag

SEQ ID NO: 41024 - DNA, 561 bp, Glycine max
  Peptide Sequence Number=SeqID_132709
atggatgaccatgatgacattgacatcttggcctctagcacaataggagaaatgttaccgccttgctccgtagggcgtaaaaaccaatctattgcatggaatcactttgataaattgccagacccaaatcctttatcccaagctaaatgtcgacattgtggttctttgatcaaatatagtagtggaacaattaccatgcacattcatttagacagatgcaagaagaaatcagacatcatgagcaagaggcaaaaattagattcttcttcaacgaccattactccttcttcctcttccatgattgagcaagaagcatgttggatcgcactggtcaaattgtttgtggaattggagctctcattccgtatgattgagaatgaagcctttcatgaattttttagcattgtagcaccttttcttgttgtcatctcatgcactaccttggcacaggatgttctttgtctttggagtagtgaaaaaatgttacaaaagaaagtgataaatttttgtcaagtcaaaagtcacacgaggaagaatttggctaggatgcttgagagttga

SEQ ID NO: 41025 - DNA, 255 bp, Glycine max
  Peptide Sequence Number=SeqID_132710
atggtagccataacccctgctaggtttcctcaatctccattttttcgaggatacgactcgaacgtaatgtgtgcttgtcacggagaagccctggggcgttccattgagcattgtagggctctaaagcataaggtgcaagaatgcgggtgcaagccattggtctgtttgctcaagcgacctgtgctcctgagtttggacttccaagaccgttcaatcagagattactcgccttgcacgttggtgggggtgccgtaa

SEQ ID NO: 41026 - DNA, 756 bp, Glycine max
  Peptide Sequence Number=SeqID_132711
atggctacctcaccaaaagatacttcagctcctggttcaccagctgtaccatcatctccgcaccaggaacaacctgaattcaacatccaacccatacaaatgattcctggtcaagctcctgtccctgagaaactggttcccaaaagacaacagggagtgaagatttctgaaaaccctagccctgctacaagccctagggaagtagacccggagatggataagaagatccgcagtattgtgagtaacattctgaaaaatgcttctgtgcctgatgctgatgaagatgttccaacatcctccaccccgaatatttctgtgcctgatgttgataaagatgttccaacatcttccactccgaatgctgaagccctcccttcacccagtgaagaggaatcaacagaagaagaagatcaagccacagaagagacccctgcatcaagggcaccagaacctgctccaggtgacctcattgaccttgaagaagtagaatctgatgaggaacccattgccaacaggttggcacctggcattgcagaaaggttacaaagcagaaaagggaaaagccccgttaagaggtctggacgaatcaaaactatggcacagaagaagagcactccaatcactcctaccagatccagatggagcaaagttgcaatcccttccaagaagaggaaagaaatttcctcatctgattctgatgatgatgtcgaactagatgtctcgacatcaaagagggccaagaaatcagggaaaaag

SEQ ID NO: 41027 - DNA, 258 bp, Glycine max
  Peptide Sequence Number=SeqID_132712
atgtcttggggtaaacacggtgcccgacaaaggagaacactggggcacaacagcaactcccatttgggatacaaccgggcggcttacccttatggattaccgcctaattacacgccgcctgtcatgcatgatgatgcgggtcatgcctcttcccccatccttgaaggggagcctcctcgacagcccgacaaggcccacgaagatcaccaagagtatgcccaaaaggatgtcgatttctaccccccgatccccatctag

SEQ ID NO: 41028 - DNA, 404 bp, Glycine max
  Peptide Sequence Number=SeqID_132713
atggttgctgaaagctcagaagaatccaaatctaagaagcctatcgatactgaatttgatgaagacgttgaggaatacaaagggcaaaatagcttaaataagcagctatcgaatacctccaaagaggctaagtctgataacaacggaatttactgtgggatccccgggtaccgagctcgaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagctgaatggcgaatggcgcctgatgcggtattttctccttacgcatctgtgcg

SEQ ID NO: 41029 - DNA, 124 bp, Glycine max
  Peptide Sequence Number=SeqID_132714
atggatgccttagaaatttacttgaatgaagaagaaagacaattagatagaaaggtgaaagttgttaggtctgatagaagtgatgagtattacaaaagatacgatgaaattggacaacacccag

SEQ ID NO: 41030 - DNA, 369 bp, Glycine max
  Peptide Sequence Number=SeqID_132715
atgactagtcctcgatccatggcatattcaattatacagagcaagcatccaagagcaatgagagaaatagtggcatggtttgatcatgaacaaggggttttaattagacacaagtgcatggatgagatggacagaataggatgtttatccaatgagaggccatacgggtgtgatatatccaaagtgttgataagattgcgagccaaatgcctaacatgcatgggttacttttttctacgaagacatgggaataaatccatggtgagggccagtggctggttgtatgtatgcatacataataataccatgatagaacagaacaggctggagatggtcacgagcagacactggttaattgaggagtcatag

SEQ ID NO: 41031 - DNA, 1749 bp, Glycine max
  Peptide Sequence Number=SeqID_132716
atgtctattcgtacaaatcccatgaaagcagtgcctacactgttgaagcggctgagcaccatagaaggacaagcgaatttggacgatttgaagcccgagttgatgaacataaaagacgtatttttgttagtgaagcaaaacaaagaagaactccttgacacattagcggccgtggatggctatcttcgcaactccaacatgcgtaagttgatggaagagaaagaagacatttgcaggagactaaggacttcatttcaaaagttgcttccagctgatgctgctgctgttccaagtggcgatacagaagctgtgcactcatcatcaatcaaaccatttcaatatgggaggaagaggaaagaagtcatgaacagagtacactcttttagccaacttcaggacattgaaaagttcaaggtacattcccataaccttgatcatcttcataaaaaacgcggcttattgtctctcttgctttttcctgaaaaaactgtcataaagaaaagggatataattacatggtggatgggactgggtgacattctgggagaaggagatggtgaggatgtgtttgttgagcttttgcattgtaacctaattgtaccacaccatcaaggaaattgcccccatgtgaataaatttcaagttaatccatgggtccgtaaaaacttgatgccattgttacaaaaagataaaaaacaactttttggaatttattcacaaataaaaacctcatcatctcatcacaatgatactttgtatggaagtttaacactcgacaaacgagaagttaaactatgtgatgagtttggttttaagtctaaccattggaaagctgtttttaatgttaatgcgagttatcttaaatttggactccaatggatggccaaaatgaagtatttggaggtgcttcatcttggccgttggccgcaacattcagcttcacatcatattgaagtggagaatgaagaattcctgaaggagttggagggtcagaagtgtttgaagtatcttagccttcgtgggatatcaagaatatctgagctaccaccctccatttttcaacttgagagcctagaaaccctagatctcaaggcctgtcacaatctagaaacactacctaatgatattgcatcgctgagaaatctcagacgtttggatttatctcaatgttacttgttggataggatgccaaagggtattgagaagctgacagagcttcgggtacttaagggatttgtaataggtagttctagcaagaatccttccacaatatcagatcttgcaaatttgaaaaaactagagcaactcagcatacatataggaagtggggcagtgattcaagatggggagtttgaaagcttaaaagagttgtcagctcttgagcatctcaaaatatcatggggtgtgtctgacataaggtatagtgatatgcaaatcattttgccttcaaatttggaaaagttgcatcttgaaggctttcctggagaaaatattccagaatggttgaaacctgacaagctacccttcttgttgaaagagctaaatataacgggagggaaactaaaaagcatggatcatggagaaatttatgacaaggaccggtacccctggttgaagatcatacgtctcaagtacctaaagcatttgaatgttcaccttacaaatttgcgagagatgtttccttcgttatggtatgttgacataaaacatgttccaaactccccatcctgggaagggagcattgaatga

SEQ ID NO: 41032 - DNA, 114 bp, Glycine max
  Peptide Sequence Number=SeqID_132717
atggaaaatggtagagataataagagagggaagggaagggaaggaagtgaaagatcagaagatggagaaaattggacggatctgttcggcgatgtcgacgcggtcaagcattag

SEQ ID NO: 41033 - DNA, 243 bp, Glycine max
  Peptide Sequence Number=SeqID_132718
atgacaaattgcataataaattttaaagaaactcagtcagatgcaatcctccctaggaagggactagtcgctagagcaataagcaagaggctccaagagaattgggctagagctgttgaagaaggccctaaggctctcatgaacctcaggctgccattcgtcttccaagaagtaaatgaatccattgatgaagaagattctagacctacaagctccaatggagctacatcacaacctctctag

SEQ ID NO: 41034 - DNA, 1401 bp, Glycine max
  Peptide Sequence Number=SeqID_132719
atgagactgagaagtaatacacttagcaagaagcttcttcctccttcttcttcttcttcttctgtttcctattatgctgtctcacgcattgcgcttctttgcttttgcgtttaccttttctgtctctcctttacttcacctacgccaaatcagcttccacattccctctccatcaccaaccactcttctcttgagcttcattccatctcctcctccaaccaatcttctcttgccacttctacggagcttcctcgttccatcttcatcactaaccattcttctcttttcgcttctccacctccaccaccagtttatgtctatgaggagccatgcgactacaccaatggcagatgggtccgtaccaaaggaggccctcaatataatgctaccaactgtgttaagatgaaaagaaatcaaaattgtatagccaatggaagacctgatttggggtaccttaattggaaatggaaaccaagagaatgcaatcttccaaggtttgaccctaatacttttctccaactcattagcaacaagcatgtagcttttgttggggactctgtgtccagaaaccacctagagtcccttctttgcttgttaaccaccgtcacaaaaccgaaccgggttcgccacccaggttctcgtcggtggcgctttccttctcacaacgctgtcttgtccttctattggtccccatttcttgtccaaggtgttcaaagaaaactccgaggaccacctcgttataacacaattcatttggatcgtgttaatatgaggtgggagaaggatttagatgaaatggacatgattgtgttgtcccttgggcattggtttactgttccttcagttttctacgagggaggtaaagttataggatgcgtgcaccgtcctgtttctagttgcaagagagacattggtttttatggtccattaagaagggctttgaggactgctcttaatagcataattcagaggaagatgagaaacagaaatggagttgatgtaattgtgagaacatactcgccttctcattttgaaggtgcttgggataaagggggaacttgttcaaagaccatgccttatggagtggggcagaggaaagttgaagggatgaatgctgagatcagaaggattcagatggaagaattggaaagggctaaggcaaaagccaagaaatttagaaggtttaagtttgaggtacttgatgtaacaaaattagcattgttaagaccagatggccatcctggtgcttatatgaatccttttccatttgctaatggggttaatccaaagacgcctgtgcagaatgattgtgttcattggtgcttgccaggacctatagatacatggagtgagatctttctccagatgttgaaaaacatggcacgagcagccaagaagtga

SEQ ID NO: 41035 - DNA, 1371 bp, Glycine max
  Peptide Sequence Number=SeqID_132720
atgagaagtaagagatttaccaatcttcttcattcttcttcttcttcttctgttttctatgctctcccacccattgttctgcttggcttttgcgtttacttttactatctctcctttacttcatctccagaaaataatattctccgttccatctccatttccgtctccatcaccaaccactcttctcttcccgctcctacgcctccagcaaatttcattgacaagagcaatgatttgaggcacaagatgtgctcaagccccatgttagagagagatgaaaaaagaaaaggagtttatgagaatccatgtgactactccaatggcaaatgggtccgtacaaaaagaggccctttgtacaatggaaccacctgtgttaagatgaaaaaaaatcaaaactgcatcgccaatggaaggcctgattcggggttcctttattggaaatggaaaccaagtgaatgccatcttccaaggtttgaccccaacacttttctccaattcataagtaacaaacatgtagcttttgttggagactctatatcaaggaaccacctagagtcccttctttgcatgttagccaccgtcacaaaaccaaaccgtgtccgacaccaaggttctcgtcggtggcattttccttctcacaacgctatcttgtccttctattggtccccatttcttgtacaaggtatcccaagaaaaaacccgggaccacattataatacagtgtttttggatcgtgttaatttgaggtgggcaagggatatggatcaaatggacatgatcgtgttgtcctttgggcattggtttaatgttccttcagttttctacgagggtgatgataaagtcttaggatgccataaccatcctgttactaattgcactaccgagattggtttttatggtccaataagaagggctttaaggattgctcttaatagcataattgagaggaaggtaagtaaaggaaatggagttgatgtaattgtgagaacatactctccttctcattttgaaggtgattgggatacggggggtacttgtgcaaagactaatccttatggagtagggcagaggcaacttgaaggagaaaatgctgtaatcagaaggattcagttggaagaagtggaaaatgctaaggtgaaagcaaaacaatttagagggtttaggttggaggtacttgatgtaacaaaattagcattgttaagaccagatggccatcctggtgcttatatgaatcctttcccatttgctaatggggttaatccaaagaagcctgtgcagaatgattgtgttcattggtgcttgccggggcctatagacacatggagtgggatttttttggagatgatgaaaaacatggcacgagcagcatag

SEQ ID NO: 41036 - DNA, 1269 bp, Glycine max
  Peptide Sequence Number=SeqID_132721
atgaatagtaagagatttaccaatcttcttccttcttcttctgtttcctatgctctcccacccattgttcttcttgccttttgcattttcttttactatctctcagttacttcatcaccagaaaatcaccttccccattccatccccatcaccaaccactcttctcttactgctcctacgcctaggtctccagtttatgagaagccatgtgactactccgatggcaaatgggtccgtacaaaaagaggccctttgtataatggaacaacctgtgttaagatgaaaaaaaaccagaattgcatcgccaatggaaggcctgatctggggtaccttttctggagatggaaaccaagtgaatgccatcttccaaggtttgaacccaacatttttctccaactcattagcaacaagcatgtagcttttgttggtgactctgtgtgcaggaaccacatagagtcccttctttgcatgttagccaccgtcataaaaccgaaccgtgtccgccacgaaggttcccgtcggtggctcataccttctcacaacgcaatcttgtccttctattggtccccatttcttgtgcaaggtgttcaaagacaaatcaagggaccacactataatacaattcatttggatcgtgttaacattaggtgggaaaaggatttggatgaaatggacatgattgtgttgtcttttgggcattggtttatggctccttcagtttactacgagggtgaaaaagtcataggatgcttgaaccatcctgtttctaattgcaccaccgagattggtttttatggtccaataagaagagctttgagaactgctcttaatagcataattgagaggaaggttattaaaggaaatggagtggatgtaattttgagaacatacgcgccttctcattttgaaggtgattgggataagggaggtagttgtgcaaagactaagccttatggtgtttgggagagacaacttgaagggaaagatgctgagatcagaaggattgagttggaagaagtggaaaatgctaaggctaaagccaaaaactttagagggtttaggatggaggtaatggatgtaacaaaattagctttgttaagaccagatggtcatcctggtgcttatatgaatccttttccattcgctaatggggttccaaagcgtgtgcagagtgattgtgttcattggtgtttgccaggacctatagacacatggagtgagatttttctccagatgttggaaaacatggcacgagcagccaaggagtga

SEQ ID NO: 41037 - DNA, 804 bp, Glycine max
  Peptide Sequence Number=SeqID_132722
atggcgagatgggtgaatggtaggggaaatttactcccatttctgggtatggtgttggttatgctagctcaaagtggaagcatggtggttatcaaagttgccatgagtgatgggattaacaagtatgtcatggttgtctactctttggcactttccaccatcttgcttcttccctttgctttgtttcttcacaggagttcaggacagataatggcttacgttggcatagatctaagctcggctactcttgcatcagccatgcttaatctcattccagctttcacttttatacttgctctcatatttaggatggaagaagtacattggagacattctagcagccaagctaaggcttcggttgcacacaaattccctgctgtaacagtcatagtcttcttccaactcttattttcaaccattcagtgtgcagtatttgccttaattgctgttccagatccaacggaatgggagctcaagttcgatatcggcttgattggcattctatatcaggcaattgctgcaacattgatacgttacatcctttgcacgtggtgcgtccttaaagccggacctctgttttgttctatgttcaagcctgtgtcaatcatcttcaccgttttcatggctgcaatttttctcggggatgatttaagccttggaagtttgattggtgcggttataatcgtgataggattttatgctgtgttgtggggaaaatccatagaagagaacaagattgtgaaaggggttgagaacttggagtcatcgtgccacaatgttccattattacaaaatagaacgtaa

SEQ ID NO: 41038 - DNA, 354 bp, Glycine max
  Peptide Sequence Number=SeqID_132723
atggaaaatgtccaatacatgacatgggctgaacttttcaaaattcacgcacgatcccataggttttatcaagcacgttcaatgcttgttctcgaagaatccgacctcaagaaggcggctcagacctcgtcctccgccatggtggctcgtgactcggatgaatctcaagagatgtctgatcattcatcagtacgccacacaaataatgatggaaaacggtattcaaactatggcaattctagaaagaatcgcaacaacactggtggtcgtgataactcaaacgctggcaagggaggctctagtggcgggggtaaaggtggcggtggcagcaatcacgggggtgaacagcagtag

SEQ ID NO: 41039 - DNA, 1017 bp, Glycine max
  Peptide Sequence Number=SeqID_132724
atggtgggtgtaggagtgagtgtatccgcagcaatggttgcaactcttttcttggaagtgggattgaacactctaatcaaagcagcaaacaccaatggaatgagtaattttgttttcattgtctactcaaacttcttggctctcttcttccttataccctccaccttcctctaccacaggttagcttcctttcacaaactttcttgtcattccttgactcttaaaaaatcacaggaaaagagctcctcccccaattccaagctcaattctctggagaatttttcttctttgttgcctcagctgtgcagtactgcagtgcagacgttgacgtacactgggatcgcatatagctctcccacactaaactccgctatgtcggaccttgtccctgcttttaccttcatatttgccattatttccaggatggaaaatctgaatctgaaactgcgtagcagccatgcaaaaattattggcacagtgatctcgattgcaggggcattgataatcactttatacaaaggaatgccattgactggcagttctatgagaaacttagtattgggtggaagtgaagcttacctctcagtgcaattagattggataattggtggttttcttcttgcaacatctagcttgtgcctttcagttttgtttattgttcagacttggattatcaaggactatcctgaagagttagtggtaacaaccatttgttgcagcccggtggcaatatttgttgtatcaatgcggagtgttgtatacacatgggcaatgcgaaagaagggacccgtttatgtagctatgtttagccctttgggaatggtcattgcaattggaatgggggtaatatttctgggagagagtctgtatcttggaagtatgattggagctgctacaataggtattggattttatgctgtgatgtgggctcaggctcaagatgaaaaactggtaaatgagaagaatgaaaaccatgattttgtcacatcttcttcagctcctcttttgtctacctaa

SEQ ID NO: 41040 - DNA, 1158 bp, Glycine max
  Peptide Sequence Number=SeqID_132725
atggaagaacatctcactccattggctgttacccatctccttcaacacactctcagaagtttgtgcagccatgaaaattctcaatgggtctatgcagtcttctggaggatcttgcctagaaactaccctccacccaagtgggaaggacaaggggcttatgatagatcaagaggaaacagaaggaattggatattggtgtgggaagatggtttctgcaattttgctgcctcagcagctcctgaaattaactcaggtgattgttctaccccacctgcttatgggaactgtgaatttcagccctaccaagggcttcaaccggagctcttcttcaagatgtcacatgagatctataactatggagaagggttgataggaaaagtggctgcagatcacagccacaagtggatatacaaagagcctaatgatcaagaaatcaacttcttgacagcatggcacaattcagcagattcgcaccctaggacttgggaagcccagttcctgtctggtataaagaccatagctctcattgctgtaagagaaggtgttgttcaattaggagctgttcacaaggtgattgaagacctgagctatgtggtacttttgagaaaaaagttcagctacattgagagcatccctggtgtgctgttgccacacccttcatcttcagcatacccctacaaagtagaaggaggaggagggtatggagcactagaacaatggcagcatttccatggaattagcaacaaccaccaccaccaccacctttcatcatcaccccaacaagctgaactatatgatcaccatgcaggccacttcaacttgccactcaagataactccttcaatgagtagccttgaggcacttctctccaagctcccctcagtggtgccaccatcaacacaacaacaacaatcactcttgccatcacaaaggccattggagttcatgggaatgcagaaagtggcaaaggaagagttggaagaagaggtgtacagaccagaacttgacataggtgagagtagcagctccatgccagaagtagggtaccaccaccaacaccaacatcaacatcaacatcatcatcaacatcacttccatcaagttcagaataataataataataatgtaactaggagtggagccaacaatggattttga

SEQ ID NO: 41041 - DNA, 1521 bp, Glycine max
  Peptide Sequence Number=SeqID_132726
atggcaaagctccattttgcgttcagtttctcacttttgtttctactcagcaatgcctcagctgcaccatccaccactttacccgccaagattgttagtgggtttctctcaaatgccgttcctgcgttcaccaaatgggtctggtcactcaaagcacccaccaaaaccgcgattggtgcgaagtcgatgatgaagttcgagagtgggtacactgtggaaactgtgtttgatggaagcaagcttggaattgagccttatgcagttgaggtgttggccaatggggagcttcttattctggattcggctaatagtaacatttataggatttcgtcctcgctttctttgaataccagaccaaagctggtggcaggatctgctgaaggatattctggacatgttgatggaaggcttagggaggccaggatgaatcacccaaaggggatagcggttgataaccgaggaaatatctatattgcagatataatgaatatggcaattaggaaaattagggtcacaacaattgctggcggaaaatggagccggggagggggccatattgatggtccaagtgaagaagctaaattttctaatgattttgatgtggtttatattggaagtagttgttccctacttgtcatagacagggggaaccaagccatcagggagatccaactacactttgatgattgtgcttatcaatacgaaaatggacttacacttggaattgcaatgcttgttggggctggcttctttggctatatgcttgcattattacagcatagacttggtacaattgtagcatctcaggatcttgagggtgcagcaatgtctggcatttcaccaagtccatatcaaaagcccttgaagtctgtcaggcctcctttaattccatcagaagatgagtcggataagcaagaagaaagtttcattcgatccattgggaagcttcttaccaatgctggggcatcagttgtggaaataatgggagcgttatttcctggtttcagaaaaaaaccacagagctatgaatttcaaagccaaccgctgttccagcaacctcaaaagcaagtaaacgcttggcctgtgcaagaaagttttgtgattccagatgaagatgagcctccttcaattgaccctagatccccaacaccacggaaaacgtatgctttcatgtcccaggatgcagaaaagatgccacaactttggcaaagccatgcattctatagtggatggggcggagatcttcagcagcagcaacaactaaaacttcaacagcagcagcagcagcaacagcaacaacaactaaaacatcatcgccatctatatcattcatcagtccctcacacatactatgagcaaagccatgaggaaatcaatgagatagtatttggggcagtgcaagagcaggaagggaagaaggaaactgtagttatcaagcctgtggattatggtcaatctctctatgatcatcactatattcgacctcgaaacagttctatgggtcatatcaacaagtactaa

SEQ ID NO: 41042 - DNA, 2076 bp, Glycine max
  Peptide Sequence Number=SeqID_132727
atgatccgaaacacaaacaggtcggatcgccgggtactaacctccccggtggttcacccatgcgataacatcgctctctctacccttctcccttccctcatcactctctccaacgccatttccaatttccaacacagttccttcccttgcaacaagcgaaacgcgagaatcgcgattcgcttgacccggcttctccaacccttccttcacgagatccgagaccatcattcgggtcttgcagacccggcaaccctgagcctctcggagcttcatttaaccttccagaagcttcttttccttcttgaagatctcacacgtaaaggtgccaagctttacatgttaatggaatcggatcgagtcgcaactcagtttcgggtcatatccagatccgtggccacagctttggacgtttttcctttcggttctgtggagatctctgaggaaactaaagagcatgttttgttgctgaacgagcaagcaaggagggcaaggcttgaatttgagcaagaagataaacgggttgtggtgagtgttgtgtcgggtttgacccgatttgagaaccgggttcccccgggtgagggtgatttgaagtgggttcttgagtatattggggttaaaaagtggagtgagtgcaacaaagaggttaagtttttggagggtgaaattgggtttgagtgcttgaagaatgaggagaaggggaagatggtttttttgagtagtttgatggggttcatgagttattgtagatgtgtggtgatggaggatgttgattgtgaagagagtaacaaaaaaattaatgtaagagaaagtagtgttgagagtgaggtgagtctgagtttgacttttcttaactcggatgattttagatgtccaatctctttggagttgatgagtgatcctgtgactatagagacaggtcacacttatgatcgttcttcgattctgaagtggtttagtagtgggaatttgatgtgtcccaagacgggtaaaaggcttagcagcactgaaatggttccaaatttggtgcttagaaggttgattcaacaacattgctatacgaatggcataagcattccctttgttgattcgagtcataggaatcgtaaaattactaggacagaggagccagggagtgtggcagcagagggagcaatgagaatgttggctagttttctgaatggaatgattgagaatggaagtggagaagagaagaatagaggtgcttttgagataaggcttctttccaagacaagcatttttagtagatcttgtttggtggaagctggtttggctcctcttctgttgaagttgttgtcatcgagcgattcgttgactcaagagaatgctgctgcagcccttctcaacctctcaaaatgtgcaaagagtagaagtgtgatggttgagaaatggggtttggaattgatcattgatgtcttaaggaaggggctgaagattgaagctagccagcatgttgctgctgtgttgttttaccttagtgccgagtatggaaacttgataggtgaagagccagaagcaataccatcattgataaggctaatcaaagatggctcttatcgaagcaagaaaaatgggttggttgcaattttcggccttcttaagcacccggaaaaccataggagggtgctagaaggtggagcaatttcttcgctagttgacatcttaaaagggtgtgaaaaggaagaccttatcacagactcgctcgcaattctagcaactctggcagagaggagtgaggggatgttagcaatccttcacggagaggctttgcatgtagctgttgaaattttgagttgttctacttcaagggtgggaaaggagcactgtgtggctttgttgctttctttgtcactacatggtggagaagatgtggttgcttatttagtgaagagaacttctctaatgggatctttgtattcccaactcagtgaaggcacatcgagagcaagcaagaaagccagtgctctcatcagagtcctccatgatttttatgaaaggaggtcctctggtttcaaggcttcagttattccacaagaacagttcattcatgttcggtaa

SEQ ID NO: 41043 - DNA, 513 bp, Glycine max
  Peptide Sequence Number=SeqID_132728
atggcggatttcgcttcttcccccgcaaccctacccctcaatccccaaccctccgaatccgcaccagatccactcccccaatccgcaacaccaccctcatccacgcccatcgccacaaaccctaatcccaatccaacgcttcttcctccgccgcccgctctcctctttccggcgggcactccgccgcaggtccccggcgtactccctccctcattccgcccgctcgctccgcaattctcccccgtcccctcgcccaacccggccttccaaagccctgccgttcctccgcccggcgtgaccggcgccgccgtggcagttccgccgccgcagatgcagcagatgctttcgtaccagattcaacccggtaatccggccctgcggcccttcgctccgatccccaacggttacgctgcagctccgaccataactcccgcgggggatgggtttgttttggaagagtgggttgtgttcggagagattgagaatttgagagagttcttaatggttggataa

SEQ ID NO: 41044 - DNA, 297 bp, Glycine max
  Peptide Sequence Number=SeqID_132729
atggttttcctcttcaacaagggtggatctcatccaaacaatgccttgaaagctgaatccttccactgcagcagccccaaaatatcatcaacccctcctgggtcaatggatacgatgacagagggagctactgtgatcctgcgtaacgccaaaattgacatgttcaaaggatcaatgaggcttgctgtggacaagtggggccgtgtggaactcacagaacctgctagtttcactgtgaaggaagataataacttgtctctcattgagtatgaactggtgaatgttgttgcggaatga

SEQ ID NO: 41045 - DNA, 1215 bp, Glycine max
  Peptide Sequence Number=SeqID_132730
atggcaacagaagaagcacccatccacggcgatatcttagaggccatattctcgcacgtgccactcatccaccttgtgcccgcctctcacgtgtcgaattcctggaagcgtgcggtgtcctcctccctcgcccacgtcagacccatcaagccgtggttaattgtcctcacccagagcctccgcgcctcgcacgtgacaaccctccacgcctacgacccccgctcgcacgtgtggctccaaatcaataactcaaaatactgtcacacctcccccgtgcgatcctcacactcgacgctcttctacacactcaccccatccgagttcgccttctccctcgacgcgctgcacctcaactggcaccacgcgccttccccgcgcgtgtggcgcaccgaccccgtggtggcgcgcgtggggacgtgcgtggtggtggccggcggtgcgtgcgagttcgaggacgatccgctcgcggtggagatgtacgacttaaagagccaatcctgggaggcgtgtccctccatgccggcgctgctgaaaggttcgacggcgtcgtcgtggctgtcggtggcgatcgccggagaaatcatgcacgtgaccgagaaacactccggcgtgacgtactcgttcgacactgtttcgaaaacgtggaaaggaccgtttaatttgaggcctcatgagagtgtttttcactgcgtcaccggaaccctaggagagaggttgatggtggcgggggtggtgtgggaagttgggaacgtgaaaggcgtgaagctgtgggaggttcgggtgggttcggggatggaggaagtgggtgagatgccgaaggagatggttcggaagttattcagtggttcggagttagattcggtggaggtgacgtggattggggattttgtttacgtaaggaacactttcgaaccggaggagctggtgttgtgcgaagtgttgaatcatttgaatggagttgggtgcgagtggcggagtgtacggaacgccgccgttagatgtggcgcgaggatgctgttttgcggtggcgatgtgtgcctggaggatctgcagcgggcggtgatgtcggagaatcccacattttccatagaacaagggcgatatgcacatgcacaggagcaaatcgccagtgagactggcgatataggtggaaggccaaaaggcaagttgcaactgtcattggcgagttcatggcaaatgtcattggcaacttag

SEQ ID NO: 41046 - DNA, 210 bp, Glycine max
  Peptide Sequence Number=SeqID_132731
atggcgggatgcgcttcaccggattacgcttggtacgctttcttgttcttcttcatattactcttcttcttcatattattgcactacattgctgttcttcttgttttatttctggactgtgctgtgattgttcttgttacgtggtttcttcccctacgagctactccgagctattacgtggtttttctaattggtttagttagaatgtga

SEQ ID NO: 41047 - DNA, 135 bp, Glycine max
  Peptide Sequence Number=SeqID_132732
atggctttatcgtgtacagaattcatcgtaattgagtcttttgtaacaagagaaggaaaatggtgggacaaagttcacgtgtggaacgacctggaagtatgtatatcatatccttccaaatctagcttttgttaa

SEQ ID NO: 41048 - DNA, 189 bp, Glycine max
  Peptide Sequence Number=SeqID_132733
atggatcctcaaggtgaacatataattgaagaacttctagcaatcctcataaattacatggaaaagatcaaattatcttctgaggatacaaacctgccagggatcacctatgaagcaatcttggaacagtttataggtgtggaagcagctgcatgcacaaagcagcataggcactggcatgtttattaa

SEQ ID NO: 41049 - DNA, 537 bp, Glycine max
  Peptide Sequence Number=SeqID_132734
atgctgcaacctgatacccaacaacttcagagtttgagggtggaaggatataaaggtgtcaattttccagaatggatgtcttttccttctctcaaatatttaacttatttaagtctagaggattgcaaaagctgtttccaacttccgacattggggaaactgccttctttgaaggagctaaggatagataacatgattaatgatttgtggattgtcagttgcaaagaggtggaaggtttgcatgaggctttacaacatattactaacctgaagaagttaagattagagtctcttccaaacctagaattcttgcctgattgcattggaaaccttcccttgcttcgccaattgcatatttggaactgtgacaagttgacatgtcttccaccaagcctaagtctccttagcagtctgaaagaattaatgatttggggttgccatcccgagttagagaaacgatgtgagaaagaaatgggagaggactggccaaaaatagctcacgttccctgtgttgaagtgatttcatggaggcagtga

SEQ ID NO: 41050 - DNA, 186 bp, Glycine max
  Peptide Sequence Number=SeqID_132735
atgagacatggaccaggattctgtttggtagggagcaaaaaattagggtataatcagaaaatggtaaattgcatacatgtgcgtaggcacaaactcacacttcgactctcaatggcttatggggttggcaaaggtgtggaagtcaagatggaggttattgggagcactgagaaagacatgtggtga

SEQ ID NO: 41051 - DNA, 549 bp, Glycine max
  Peptide Sequence Number=SeqID_132736
atggcgcctaccaggcaccctctggacccagataagtccaacagggccctaggatttcccgccttgatcacgggactctgccagtcgttcggcgtccccgtcacacctagcaaggtgattcggccgcccatcacccgagcttttattgagaagtactgcacacagagacaggtccagggtgatgcaccacaggccgcgggcgcgccgccacctcatcaggctggcccagccagattgtttgatacagagcagtatttgcggcatttggttcgccagcaggcggccaaccatcgggcacatgtacagactcatgattgtctgtatcagatgagtctcagcctgcagagtcagggctttacttcttttccgtgccatactccggaccagttcagggcagaggtcgcgtggcctggggattggcttgaggcccaggcaggagaggcaccagcaggggcaccagcagaggctcccgacgaggcagatgaggcccgcaaggatgaagagatgatcgatttacttgatttcttaggagggagcggtgccacatga

SEQ ID NO: 41052 - DNA, 297 bp, Glycine max
  Peptide Sequence Number=SeqID_132737
atgggtatgtctaactcatccaaacatggcaaaaaactaacaaaactacccatcatatctcccaaaaccccatacccacgaaaatcaaaggagaaagaagtccacccaaacctgaaatttcgaagtcccactcgtagacacgcccttcatgaccccgaaaatgctctcctttcgcgatttggagcagaaatgatggccaaaggttggagctttgttggggtttcaatggagaatggaggagaaagaaaaagcaacgtgaggaagagggagagagagcttctgaaaatgtggggctga

SEQ ID NO: 41053 - DNA, 240 bp, Glycine max
  Peptide Sequence Number=SeqID_132738
atgggttttcctttgccggcagtcatttacccagccaaaaatttatctgcattcgttattcactctcccttgaggagattctgtgtcctttacttcgggggaaaggatgaggattcttttcatgggccaaggttcaaagtagctcaaggttgtgtctcaacatggtcttctcatcgtgcgagtccgattttgatatctggggcaaaacaaattcgtgtcaaggtgtcggtctcgggttga

SEQ ID NO: 41054 - DNA, 588 bp, Glycine max
  Peptide Sequence Number=SeqID_132739
atggagagaagtatgatagatgctgccagtggtggagcccttggagacatgacccctgctgaagccagaaatttaattgaaaagatggctttaaactcccagcaatttagtgccaaaagtgatgctattgtcattagagaagtgcatgacgtagccacaaattcatcttcatcagccgagactaagaagcttgaaggtaaactagatgtcttggttaacctggtaacccaactggccatgaatcaaaaatatgcacctgtcgccagactctgtggtttatgctcctctaccaaccatcacaaagacctttgcccttctgtgcaacaatctgaagcaattgaacaacctgaagcttatgctgcaaacatctacaacagacctcctcaacctcagcaacaaaatcagccacaacagaacaattatgacctctccagcaacaggtacaatcccgggtggaggaatcatcccaaccttagatggtcgaatccttcacaacagcagcagcaacaacaacaactgccttattttcaaaatgttgttggcccaagcagaccatacgttcctccaccaatccagcaacaacaatag

SEQ ID NO: 41055 - DNA, 363 bp, Glycine max
  Peptide Sequence Number=SeqID_132740
atggaacttatgagactccatcaacatgaagagaatgatataaagagaaaaggaatagcactcagagccacatcatcttttattcaaaaagaaagtgacaaagaggacttgactgaaacagaagaagatgataatgatttcaaactctttgtgaaaaggttcaataaacttttgagaaacaaaagaaataaaaggaaatcaaacatcaatacaaagaagaaagaagtagactcctccttagtcccatcatgctatgaaagtaatcaacctgggcacatgagatctgattatcttgtctttgaaagaagaattgaaaaatccgacaagaggaatctcaaagaaaagaaagaaaagaaaacatag

SEQ ID NO: 41056 - DNA, 249 bp, Glycine max
  Peptide Sequence Number=SeqID_132741
atggctgaagagccaagaagagtaaccctggaggattattcaagttctactgtgccacaatttttcactagtatcacacagccagaagttcaagctcagacaattacatatccaccttctttgatacaactaattcaaaataatctgtttcatggtctacccaatgaagacccttatgcccacttggccacctatatagagatatgcaatactgtcaggctggcgggtgtgctttggggatgcaatcag

SEQ ID NO: 41057 - DNA, 377 bp, Glycine max
  Peptide Sequence Number=SeqID_132742
acaaacggtcagcgaactacacgagaggcctcattcagtgcgccgcaagtatacccgcttgtatcagccattgcgtacagggaatgaggggcagaggttagcaggaacaggaaggcggcttgtccatttggtgtcgcttccgacggcagaccgtcccgacaaagacgttatcggagatggaggacaggaggccgttgaacagatagaagagcgtaagttgtgcgtttggtgcagcatgcagcacaaaggtaattatgggggcaaacagatgctggtcgataatcaccgccacgaccgcaaagaagaccgccagcagggcggtaaacggcagggcttcggtaaaggctttgccgatggcatgctcatccgttacgccg

SEQ ID NO: 41058 - DNA, 338 bp, Glycine max
  Peptide Sequence Number=SeqID_132743
atggatttattttggtttaatggttggttttgtttggatatttattgtgttactgatttggatattgattgccttgctctagttctttttgatgttgccaaagggggagagaacttaggcaagaacatgcgtgctatcatcttgtatatagcttgtcttgatttaaggtattgccatcatcaaaaagggggagattgtagacaaaggatcaagctgaaagttttgatgatgccaaaggattacatgaatcatatgcttctcaaagatttactcaagacaaagcaattagagatattcaagatggataatcaagacagtcttagaaaggatattaaata

SEQ ID NO: 41059 - DNA, 321 bp, Glycine max
  Peptide Sequence Number=SeqID_132744
atgactagaggcaatccatctgacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattctgattctgagcattctgattttgcacattctcagaacatggcacaacctccacctcgtgagaggactctaagggaaatggctgcacctgatttcacctatgaaagcttgtgcatccaataccctgatgaggat

SEQ ID NO: 41060 - DNA, 497 bp, Glycine max
  Peptide Sequence Number=SeqID_132745
gtatgccacccaccaggcaccctctagacccggataagtctaacagggccctggggtttccagtgttgatcacgggcctctgccagtcattcgaggttcccatcacacctagtaaggtgatccggccgccgatcacccgagccttcattgagaagtattgcatgcctaggcaggcccagggtgatgcgccacaggccacagacgcaccgctgccacctcatcaggctgatcccactgggtcattaggcatggagcggtatctacaacacttggttcgccaacaggcagccaaccaccgggggcagggccagggtttcgctccttttgcatgccctactccaaatcagtttagggctgaggtcgcatggcccggagattggcccgaggaccagacagaggaggcacctacaggagctcccgacgatgcagaggacgctcgcatggatgaggagatgacagacttgctcggcttcatgggaggaagcacagccacgtga

SEQ ID NO: 41061 - DNA, 237 bp, Glycine max
  Peptide Sequence Number=SeqID_132746
atgggtgatcaagaggagacacaggaacagatgaaagccgacatgtcggctttgaaagagaaaatggcttccatgatggaggccatgtcaggaatgagacaactcatggagaaaaacatggccaccgctgctgctgttagttcggctaccgaagcagacccaactctcctggctactgatatgaaccctcatggcacaagggctgacttaggatcgtctaggattaaaccttgctga

SEQ ID NO: 41062 - DNA, 306 bp, Glycine max
  Peptide Sequence Number=SeqID_132747
atgatattgcacgagattagaaggcccaactttctaaaaacagttcccagtggagtcgctaactgtcgcaacctacccttcggcgggagggcgacgcgggggctcgtgggtgcgtcttccatggaaggaaaatgtgcggagttgccaccaacgtttattcgaggaaaacgtcgaaaaaaccgaaaaaggtgtggtctacgaactttgagtgtgaaaggttcaggagttgtatttacgcacggggaagggtgtttcccttgctcctacgtattcctcaattgtgatgaggaaatcagacctacgtag

SEQ ID NO: 41063 - DNA, 201 bp, Glycine max
  Peptide Sequence Number=SeqID_132748
atgggtgatgagaaatccaatgacacggatcaagggaatgaacaagtcttacaagagataaatcataatgatttgatcagaccagaagccgatgatagtgatgatatcattgaagttacaatacctatggagaacattttaccacatgacaaggatgataattatatagatgatgatgagagcgatgcagacttcttttga

SEQ ID NO: 41064 - DNA, 261 bp, Glycine max
  Peptide Sequence Number=SeqID_132749
atgttcaagacgcgtctttggtatcatttcctaatttttgggcaaaaaacgttggtggcgaccgcgcgtattcctttcgtggaacacaatcgagtcgccctcccgccgaagggtaggttttgtaacgcttccgtaaatgtgggaaattcttcctctagatcgcctgcgtcttcaaccgttcttcatccgttcttcgttcgttcttcgttcttcaacggttttcttttcttcccttttgacgtgcttaagccatttatttaa

SEQ ID NO: 41065 - DNA, 450 bp, Glycine max
  Peptide Sequence Number=SeqID_132750
atggcagacaacatgtctggtacaaccactaccctcttgccagctcgacactcctacttcttcctcctgagtggtggcagacaacatgtctggtacaaccactaccctcatgctagctcgacactcctacttcttgctcctgttgcattgagtactctcttgatcttcatttataattgttcttatcaagttctagttactcgagaaaggagaaaggctaaatccagggaatctgctactagacaagtaagagaaattgtacaggctcgggaaaggtggaaaatagcaaaagatgttgctaagaaaggtagaaggggattgcaaggcgatgttagaacaactcttgtgattgaggtagcttttaaggatttaactcttacttttgaaagatttgtaagcaggcgctatgagaaggaaaatcacagggagttgactacctcctttttttaa

SEQ ID NO: 41066 - DNA, 405 bp, Glycine max
  Peptide Sequence Number=SeqID_132751
atgaaactgggcaacacccaggtccatttgctaaacttcttcataaacgtggtatttgtgcgtaatacgcaatgccagaaaagtcaaaaggggtatatgttttattatcctaatcatagtatgagaattgtcaaaactgaaaatgtaaggttcattgaaaatggtgaaatcagtgggagtaaagtttcacaagatgtggaaattaaagaagttagagtgcaagtccctctagcttgtgcctttagcaataaggtgattgctcctttagttattgttccaaacaataatgaagaagagcaacacaataatgagctcatgatacataatgaacctattgtggaagaaccacaagaagtagcattaaagaggtctcaaagacaaagggagacaactatttcgaaatga

SEQ ID NO: 41067 - DNA, 250 bp, Glycine max
  Peptide Sequence Number=SeqID_132752
gcccacttgggccctccaaaatattcctccagaaggctgttgcttctggaggaagcaacctggctcgcctgggcgagctgggcggcaaccacctcccctattttgctataaataggggaggaagtgaagaagaaaaggccgaggcgcttccgaaacgtttccgtaacgttttccgtgaggaatttcgcaaaggtttcaaccgttcttcgacgtcttcattcgttcttcatcgttcttcgatcttcaacgg

SEQ ID NO: 41068 - DNA, 303 bp, Glycine max
  Peptide Sequence Number=SeqID_132753
atggattatttggctgaggggtcaaagtttgttaaagagaagctttgcatacccagagggttaagaaccaaatcaggaccaatacaaaggaaggatagaacccttcgttactcaaaggaaccaagtttagcccatagagggaaagatggtccattttcaggtggagcattaatattgccaggaggcctaggaaccaaagatttgaggtcaacctctatcaagggtgaggggatgatgcaatcctccctagcaaagggaccacttattaccaaagccatgagcaagaggctccaagaggattag

SEQ ID NO: 41069 - DNA, 198 bp, Glycine max
  Peptide Sequence Number=SeqID_132754
ctgagcctcagcctgcagagccagggttttacttcttttccatgccctacttcggatcagtacagggcagaggtcgcatggcccggagattggcgtgaggcccaggcaggggaggctcccggcgaggcagatgaggcccgcgaggacgaggagatgaccgatttgcttaacttcttgggagggagcggagccacatga

SEQ ID NO: 41070 - DNA, 480 bp, Glycine max
  Peptide Sequence Number=SeqID_132755
atggtggtgacggttaaaaagctcgtagttggaccttgggttgggtcgatcggtccgcctccggtgtgcaccggtcggctcgtcccttctgccggcgatgcgctcctgtccttaactggccgggtcgtgcctccgcatgggataacaccacaggattctgatcctattgtgttggccttcgggatcggagtaatgattaacagggacagtcgggggcattcgtatttcatagtcagaggtgaaatttcttggatttatgaaagacgaacaactggcgaaaagcatttgccaaggatgttttcattaatcaagaacgaaagttgggggctcgaagaacgatcagataccgtcctagtctcaaccataaacgatgccgaccagggatcagcggatgttgcttttaggactccgctggcaccttatgagaaaatcaaagtctttgggttccggggggagtatggtcgcaaggctgaaacttaa

SEQ ID NO: 41071 - DNA, 252 bp, Glycine max
  Peptide Sequence Number=SeqID_132756
atgtgtaactgtcgcaacgtgcccttttgcgaccgagcgaaggcgaggctcacgggtgcgctttccaaaggaggaaagatacgcggattcgccaccaacgtttatttgtggaaaacgtcagaaaaaccgaaggaaccggtcaaaatgaaaattcaaagttcgggagttgtatttacgtatgaggaaggtcgacaaaagcggggctgttgctcctacgtaccctccattaaagaggaaatcagacctacgtag

SEQ ID NO: 41072 - DNA, 845 bp, Glycine max
  Peptide Sequence Number=SeqID_132757
atgggaacaaatcaaaccggcaagaggttctaccaagtcaaggttaaaagcctagataccaccagcgtcaaggaattagggcggttgatggaacctctccaaatgcaagccttccgcaagacttacggaaagatcttagagttgaccatagcagaggtgtccatagaagccattgcatcactcacccaatactacgaccagcctttgaggtgcttcacattcggagacttccaattagtaccaaccattgaagaatttgaggaaattctaggatgtcctctcggcaagaggtttgaccgcataaaacagactcgaaacggcatagcgggcctaccacggaggtacctagaagacaaggcaagggcgatcgacgctttccttgcctaccaccatagcaaggagagtccggtggtagctgtcttggcagatctatttggcacatttgaccgaagaatagattgggaccagctcttggccgggataggaggtagaacaatcagttggttcccccgatggaaggaaggaaaagaaggagtccttttctcatgtggaagatacccaaacattccgctggtaggaacgaggggttgtattaactacaatcccgcgctcgctataagacaactagggtaccccatgaggggagcaccgacggaagaaagcatgtctcctttccttgtgagggatttcggcgcacaaaattccaagactatacaaagaatccataaggcgtgggaaaccccgttaaagaaagatcaagagcttagaggcattcgtaatggcatcattggtgggtaccacgaatggctgaaagttcatatacgaggtttagattggctcgccaa

SEQ ID NO: 41073 - DNA, 333 bp, Glycine max
  Peptide Sequence Number=SeqID_132758
atgtcaggatttacacgcaattctcctcaaatttcagccagcccgcatcaattagaccttgcaccttacgcttcagagccctacaatgctcaatggaacgccccggggcttctccgtgacaagcacacgttgcgtttgagtcgtattctcggagaaatggaggtggtgttcgtcattggaagtgcggtagacagactttgtgggttgagtaatgacattgttgggttggtgggaaacttggccgtacaggaatggcagtcacagcatgggttctccctcatcgtcacctctttatttgccccagtttctcattcgtccaagcaggatgattaa

SEQ ID NO: 41074 - DNA, 789 bp, Glycine max
  Peptide Sequence Number=SeqID_132759
atccaaagtcttctcttacagactggccttcgcgctctttttcggcttgtgggttgggaggttcccctcatgattattctttgtgttctttcgggcctcgaatccgggtatacgttgcacatgatggatccagcaggaggtcagcctgctgccaatcctgcagcggagcaaccctcaaacgtgccttcaggcgcatcgacctcgggctggagaagtttcgaagaaggtgttttgttagaatcttcaaacgaatccagcgaagcgagcgtgaatcagcagcctgtgattcccgaacttgaacctccgcttctcgatgacaacacccggcgagcagagctcgctgttcgattgagggcgaattggtgggggatcgcttataacgagcgaatcctcgactccttcgtccggagtcaacttgcaatcgaaaggcacatagaggccgcacttgtggcggacggatattccccgcaagggcatgcgctgagtgaaaacgcttacgcggccggcaaaatgactacaggatcatcggtctactctacctcaattcaccatttcgaactttatacagaaggtttttccgtaccagctccttctacctataccgctgttgaagcacctaaaggagaatttggtgtctttctggtcagtaatggaagcaatcgtccctaccgtcgtaaaataagagcacctggctctgcccattcacaaggactcgattctatgtccaaacatcacatgccagcagatgtggtcaccatcataggtactcaagatattgtgtctggagag

SEQ ID NO: 41075 - DNA, 225 bp, Glycine max
  Peptide Sequence Number=SeqID_132760
atggctgggaaaggggttttcagtccttaccgtgttgaggaaaaaattaatgagtttcaagagcctctggatttgaggtcaaatccttttcaagggggagggaatgatgcaatcctacccccaagggcattggatagaagactccaagaagattggaccaaagatgtaagagaaggtcctagggttctcatgagccttagggtagatttcgggcccatggactaa

SEQ ID NO: 41076 - DNA, 878 bp, Glycine max
  Peptide Sequence Number=SeqID_132761
ggatcccgtttgatgcagatgctatcagccagttcctgggataccatttagtgctggaagagggtcaggagtgcgagtatggccagaggaggaaccggtccgatgggttcgatgaggaggccatcgcccatttgctatgtataccggggcaggattttgcccggactgctaccgggagacgggtgcggatcatgcgcaccaacatgaccaccctgactcagatctggatgactttgctgcttagcaacatccagcccagcgatcataattccgacctccccctgtcgaagtgtcagctggtgtacgccatcctgacacggatgagcattcacgtggctcagttaatcgctgatgccatctatttatttgcaggtatggcgcctaccaggcaccctctggacccggataagtccaacagggccctgggatttcccgccttgatcacaggactctgccagtcgttcagagtccccgtcgcacctagcaaggtgattcggccggccatcacccgagcttttattgagaagtattgcacacagagacaggcccagggggatgctccgcaggccgcagacgcgccgccacctcatcaggctggtccagctggatcgtttgatacggagcagtatttgcggcatttggttcgccagcaggcggccaaccaccgggctcatagccagggttttacttcttttccgtgccctactccggaccagttcagggcagaggtcgcatggcctggagattggcctgaggcccgggcaggagaggcaccaacagaggcaccagcagaggctcccgacgaggcagatgaggcccgcgaggacgaggagatgaccgatttacttgatttcttaggaggaagcggggccacatga

SEQ ID NO: 41077 - DNA, 279 bp, Glycine max
  Peptide Sequence Number=SeqID_132762
tggcttctgtttctatcagctgtccctccctgtcagctactgacggggttgcggtccccgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagtgttttcccagtcacgacgttgtaaaacgacggccagtgaattgtaa

SEQ ID NO: 41078 - DNA, 625 bp, Glycine max
  Peptide Sequence Number=SeqID_132763
gtatgcgttaaaccagattgttgttgagtttgacaatgtaagttatgttggtattagcaattgtcgttgtggatgtgtaatgagaactactcacggtcttccttgtgcatgcgagttagctagatatgttgtcggtagcatacctctcggcgtaatccatatgttttggcaaaagctaagtttttcataccaagggttatttgagcccaaagtcagcataaccgaagagatggaaaccatatccaagcggtttgaagagcttgatgtttgtggcaaagctactgtaaagagtaaattttggaaaattgcctaccctgatctaaactctatgtgtgctcctccagaaaagcaagcaaaactaagaaggaccatgccgatgttggatcaatttcatccatgcattcatgattccattgaaaacattgtcgatgtcaaaactgattgtaattgtgaaaatcatgcaattgctgccttattaggtatgggtgaagattcgttgtctttggttcacaaccatttgcttaaagaacttgcaaaatggtctgatgagtatatcaacctgctttgtggcatagatagatttgaggaattaaagcaatccctacttgttgatggattatccatg

SEQ ID NO: 41079 - DNA, 654 bp, Glycine max
  Peptide Sequence Number=SeqID_132764
atgcattctgaagctgaagcactagaacatatgaagaaaagacatacaggccatcaaagtgtgtcattggagaataagacaggagattcatctgtgctgaagataggagattcggctaaagttgtgacaaaacaagacatgaagggaggagagcataaatatgggtttaacaacaataaacatgagaagccaaagaaggtaagggtggtgaatgatgaaactggctacaaacatgagctgtttgaagtcctaaggatgccatctagatgtgtatttttcaaggtcttcatgtcattccttcatcattcaacgtctttcatgtcattccttccccgagagtttgaagatcatggcttctccacctgcctcccatcctcctcctcctcctgcaacttcgggccgcatcggcttagccgtcttccgttaagcggacacgcaaagtctcacgtttacgatcattgtctactagaccacctggtgctgagagaccagtggtccatgttgatcctgctaccgacaaggccgatggtccccacaggaaggaaattaagaacatatttggggattatggcgcgtgataaggtggacgtcacctacgagaatttggaagaggtccctattgctcagaaggacctgatttgggaggatattcag

SEQ ID NO: 41080 - DNA, 108 bp, Glycine max
  Peptide Sequence Number=SeqID_132765
atggatacctcagagccctacactggggcaatgaaaggcaccatgcatgagcctcaggcgaacctaggggcagggggagtgacaaaccctgggatttcagtggattga

SEQ ID NO: 41081 - DNA, 288 bp, Glycine max
  Peptide Sequence Number=SeqID_132766
acttatcaaggtaatccttgtggcgtctaccctgacttatcttccttcaccggaagcggcgtctacccagacttatcttccttcaccggaagtggcgtctacccagacttatcttccttcattggaagtggcgtctaccctgacttatcttccttcattggaagtggcgtctaccatgacttatcttccttcactggaagtggcgtcatccaaatctccgtagcctgtatcaaacgatccgctcctactcaggttcacatcatttggtatcagagcttcggctcttga

SEQ ID NO: 41082 - DNA, 891 bp, Glycine max
  Peptide Sequence Number=SeqID_132767
atggaagaaagcatgtctcctttccttgtgagggatttcggcgcacaaaatttcaaggctatacaaagaatccataaggcatgggaaaccccgttaaggaaagatcaagaacttaggggcattcgtaatggcatcattggtggttaccatgaatggctgaaagttcatatacgaggtttagattggctcgccaagttaaaagtcgtcagcgaagagagttttgaagcaccggaagaggacgaagaagtccaagctctcaaaagcgggcttggaaaggcgaaacttgccaaggagaagttcaagttggccgctacacacatccggaaggagtgtgccggattacaggaagagaatgcaactaccgcaagagcccttgaacaagaggccaagagggctcgcaaggaagagtatggccgtaacaaatttcgcggagctctgtggggtagcaacaatgaactcaagctgcgaagggaagagagggaccagtcgcgagcacatagcatggtcttgaaagaggagttagtcacctgttcaaggtccaaaaggagcttgtctcagcgtttatgcgagacggagaccaacatgctagctatcatcgccaagtaccaagaagagttaggtctagccacggcccacgagcatagggttgcggaagagtatgcccaagtatacgtggaaaaagaggctagaggaaagggtgatcgactctttacaccaagaggcaaccatgtggatggatcggtttgcccttaccttgaacgggagtcaagaacttccccgattgttagccaaggccaaggcgatggcggacacctactccgcccccgaagaaattcatgggcttctcgactattgtcagcatatgatagacctaatggcccacataattag

SEQ ID NO: 41083 - DNA, 210 bp, Glycine max
  Peptide Sequence Number=SeqID_132768
atgaccacgagcaagggcaaggatccacttaaaggacttggagggcctatgacaagggctagagcaaggaaagccaaggaagctcttcaacaagtgttgtccatactatttgaatacaagcccaagtttcaaggagaaaagtccaaggttgttagtgggtcattactaaaatctactgtaatgcttctatataagcgtgggatcctctag

SEQ ID NO: 41084 - DNA, 203 bp, Glycine max
  Peptide Sequence Number=SeqID_132769
gtgttgagggaaggagcccagagtatgaagaacctcgggatttgaggtctaatcctttccaagcttctcatctcaaggaggtgagcttagctattagagagcttctcaaggaagttttctcaaagaagcttctcaaggaagttttctcaaagaagcttctcaaggaagttttctcaagaaagcttctcaagaaagctacctag

SEQ ID NO: 41085 - DNA, 204 bp, Glycine max
  Peptide Sequence Number=SeqID_132770
atggaggcgaccgatgcacaatttgatttatttaaaatgctagatatggcaaaacaagttgcagagttatcaggagccattccagtagatttgttcactaactatcttgatcagtacgtcaatttactcaagactatgggcaaacttgttgagatcggcttctctgacgtgtcttcgaaagcagagattcttagaaaccaataa

SEQ ID NO: 41086 - DNA, 153 bp, Glycine max
  Peptide Sequence Number=SeqID_132771
atgacgagtttcaataagcccaacagattgaattgtttcaatatagcaataaaaacaaagcacaaacgggttatggcaaccctaactttgtcaggcaagattccgcgaatcgctacaaccaatagttgttgcattaagacatggaaatcatga

SEQ ID NO: 41087 - DNA, 499 bp, Glycine max
  Peptide Sequence Number=SeqID_132772
atgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctatcaagcttatcgataccgtcgacctcgagggggggcccg

SEQ ID NO: 41088 - DNA, 218 bp, Glycine max
  Peptide Sequence Number=SeqID_132773
ggtacatcctttggggtacaagtagagggtacatctacttgggtttgactgagaacaagagagggtacatctgttgtggatcagttctagtggagggtacatccactaggttcaaagagaacaagggaggggcattacaccccgaccccatgacaacacagttcatggcagactttctagcagaatttgctggaaatgaccataccaccctagactga

SEQ ID NO: 41089 - DNA, 279 bp, Glycine max
  Peptide Sequence Number=SeqID_132774
atgcgcagagacttacatcatcttctgcatcttttgtcatccggagacggcgagtccgatgacatacgggggtaccgtatggttttccccacctttcatcaaccaggggaaaacgagcccgtcgacatgcagagactaacatcaccttctgccccttttgtcatccagggacaacaagtcaggtggcaggcagagataccttatggtcatccacacctttcatcaaccgaggcaaacaaattcgacgatatcaggatgatgttggtcgtccgattctga

SEQ ID NO: 41090 - DNA, 758 bp, Glycine max
  Peptide Sequence Number=SeqID_132775
gggagcaccgacggaagaaagcatgtctcctttccttgtgagggatctcggcgcacaaagttccaagactatacaaagaatccataaggcctgggaaaccccgttaaggaaagatcaagagcttagaggcattcgtaatggcatcattggtgggtaccacgaatggctgaaagttgatatacgaggtttagattggctcgccaagttaaaagtcgtcagcgaagagagttttgaagcaccggaagaggacgaagaagtccaaactctcaaaagcgagttaggaaaggcaaaacttgccaaggagaagttcaagttggccgctacacacgttcggaaggagtgtgccgggttacgggaagagaatgcaattactgcaagagcccttgaacaagagaccaagagggctcgcaaggaagagtatggccggaacaaaattcgcggagctctatggggtagcaatagtgaactcaagttgcgaagggaagaaagagaccagtcgcgagcacatggcatggttctgaaagaggagttaattgcttgtttaaggtccaaaagaagcttgtctcagcgtttatgcgagacggagaccaacatgctagctatcatcgccaagtaccaagaagagcaaccatgtggatggatcggtttgctcttacctttgaacgggagtcaagaacttccccgattgttagccaaggccaaggcgatggcagacacctactccgcccccgaagagattcatgggcttctcggctatt

SEQ ID NO: 41091 - DNA, 613 bp, Glycine max
  Peptide Sequence Number=SeqID_132776
ggatatggctcaaggctgatagagttcggacaactcgaaacgatcctgaaggctgaaaagctgctgaaactctctatgcggagccccaagaaggaaaaggctgaggaggagttaattgatttcttgaacagatgcaaactcgaaaacaagattgtgatgctctgccctcgctgcagtgcaatatgtgataaggaggctactgagggcctcaagaaataccaagttgttaacaagggggcaaagcaggaccaacgtttcgataaaggaactactttcgctctcctggttcagttccggtcgaaaaatggatgcaccagggactctataaggttcaacaaagggattatggaagtaggtggttcgagtggaacgaagcaaattggccacaggaggttccagcgtcagaagaaattggcccagcagaacccgcaaatgggccaatataaagaagtatctaggaggccagtaaaggagagactcctgcctccagtggatgaagacaagatggaggatgaggatctactggattctgagccagatttcgatgtcatctgtgtggtatctatcttgccatctgaatatgatgtccaatctgaagttactgagatcgaaa

SEQ ID NO: 41092 - DNA, 153 bp, Glycine max
  Peptide Sequence Number=SeqID_132777
atgactaaagcacgtcaaaagggggtacagaaagaaaaggaaggagatgcttgccacccagcttgcccaggcgagctaggttgcttcctccagaagcaaccgccttctggaggaacatcctggaaggcccaagtgggtctggttgctatttga

SEQ ID NO: 41093 - DNA, 636 bp, Glycine max
  Peptide Sequence Number=SeqID_132778
atggagggggagcggttaataccgttgagtccgacaggccgcacaggtctaaaccttttagggacgtggcaacccctaggaggtttatctttgaggccctacaaaaaggagcggatgatagatcagggtcgactggaagttggcagtgaaggaagagaagagcagcatatatgcatgcagtccacggatgggagcagtgttgcgaagcccaaacccttggtgatatacttcaccaagggcgcggcttcgcaaaaaaccagacaccccttggcagctaaacctgtcccattcccataccaaaatagccactcagtcccatggagatatacacctccgacgaagaagaaagaagaagccaccaacgccagctcgttgtcagctaaggtaacaaatatcacgggactgagtggtgtgacccgtagcggtcatgtgtttgcacccccggacctaccagtccaacccgcgaacgtcaaggagaaagcaaaagtggtcgaggaacaagatgacgaagcacccctcgcttcgaataaagatattccagcgaaaggtctttcggagaaaaaggatggtaaaaaagaggtgtcgctagaggaagccagcgagttcctccgtataattcagcagagcgaattcaag

SEQ ID NO: 41094 - DNA, 156 bp, Glycine max
  Peptide Sequence Number=SeqID_132779
atgactctaagacaacatggattaagcctaggatcttcttcatcaatggattcctttgcttcttggaagatgaatggcagtggaatggagaaggaagagagagaggagatgccacttcaaggagaagatgagtctagaagaagctcaccaccatag

SEQ ID NO: 41095 - DNA, 429 bp, Glycine max
  Peptide Sequence Number=SeqID_132780
atgagtccttgtgctgtcccagtgattttggtccctaaaaaggatgggacatggcgcatgtgttccgattgtagagcccttaataacatgatgagaatcatgaaactggccaaatacaggctaaaggcccaagtggagaaggacgaaggcccaagtggagaaggacaaagcccccgagtggagaaggatgaaggcccaagtaatccttgtggcgtctacccagacttatcttccttcactggaagtggcgtctaccctgacttatcttccttcaccggaagtggcatctaccctgatttatcttccttcattggaagtggcgtctctgatgagaatcatgaaactggccaaatacaggctaaaggcccaagtggagaaggacgaaggcccaagtggagaaggacaaagcccccgagtggagaaggatga

SEQ ID NO: 41096 - DNA, 363 bp, Glycine max
  Peptide Sequence Number=SeqID_132781
atgttaggatttatacgcaattctcctcaaatttcagccagcccgcatcaattagaccttgcaccttacgattcagagccctacaatgctccatggaacgcctcggggcttctctgtgaccagcacacgttgcgttcgagtcgtattctcggagaaatggaggttgatgaaccttggctggggttatggctaccattgaattatcaagtagatatgggatcaagtttagcatatgacaacgaaatttggggtgaaccctacaggctttctcgctgcaaaattcatttcttgttggtgttcttttggtttgtgctaaaggtggtcttcgtcattggaagtgcggtagacaggctttgtggttga

SEQ ID NO: 41097 - DNA, 354 bp, Glycine max
  Peptide Sequence Number=SeqID_132782
atggtagccataaccccaaccaaggttcatcaacctccatttctcctagaatacgactcgaacacaatatgtgcttgtcacggagaagccccggggcattccattgagcattgtagggctctgaaggataaggtgcaaggtctaattgatgcgggatggctaaaatttgaggagaatattgatatctttgtccctcgtcctctcacaaacgcatctttgcttattcaactttcaccggaatgtgggtgcaagccattggtctgtttgctcaagcgacctgtgctcctgagtttggacttccaagaccgttcaatcagagattactcgtcttgcgcgttggtgggggtgccgtaa

SEQ ID NO: 41098 - DNA, 399 bp, Glycine max
  Peptide Sequence Number=SeqID_132783
atgtcatcaagtcaatcaatatcaatcaatacacaagcgttatgcaacatatacactaagactcaatcctatatgcaatgtcgtaccatgttaatgaaaacccacctcggacgcctaggagtacatgacaagacaaaccacgcactagcaagtcaagtcactctcactaggcttaaaggagcactcaaaccgggtgacccccaaggcctacaccccgaagagtcctttatctcgtcgcccttaaagggtcttagcattaactcgttgcccttaaaggaacttagcattaactcgtcgcccttaaagggacttaacatttactcgtctcccttaaagggacttagcattaactcgttgtccttaaagggtcttatagtcctgcgattgtacaattcatag

SEQ ID NO: 41099 - DNA, 264 bp, Glycine max
  Peptide Sequence Number=SeqID_132784
atggctcgcagagacaaaaattggtcattctacaccctttgtcatccagaggcggcgggcccgatgacacgcaggagacaaaatttggtcattccgcacccctttgccattcagacacagtcgtgtccgatggctcgcagagacaaaaattggtcattctgcaccctttgtcatccagaggcggcgggcccgatgacatgcggagatttacaaattatggtcattccgcacccctttgcttcagacacagtcgtgtcatactga

SEQ ID NO: 41100 - DNA, 579 bp, Glycine max
  Peptide Sequence Number=SeqID_132785
atggaaaatcctaaacaaaaaacaaaatcaaaaataacgtgctacaattgtggaaaacaaggccacatcagcaaatactgtaggctaaaaaggaagttaagaaatcttaacctagaacccgcaattgaagagcaaataaacaatttgctcatagaaacctcggaggaagaaacagaaacttcatcctccgtgctttccgatgaaaacctaaacttaatccaacaagatgaccaactatcatcaacagatgatgatgatgggcaaatcaatactctaacgagagaacaagatctcttgtttgaagcaatcaattccatacctgacccccaggaaaagaaggtttttctggaaaaactcaagaaaacattagaggtaaaacctagacaaaaggattttatcacaaacaacaaatttgatgtaagtaacatactcaagagattagaaaattcttcaaccaaaccaacgacaatccaagatctccaaacagagataaacaatctaaaaagagaagtaaaagaacttcgtcaacaacaagaaattcatcagatcattctttctcaacttgagggaagacagtga

SEQ ID NO: 41101 - DNA, 405 bp, Glycine max
  Peptide Sequence Number=SeqID_132786
atgaagaaagctagaaaggaagagtggagtagaaacaagttccgaggggctttgttaggcagcagtaatgagctcaaacttagaaaagtcgagaaagacaaatcaaggatggagaacgtaatgttaaaagatgagttaaggaattgtcaggagtcaaagggaagtttgaaagagcagttgagcaagatggaaaagaacatggtgataatcattgatcaatataaagagaaggtgaacctagctactggttgggggcaggtgctgagggatgaacagacaaaggcatcatctttgcaagttgaaagggaggcaagggaagaggtgatagagttattgcattggtctcactctaaatggaagtcaagagcttccaaggctgctagccagagccaagacggtggctga

SEQ ID NO: 41102 - DNA, 444 bp, Glycine max
  Peptide Sequence Number=SeqID_132787
atggctccgagaaagctttccgcaaagagatctaggaaggacgccgcggctgaagggactagtgctgctcccgagttcgacaaccatcgtttcaggagcactgagtaccagcagcatttcgaggccatcaagggatgggatgatgagtacacagatttccaggaagagatagctcaccgacgttggatgtcgctggtcactcccgtggccaagtttgatccagatgtagccctagagttttacgcccaatgctttgcccacggaggagggcgtgcgggacatgcggtcatgggaggccattgcctagctgttatgcatactgggtcaggattttgcccggaccgctgccgggagacgggtgcggatcatgcgcaccagcatgactaccttgacccagacgtggatgacgttgctgctcagcaacatcctgcccagcgattataa

SEQ ID NO: 41103 - DNA, 53 bp, Glycine max
  Peptide Sequence Number=SeqID_132788
tgaccttgttggatatccctggtgggggagatagagtggttaaagagttttaa

SEQ ID NO: 41104 - DNA, 75 bp, Glycine max
  Peptide Sequence Number=SeqID_132789
gaatttcgcaaaggttttcaaccgtactttcgacgttcttcattcgttcttcaatcgttcttcgatcttcaacgg

SEQ ID NO: 41105 - DNA, 696 bp, Glycine max
  Peptide Sequence Number=SeqID_132790
atggcctccaactcccagcagtttagcgccagaaatgatgccataatcattagaggagtgcatgaggtagctacaaacccatctgcatcatctgaaactaagaagcttgaaggcaaactggatgcgttggtcaacttggtaacccagttggccttgaatcagaaatctgtacctgtcgcaagggtttgtggtttgtgctcctctgctgaccaccatacagacctttgcccttccatgcagcaacctggagcaattgagcagtctgaagcttatgctgcaaatatttacaatagacctcctcaacctcagcagcaaaatcaaccacagcagagcaattatgacctttccagcaacaaatacaaccctggatggaggaatcaccctaacctcagatggtccagccctcagcaacaacaacagcagcctgctccttccttccaaaatgctgttggcccaagcagaccatacattcctccaccaatccaacaacagcaacaaccccagaaacagccaacagttgaggcccctccacaaccttccctcgaagaacttgtgaggcaaatgactatgcagaacatgcagtttcagcaagagaccaaagcctccattcagagcttaaccaatcagatgggacaattagctactcaattgaatcaacaacagtcccagaattctgacaagctgccttctcaagct

SEQ ID NO: 41106 - DNA, 303 bp, Glycine max
  Peptide Sequence Number=SeqID_132791
atggattcttttacgggtgcgggtgaagatggggacatggcggactatgtttgggctgaggtgcttgggcacccagtcattaggcaatttgtgaaaattccgggacatgccggaaaacaaaagaaaaatattgatgcacaatccgcacttctctctctttcgaatttgcttggaaaaattgtttccgtgaagaaaatccaagccgaggcgcttccgaatcgtttccgtgaggaatttcgcgaaggtttcgaccgttcttcgacgttcttcattcgttcttcatcgttcttcgatcttcaacga

SEQ ID NO: 41107 - DNA, 81 bp, Glycine max
  Peptide Sequence Number=SeqID_132792
atgaaggccaatatgacggccatgaaggagcaggtgacaacaatgatggaagcaatgatgagcatgaggaagatggtggag

SEQ ID NO: 41108 - DNA, 579 bp, Glycine max
  Peptide Sequence Number=SeqID_132793
atggataacgaagagggagtgcaagaacagatgaaggccgacctatcagccttaaaagatcaaatggcttctatcaaggaggccatgctaaagcttcaaaaaactatagaagataatgctacggcggtcgcttccaatacagctagggaagcggaaccggtgctacagcccgcaataaacttgggccaagatagaaacacgacgggtttcaatcggaggtatagtcctcaagcctacccttatggtttgcctccggacttcactccccgtactgctccaggcgatttgagccaagcccctaccttcgaggggcagctccctcctcatgccgactatcctctgcaagaagatgatgaaggagatgcccatttaggccctctacctcccctcaaggaaccagccccccatgagttgccccgacaaaacatagtccgccacgtcccatctccatccgcacccgttaaggaacttgttccctttgcaaaagacaagggaaagattgatctacttgaagagaggctgagagcggtggaaggcctcggcaactatccgttctcggatttagtggatctatgtctg

SEQ ID NO: 41109 - DNA, 222 bp, Glycine max
  Peptide Sequence Number=SeqID_132794
atggcgcctcaacgcctaactcacaaaaagtccccagtggagtcgccaactgtcgcaacatgcccttttatgggcgagcgaggcgaggctcacgggtgcgctttccaaaggaggaaagatacgtcgagtcgccaccaacatttatttgtggaaaactcagaaaaaccaaaggaaaccggtcaaaacaaaaattctaagttcgggagttgtatttacgtttga

SEQ ID NO: 41110 - DNA, 357 bp, Glycine max
  Peptide Sequence Number=SeqID_132795
atgagatgcttgccacccagctcgcccaggcgagctaggtttctttctccagaagcaaccgccttctggaggaacatcctggaaggcccaatgttgcggcaccttacggattatgtagtcatcccttttttgccttccggaacgttacgaaactttacggattgcgcactaacacttctttttaatttccgacatgtcacggaacttcacggattgtgctacaacgcttttcttttggcttccggcatgtctcagaacttcacaaaatgcctaacgatgggtgccaaatacctcgaagtggtcaaacaagggtcgcatcccaacaacggatggtccccgaatgaaattagggtatga

SEQ ID NO: 41111 - DNA, 847 bp, Glycine max
  Peptide Sequence Number=SeqID_132796
taccctcaccttcagagggctgcacgcccttaccttcaaaggactacacatcctcgccatcaaagggctacacgtcctcaccttcaaagggctacacgccctcaccttcagaggactacatgtcctcacctttagagggctgcatatcctcgccttcggagggctgcacgccccgcctttagagggctacgcttcttgggccacccctaatattggagggcgaccaactgtgcgagcacaaccagagagggaggctatcacgcaactactatgcatatcggggcaagatttcacccatgccactgcaaaaagacgagtttggatcatgcgcaccaatatgaccactcttacactgatatggatgacgttgctacttagcaacatttcatccagtggccacaatactgatctccccctgtggaggaatcgcacccacaaagacacccagtggacccggagaagtccaacagggccctggggtttccagctctggttacaggcctctgttagtcctacagggtgtccgttccccccagcaaggtcacgccatcatgacatagggatcgcgcctgcaagacacccagtggacccgaagaagtccaacagggtcttggggtttccagctctgattacgggcctctgtcagttctacagagtgcatgtcgcccctagcaaggcaggcgcagggcgagacaccacagtagcctggggatggccggcagcaggcaacagacgcactgttgccacctccaaagcccctcagctcatccacaaaaaagtccgtgaccgacaagtcatcaagcgtctagctcaagacgttaaagaagcgctactaggaggcaaccta

SEQ ID NO: 41112 - DNA, 390 bp, Glycine max
  Peptide Sequence Number=SeqID_132797
atggctcatggtcgtcaagcacttaccttcgataagattggtgccattttcagtaatgatcttcctagggagtccataccgacgaatcagctccctctttatgaatctgaccaccacgctcttcgtgacattggtgtaggaagccgcttcgacccatatggtgaaataatctatcgccacgagaatgaagcaatgaccgttcgaagccttgggttcgatggcccctatgacgtctatcccccacatggaaaaaggccaagaggcaggcatgacattcagaggatgtggtggagcatttacattgtccgcgaacacttggaatttatggaatttccttacatgggttcagaaatcgctttccatggtgagccagtaataacctgctcttag

SEQ ID NO: 41113 - DNA, 941 bp, Glycine max
  Peptide Sequence Number=SeqID_132798
atgggaggcgcatcgagggggcaccccggcgctggtggcgacgccgtcgtgcttacgcggggcgacatcatcatcaacgccctggtctccggcggccagggtggcacccgcgatctcaatctggccccccgcacgttctcgggagatggcggcgtcggcatctccctcggctcgggcacggtggtcaacaacaacgtcgtgctgggcggttttcccggcaccgtgcagtacccaaacaaaggaagtgtcggcaagagaggcaccgcgctacgagcgggcagcgatacgatcgtcaccaacaaaggcagcttcaacagcaacggcgcgactgccgttctcttcgaaggcgacaacaacacattcatcatgtggtcgggttccgacatcatcggtgacctgtatttcaagggcaaggacaaccagctggcctttggcagcgacgatggcgcgccgatcacccagtacatctggggcgatggggacctcgatttcggcatcgcaggcacctacaccgtgcgcgtcacgccaaccgccgccgaccggctcgatgtggccaagacggccaggctcaccggtgcggtgctgcgggtcaacgcgatggcgtcggacctgtatgcggaaacgcagcgctacaccatcctgcatgccggagagaaattcaacggcacgcgctttgccggcgtcacgtccaacctggcctatctcacgcccacgttgagctactcggacgacgaccaggacgccttcctgacgctggtgcgcaaagccgcccccgcccccgctcccgttcccgtaccccctgtgatcgagccggttcccccggcgacaaatccggctccgccggtgactgacccggtgccgcccacaaccgagcccacccctcctgtgactgacccggcgccgccgacaaccgagcccgttccccctgcctccgacccggc

SEQ ID NO: 41114 - DNA, 234 bp, Glycine max
  Peptide Sequence Number=SeqID_132799
atgatcagtcaatggaacaatagagctgagtttagggttgagggtgaagttccggagacattacagtatatggtgtcaccacaagggaggaacacatggacagttgatgatctcgtgccttatgtggagaagataacgattttatctgaaaagcaagagaggatcactgagcatgtggcacattgtccagcatcagagcatcgatttccctcacaacagtttcacatgctttag

SEQ ID NO: 41115 - DNA, 285 bp, Glycine max
  Peptide Sequence Number=SeqID_132800
ctctctctctccctcacgttgccattttcttcttcttcattctccattgaagctccaagcaaagcttcaacctttggccatcatttctgccccaaatcgcgaaaggagggcattttcggggtcgtgaagtgcgtggctatgagtgggacttcgaaaattcaggatttgatttgggcaagattggatgaggggaagtgtgattttcgaaatctgcacttgtcataccctaatttcgtccggggacctttgcttgatgacatgcgacctttctttggtccttgtgag

SEQ ID NO: 41116 - DNA, 363 bp, Glycine max
  Peptide Sequence Number=SeqID_132801
atgaaaagagaaaaacatgcctcctatagtagtcatgactcttgcaagagtttaagtgaagaacttagtgactattatagagggtgtcatagttcacataccaaacatcactcccaaagaaaagaaaaggataaaaggcctcaagaggttaacattagcctcccatatttccatggaaaagataatgttgaggcctacttagattgggaaatgaaggttgaacaactctttgcttgccatcatattagtgaagagagaaaaggaattagaaaggaggattggtggccatcccttgaagagattgatgagtctaagagcctatggggaaaggacatccctcactatgaaggagctatggactaa

SEQ ID NO: 41117 - DNA, 471 bp, Glycine max
  Peptide Sequence Number=SeqID_132802
atggaaccccgtcccgatcacggtgaaaccagctatcgcggcactggccgtttaaccgggcgcaaggcgctgattaccggtggtgactccggcattggccgcgcggtagccattgcgtatgcccgtgaaggggctgacgtggcaatcaactacctgccggaagaggagcaggacgccgctgaagtggtgcaattaatcgaagcggaaggccgtaaagcggtggcgattccgggtgatattcgctcagaatctttttgccagcagctggtaaaagaggcagcagaaaaactcgacggtctggatattgtggtgaataacgccggtcgccagcaatttaatgagtcaattcgcacgctctcaactgaagattttgacgccacctttaagaccaatgtttatgcgatgttctggatcaccaaagcggcactggaatatctgcctgccggatcatccataattaatacctcgtcg

SEQ ID NO: 41118 - DNA, 654 bp, Glycine max
  Peptide Sequence Number=SeqID_132803
atgccgcccgccagcaacaccagccaggtttcattggcatcccacagcggcagcaggctgtgcaccatccactgccgctcttgtggctggtcgaaactgtacagcagaatccccacgccgctatccgtgccatccagcgccagatacatcagcagggcaaacagcaggagcacagcagaaagttcgaccaacattctcaccctcctcaggctggcgtctgtatggtttccgctaccgccgtcgcctgcggatccggcagcggtgccgccaggtggcgcagcagataacccagaccaaaggcaaaactcagtgcgtaaatcaccaccaccgacacgaaaatggcgacgctgctgccgagggacattggcgccaggctgtcggcggtacgcagcatgccgtataccgtccacggctgccggccaacctccgtcaccacccagcccgccagcagcgcaacaaagccagccggtgacatcagcgccagcagacgcagcacgcgccgcgactgatcaagacgaccgcgccagcgctgcacattgcccgccaggctgctcagcagcattagcagcgccagtcccaccatcaggcgaaaggcaaaaaacaccggcagcaccggcggcaggctgtcgcgcggaaattcacgcaggcttttga

SEQ ID NO: 41119 - DNA, 2418 bp, Glycine max
  Peptide Sequence Number=SeqID_132804
cccggcagcacttaccccattgagctcaaattcagcgccgctcgaacgcgctttattgatggcgcgcgtggtgccgttaatgttgagcgacatatcgcgttcgtcgatgcggtacagcgctacgctggcaaacagccggggcgaaatctgccacttgctgcccacttcccatgtggtgccctgttccggcttgccgacgttgccgtcatcgtcgacgtcagtcgacggcgtaaaggatttgctcacgctgctcaccgcaatccagtcgtcggtgagcgaaatgctgtctttggcgtataccgagcgactgtgcaagcggttaagcaggttagcgttggcgctgttttcactgctgctgttggtgagcggtgccagcatatcgtattgcggatcgtacaggttgaagccggtgttcgctttgaccctgatactggtgtgcacgccacggttggcgtcggcgcggcgcgtcaccacgccggtagtggggttgatcgccgtaacccgcacttcgttgttgtcgtactgacgctggttccagccaaaagtcaggcgcgtgctccacgcctcattgaactgccaggcgtaatgcgcgttcagggttttattgtggccccacgcatggttagctttatcgtccaggcgatctttatagccaatcgctactggcttaccgttaacaaacgccgtgccgcgatcgtagggaatatcgtactgataatcttcgtagctgataaggaagctggcctgctcgccataccactcaatcaggcggaaagcaaaaccgttgccgagcgggccggtgacgtccagcgtgccggcgccgccgccctcgctggctgcgcgaccgctgactttggtgtgccaggtgtattgcggctttttgctcacaatattgatcacgccaccgggattctggataccgtacagcagcgaagccgagcccttcagtacctcgacacgttcggtggtggcgtcgaaattcaacccctggctgctgcgcacgccatcacgatagatggaaccatccgagttgctgccaaagccgcggcgtacaaagccatcttcggtacctgccagcgtattgccttcgcttacgccgctgacaaagcgcagcgcgtcggcgaggctggcggcctgataatcctccagctgctgttgcgtcaccacgctcaccgattgggcttcattgaggcgcgacaccggcgttttactggcgaccgaactgctggtggcgctatagccgtcgtcactgttttgctgctgcgccgtcacggtgagggtgctgttttgttcagcggcaaggctgtcagtactgctgagtgccgttacgccgtaaatagcggcaaggatagccggatggcacagacattcgcggcccggcattgttatgccatcagtcagcagaaaaaggcggctgagatccaggcgagaagggagtggacagcggtagcggcgcaaattttcactacaagccggcctgccgacgcggttcacaacgatgcgatattactaacaggcaacataatggcggcaaataacattaaaaatcgggtggatgtattcggtgaacgctaccgtgcgcgcgtcacgacattatcggccagcctgcaaacggtggcgcgatatatccacgaacatcgtgaggctatattagacgcgactgcattggatatcgcccaggccactcaaacctctgacgccaccgtggtgcgcaccgtgcaggcgctgggctttgccggtttgcgcgatctgaaaaccacgctggccgcgtggtttggcccggcgcaaaactcggaagagaagatgagcgcgaccatcagcgaactgtcgtgtgacatcaactccggcatcgattttgtgctgggcggccatcagcgcgcctgcgaagtactggctgaaccggttaaccgtcaggcggtggcggctgcggtgacactgttgctggaagcgcgtcaggtggcgctgtttggcatcaacgcttccggcattctggcggagtacagcgcgcgactgttccggcgcatcggcctgccggcggtgacgcttaaccgtgccgggattgcgctggcagaacagctgattacgctacagcgcggcgatgtactgatcatgatggcacagaaatcggcgcaccgtgagggcatgacgacgctgaaagaggcgcagcggctgggtatgccggtgattctgctgacccacgcgctggattcggcgtttgcgcagcaggcggatgtagtaattaacgtgccgcgcggcggtgaaaatggtcgcatgccgctgcacggtacggtgctggtgtgcctcgaaatgctgattctggcggtggcctccgccagttcggcacgcacggttaaaaccatgaaacgcattcaggatctcaatcgatcgctgaaacccacgtcgaagaaggcgggataa

SEQ ID NO: 41120 - DNA, 918 bp, Glycine max
  Peptide Sequence Number=SeqID_132805
atgaaaaagaaaacgctggcccaggtgaccgacttcgacctcagactgctgcgcgttttcaaaaccgtcagcgagtgcggcagcttttccgccgccgaaagcctgctcggtattacgcgctcggccatcagcctgcatatgagcgatctggaaaaacggctgggcatgcgcctgtgccagcgcggtcgcgccgggtttgcgctcaccgaggaagggcgtgaaattttacgacacagcgagaccatgatggcggcggtggaagattttcgccagcaggtgaaccagatgcatcagcagctgcgcggggagttcaacatcggcatcatcaataatctggtgacgcagccgcgcatgcgtctcacccatgcgctggcggcgctgcgggagagcggggcagggatccggatcaacatcagtatgttaaccgcggcggacatcgagcgaggcctgctggaaggacgcctgcacgtgggcgcgctgccgatggcggcgccggtctccgggctggcgtacgcacagctgtatgatgaacatgcgcagctctattgcagccacgcgcacccgctatttaaccaggcggagcggccggaacaccacgcgctggcggcctgcgatgcgatagcgccgctgtttcgcatgccggcggaggcgattgcgctgcatcagcagctgaactgcagcgccaccgcttccgatcgcgaagggatcgcatttctcattctcaccgggcgctatatcggtttcctgccggaccactacgccgcgcagtgggtggagaaaaagcagatgcgcgccctcgcgccgcagcagttccattaccacagtcaaatcgcgctcgtcacccgccagggcccgcgtcacaacgccatcctgcaacgctttttgcaggcgctggcgctggacgagcccggcgcttag

SEQ ID NO: 41121 - DNA, 91 bp, Glycine max
  Peptide Sequence Number=SeqID_132806
agcaacactcattgatgcaatcttgtccccccaagggcattggatagaagactccaagaaggttgggccaaagatgaaagagaaggcttag

SEQ ID NO: 41122 - DNA, 618 bp, Glycine max
  Peptide Sequence Number=SeqID_132807
atgggtgatcaagaggagacgcaggaacagatgaaagccgacatgtcggctctgaaagaacaaatggcctccatgatggaggccatgttaagtatgaagcagctcatagagaagaacgcggccaccgccaccgctgtcagttcggctgccgaagcagacccgactctcttggcaactacgcaccatcctccctcaaacatagtaggacggggaaggaacacactggggcacgatggcagccctcacctgggatacaaccgagcggcttacccttatggattgccgcccaactattcaccacccgtcttgcaagaagatgcgggccacattgcctctcccgtccatgaaagagagcctcctcagcaacccgacgaagtccataaagaccctcaagattatgctcgaagggatgtcgagttctatcccccgatccccgaagggccggcaccaggcacgttgcctcaacccaacatcgcagcatcgccaatagttttgtccatggaagggccgcccccggcaactgaagaaaggaggaagctcgatctccttgaggaaagattgagggctgtggaaggatttggggactatccgtttgcagacatgacggatctttgctta

SEQ ID NO: 41123 - DNA, 675 bp, Glycine max
  Peptide Sequence Number=SeqID_132808
atgggtgaagtagaggaggtgcaagagcagatgaaggccaacatggaagccatgaaagagaaaatggccacgatgatggaggccatgatgagcatgaagaagataatggaagccaatgcggttacaattgccgctaccagcactgttgctgagaggaacccgatgcccccatgtggcctcaaccaaatgaatcatccaacctcagttatggtaggcaaagatttgggaagtacgggcagcccccatgatgtgcaaattcaaaacgagcatgccttcccgacatatagtttgcctctcaactatacgccagccaaagtggccacccatgaaattccccatcacaatctagccgacttcgagccttggctcggatataccactgaagggcaagcagttggtggtataccctacaaaaccctttggagggccctcagtatcacccacaactgcacctcttgcattccacagaggttaaaaaccctcatgactatggcaggaatgggaaagttggatcatctagaggaaaggctcagggccattgaaggaggtgaagattatgcctttgctaacctagaagagttgttcctaatacccaaacatggtcattcccaagttcaaggtgccggactttggcaagtacaaggggactactcgctccaaggaccatctaaagat

SEQ ID NO: 41124 - DNA, 751 bp, Glycine max
  Peptide Sequence Number=SeqID_132809
aggcaatccatctgacttacaaccctttgatcctgagatagatagggcattccatagattagttaggcatcattttataccttttgatcatcctgagcattccattactgctgaatctgtgcattctgttattggtgattttgaacatcctgattttgagcattataattttgagcattctgattctgagcattctgattttgaacactctgagaacatggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgcaggtgaagacccgcacaaacatttgaaggaatttcatattgtctcctccaccatgaaacccccagatgtccaagaggaccacatatttctgaaggctttccctcattctttagagggagtggcaaaggactggctgtattaccttgctccaagtaatatggagagaagtatgatagatgctgccagtggtggagcccttggagacatgactcctgctgaagccagaaatttaattgagaagatggcttccaactcccagcagtttagcgccaaaaatgatgctatagtcattagaggagtgcatgaggtagctacaaactcagctgcatcatctgaaactaagaagcttgaaggcaaactggatgcattggttaacttg

SEQ ID NO: 41125 - DNA, 273 bp, Glycine max
  Peptide Sequence Number=SeqID_132810
atgagggaggcacatgaaataccccaccataatctagttgacttcgagccttgccttggatacgccactgaggggcaatcagtttatggtgtacccttgccaaacactttggaggaacctcagtttcactcacaaccacaacccttgcattttatggtggggagagtccctcttgctatggcggaaaaagggaaattggatcatatagaggaaaggcttagggccattgaaggaggcggagatcatgcttttgctaacatggctgagttgtag

SEQ ID NO: 41126 - DNA, 252 bp, Glycine max
  Peptide Sequence Number=SeqID_132811
atgcctagcgctgttcatgtgtcctccaccttcgagtctgcagccccgcgaatgtctttgcctagcgctgttcgccaattctccattctatacttttattcggagccccatgaatgtcgttgcctaacgctgtacatgcatcctccacccaaagagattggagctatgcttcacgattgcctaagtgtggaccctctagtgcaatcctccattctacacttttttcggagccccatgaatgtcattgcctag

SEQ ID NO: 41127 - DNA, 932 bp, Glycine max
  Peptide Sequence Number=SeqID_132812
agttagggcagttgatgggtcagctccagcggcaagcttttcgcaaagcttacggtaaaatctgggacctagccatggtagaagtctctacagaggccattgcctccctcgcccagtattatgatcagccgttgtggtgcttcacctttggggacttccagctgtcacccatggtggaagaatttgaagagatcctaggatgccctctaggggggaggaaaccatacctcttcacagggttctatccctcattagctagaatttccaatatagtccaaatctcggcgcaggaattagaccacaggaagcaagtcaaaaatggggtggtcggaataccgagaaaatatttggaggtaaaagcaagaatcttggcagttaaaggcgagtgggccccgttcatagatattctcgcattgttgattttcgggggagtcctctttccgaatgtggatgggttggtggacctagcagcgattgacgcttttcttgcctatcatgaccacaaggaaagcccgatcgttgctatgctagccgacctctatgacacctttgaccgaagatgtgagaagagtagtatgaggattttctgttgtactcccgctctttatgtatggggttgcatcaattacaatcccgttcttgcgataaggcaacttggctatccgatgagaggggcaccactagaggaagagctcgcacctatcatttcacgagggttcagtgagaccaacatggagacgcttcggaaggtccgcgaagcatgggaagtggtacaaaagaaggacaaagagctcagaggcagtaacaataggcccattggtggctaccatgagtggttgaaaacccacgtgcaaggtttggaaatgctcccaagtctgaaaaccgctaaaagggaggaagttgaggcaccgaaggaagacgaagaggtgtag

SEQ ID NO: 41128 - DNA, 273 bp, Glycine max
  Peptide Sequence Number=SeqID_132813
atgaggcttaagaatcaaggaaatcactcagtcaattatataaaccaccaaggaaatcaaggagctaaaattttttttatgaagaagcatgataaaggcaaaaggtcattaaagatcaatgacgaatctttgcaaatccagaagaaggtatcaaagggcaataattgtcaattttatggaaaatctggacacctcgacaagaattgcctaaagcataagtcttggttcgaaaagaaggggattccttataatccaaaccataagcccaaatga

SEQ ID NO: 41129 - DNA, 75 bp, Glycine max
  Peptide Sequence Number=SeqID_132814
atggagcaacaacaaaggacttgggaatgttgtgaagcaaagtcagatgaaggtatatccttgactattctttga

SEQ ID NO: 41130 - DNA, 873 bp, Glycine max
  Peptide Sequence Number=SeqID_132815
atgcgagcttatattcctcagcctggagccaatgacaacacgctgtggcgggttgcaggcctgcctccacgtggtattgagttaacgcgtatgctggaagccggtttgccggtggccgtcattgatgatatccgtcactggtcggccatgacgcgcgccgaaatcatgaaggtcacagggattaatgaacgcaacattgcccgtcgtaaaagcacgggtaaaagtctgtcacccgacgagagtgaacgtgtcgcccgcttcgtccgcgtgatggatgccgccgttcagctttttgctggtaataaagaagaggccacccagtggctgagccggccggtgaaagggttaggcaatgttgcgcccatcaccttactgacgacggagagcggtgcgctggatgtgctcgatctgatcggccgtctggagcacggtagccagtatgcggctgaagcctggtccggttatggggcaaaacagtatggtggacgctggaatcataaaggctatcccaccgtttatgttgccacgtcggtgtcactcgcagcactggaagtgctggtccatatcggaagagagtcggtgctggatgagtacaccttactcagtatcgacatcccggatgcagaagttgcctatcttgctgaagcatttttgccgccggactggcgtcatgatccagcgccactgtcgacaatggatctcggcaccggctggctgcaatccgctgaaggtgccgcgctgatgctaccttccacgattatcccgatggaaaacaacgccatcctgaaccctctccatcctgcatttagtgactatctgccgggtgtgaaagcgttaccgtttatgtttgatcgccggcttatcaggacataa

SEQ ID NO: 41131 - DNA, 513 bp, Glycine max
  Peptide Sequence Number=SeqID_132816
atgggttccttggcagacctgcagtcgttacaaattcgtaacaacacactctcaggaatatttccaaccagtttgaagaagaataaccaattgatatccttggaccttggggaaaataatctttcaggaagtattccaacatgggttggagaaaagctcttaaatgtgaaaatcctcctccttcgatcaaacagttttaccggccacattccaaatgaaatatgtcagatgagtcttcttcaggttttagaccttgcacaaaacaatttgtctggcaatataccgagctgtttcagtaacttgagtgccatgacactaaagaaccaaagtacagatcctcatatctattctcaagcacaacttgttatgctttacacttcctggtatagcatagttagtgtgctactatggctgaaaggaagaggagatgagtatagaaacattctgggtttggtaacaagcattgatctatcaaggaaaaattccaacaggaactcaattgcaaacctttga

SEQ ID NO: 41132 - DNA, 436 bp, Glycine max
  Peptide Sequence Number=SeqID_132817
attgattcatgcttgctgaaatcaatttcttacactgagaatgctttaagaaatagtttcctcaatcctgtgccaattgccaatagctttgagctcctcataattagatttagtgttgttcacggtagctcctttgatcaaaaatctggtccagttcctgtacccactgatgaggtttccttagtggggcagacacttcacaccttcctttcttggctgacacatctggtcaagtctttatcacagcaggtagttgtgtctcctgcaaaaccacctccaaagctcgatgatccgctttatctgatgacattgaccatcccagagcttttctcgaggccttatcaggttagatgggatgccactgtgttcggggtctttaatccagatttccccctctacataaagcacgaagacctctccgaaatcgcacacggtg

SEQ ID NO: 41133 - DNA, 372 bp, Glycine max
  Peptide Sequence Number=SeqID_132818
atgccgaactccccctgcggaaatatcagttggtttgtgtcgttccgacatagttctacggagtgcccgtcgcccccagcaaggtcatgccatcatgacatagggatcgtgcccgcaagacacctagtggaccctaagaagtccaacagggtcttggagttgccagctctaattacgggcctctgtcagatctacggagtgcctgtcgcccccagcaaggccatcatgccccctactaatcgagctttcatcaagaagtactgcgccccccgacaggtgcagggcgaaacaccacaacagcctggggatggccggcagcgggcaacagacacaccgccaccacctctagagttcacctcagctcatccataa

SEQ ID NO: 41134 - DNA, 261 bp, Glycine max
  Peptide Sequence Number=SeqID_132819
atggggaaagttggatcatctagaggaaaaggctcagacccattgaaggaggatgcaactacagaacatttgcaaaaagggggacggatctttcaaagaaccacgcccaaaaggtggagggatctggcggcccaggtggtacccccaatgatggaaagggagacgatgatcgtgatggtagacacattatcgatcctctactatgaaaagatggtgggctccgccccctcaaagctttgcggatttggtcttcgccagtga

SEQ ID NO: 41135 - DNA, 720 bp, Glycine max
  Peptide Sequence Number=SeqID_132820
aagggtggacctttgggtactagtaccctcaccttcagagggctacacgccctcacctttagagggctatacgtcctcaccttcagagggttacacgccctcaccttcagaggactacacatcctcgccatcagaggactacacgtcctcgccttcagagggctgcacgccctcatcttcagaggactatacgccctcaccttcagtgggatacacaccctcaccttcagaggactacacgtcctcgccatcagagtactacacgtcctcaccttcagagggctacacgccctcaccttcagagggttatacgccctcgccttcagagggttacatgccctcaccttcagaggactacacgtccttgccatcagaggactacacgtcctcgccttcagagggctacacgccctcaccttcagaggactacacatcctcgccatcagaggactacacgtcctctccttcagagggctgcacacactcaccttcagaggactacacatcctcaccatcagaggactacacatcctctccttcaaagggctgcacgccctcaccttcagaggactgcacgtcctcgtctttagagggttcctcgccctcacctttagaggactactcgtcctcccctttagaggactacatatcctcgccttcagagggctacatgcccttaccttcagagggctgcacatcctcacctttagaggactacac

SEQ ID NO: 41136 - DNA, 276 bp, Glycine max
  Peptide Sequence Number=SeqID_132821
atggctaaagagcaacctcgacgagtgaccttggaagattactcaaagggtcgcaacgtgcccttcgcgggcgagcgagggcgaggctcacgggcgcgctttccaaaggaggaaagatgcgcggagtcgccaccaacatttatttatggaaaacgtcggaaaaaccgaaggaaaccagtcaaaatgaaaattctaagttcgggagttgtatttacgcttgaggaaggtattagcacctcttacgtttgtctcgaaggacaacagcctattttttag

SEQ ID NO: 41137 - DNA, 192 bp, Glycine max
  Peptide Sequence Number=SeqID_132822
atggaagcggtactctcatttgaggtagaggtcccttcccagaggatactagcggaatcggtcctagaagaatcggagtgggctcaaacacgctacgaccaactcaaccttattgaagtttgtgataacttgagccctttcgctaagttcatcgggtgccccaagcacttaattaaaactgaacctaactag

SEQ ID NO: 41138 - DNA, 705 bp, Glycine max
  Peptide Sequence Number=SeqID_132823
atgactccgaaaaagctttccacgaagaggtctaggagagacaccacggcggaagggtccagtgccgcccccgagtttgatagccaccatttccggagcgccgagcaccagcagcgcttcgaggccatcaaaggatggtcattccacagagagaggcgcgtccagctcagggtggataagtatacagattttcaggaggagatagctcgcaggcatcggacgtcgttggtgacttccatggctaagtttgaccctgaggtagtccgggagttttatgctagtgcttggcccacagaggaaggagtgcgagacatgcgttcatgggtaaggggtcagtggattccctttgacgcagatgccctcagccagttcttgggtgacccgctagtgttggaggaaggccagcagtgcgagttcagccagaggggtaacagggccgacgggttcgacgaggaggccattgcccagctgttatgcacaccgggacaggatttcgcccggaccgctgcagggaggcgggtgtggatcatgcgcaccagcatgaccactttgacccagacgtggatgacattgctgctcagcaatgtcttgcctagcgatcataactccgatctccctctgccgaagtgccagttggtgtatgccatcctgacacggatgagcgtccacgtggcccaggtatgccacccaccagacaccctttag

SEQ ID NO: 41139 - DNA, 330 bp, Glycine max
  Peptide Sequence Number=SeqID_132824
atgatgataacaaaagatgacgacaaaggtgatgacaaaaagctcaaagatcaatcaagaacaattcaagagttcaagataagaatcaagaagaattcaagactcaagaatcaagattcaagcctgagatctttgtctcaacacattggaaggtacatcctttgtggtacaagtagagggtacatctacttgggtttgactgagaacaagggatggtacatctcttgtggatcagttctagtggagggtacatccactaggttcaaagagaacaagggagggtacatcccttgtggatctttgcttgtaaaaggatttttacaaggttga

SEQ ID NO: 41140 - DNA, 313 bp, Glycine max
  Peptide Sequence Number=SeqID_132825
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccggttcagtccgaccgctgcgcctttatccggtaactatcgtcttgagtccaacccggaaagacatgcaaaagcaccactggcagcagccactg

SEQ ID NO: 41141 - DNA, 150 bp, Glycine max
  Peptide Sequence Number=SeqID_132826
atgggttggaatgtgagcaatctttggccagtcttcgcctcctgggttcgggcaacgctgcttgagctgttggaggttggggcagtttacgagagaccatttcttgagagaggagagctgacagagccccttgtagtccagtttttctag

SEQ ID NO: 41142 - DNA, 657 bp, Glycine max
  Peptide Sequence Number=SeqID_132827
ggctaatccgcctcacgagggtcgccaacggcacgagcctttggggggccgaggccccctactgctggtcggcaaacggactgcgggcgcacgcgtcgcttctagcccagattctgacttcgaggcgttcagtcataatccaacgcacggtagcttcgcgccactggctttcaaccaagcgcgatgaccaattgtgcgaatcaacggttcctctcgtactagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataa

SEQ ID NO: 41143 - DNA, 483 bp, Glycine max
  Peptide Sequence Number=SeqID_132828
atgaagggagcaccggcagaagagagcctctctcctttccttatgagggatttcggcgcgcaaagttccaagattatacaaagagtccacaagacgtgggaaagctcgttaaggagagataaagaacttaggggcattcgtaatggcatcatcggtggttatcgtgaatggctgaaagatcatacacgagggttagattggctctccaaattaaaagttatcaatgaggagaacttcaaagctccggaagagaatgaagaagtccaagctctaaaaacagaactaggaaaagcaagacttgccaaggaaaaattcaagttagtcgctacagacatccgaaaagagtgtgtcgggttacgagaaggaaatgcagcttccgcaagagcccttgaacgagaaaccaagagggctcgcaaggaagagcatggccgagacaaattccgtggagctttatggggcagcaacaatgagctcaagctttga

SEQ ID NO: 41144 - DNA, 177 bp, Glycine max
  Peptide Sequence Number=SeqID_132829
atgagagcgcacgagggagccgccaggggaaacgcctggggggcggagcctatggaaaaaacggctttgccgcggccctctcacttccctgttaagtatcttcctggcatcttccaggaaatctccgccccgttcgtaagccatttccgctcgccgcagtcgaacgaccgagcgtag

SEQ ID NO: 41145 - DNA, 192 bp, Glycine max
  Peptide Sequence Number=SeqID_132830
atggctctgatgggcgtaaatgatgcggaaaagggtagtgacattgatccactagttggagaagcacagcaaactcttgaaatagcagaagctaatttgaataaggcggaaggcaagagacaaacaattgaggcaaatctagctcttagacgagctaggacacgagtagaggctatcaatgtgatttcataa

SEQ ID NO: 41146 - DNA, 603 bp, Glycine max
  Peptide Sequence Number=SeqID_132831
atggtggcacgtgttatgcttaggaacggatttgagcccggaatgggtctaggcaaggactgcctcgggaatgccgacgtggtcgatatcaagggaaatccatacaagtatggattagggtacgaacccgggatgtcggggaggaggaacgtgccgtcaagatttcgggcggatagggtatggcccggccgtattagccagtgtttcaccagcgctggaatggtgtccgaggaggaggtggccgcaatagaagaggagttccctcaagacccaccaagttttgtgcaacgatgccaccccgattcccaagtggggagctggcgcgtgataagccagtcagaagtctatgccgctgattcgatatatgagggtcgattctttgaggatcctaacaacgagggtttgacaatcgatttcgatcgagatataagccaaacgataaacgaggaagaggaagaggacgtcctatcaccagagttggagaggtttcttagctgtggcgcggtacccggagtgggtggccaacattgtcccagtcccgaaaaaggacggcaaggttcggatatgtgtagactaccgggacttgaaccgagccagtcctaa

SEQ ID NO: 41147 - DNA, 487 bp, Glycine max
  Peptide Sequence Number=SeqID_132832
aatttcacaccctttggacccagataagtccaacagggccctgggattccccgcactgatcacaggactctgccagtcgttcggggtccccgttgcacctaccaaggtgattcggccgcccatcacccgggcttttattgagaagtactgtacccagagacaggctcagggtgatgctccacaggccgcaggcgcgcccccaccacctcatcaggctggccaggctggggcatttgacatggagcagtatttacggcatttggttcgccagcaggcggccaaccaccgagcacatagccagggcttcgcttctttttcatgccctactccagaccagttcagggcagaggttgcatggcccagagattggcccgaggcccaagcagaagaggcacccccagaagctcccggcgacggagaagaggcccacgaggatgaggagatggccgatttgcttgacttcttgggagggagtggagatacgtga

SEQ ID NO: 41148 - DNA, 136 bp, Glycine max
  Peptide Sequence Number=SeqID_132833
agaggagacaggagactcatggcacttgtggctgttgagggccatccagttgcttgcttatgagagcaggaagctgaacggagccgagaggccctacgcagtacatgagaaaaactgcagggaagaccagccataa

SEQ ID NO: 41149 - DNA, 543 bp, Glycine max
  Peptide Sequence Number=SeqID_132834
atggatccattcggtgggagtcgttccctctacactccaccagaaattgaagttcgtagtggaggggcatttgtttatcgtatcgggcgaggaagacatcttgattccttctctgggcaaccttggctgtccgatgcggcagtaatgatggcccgagtgatgttggggaatggttatgagcccggaatgggtttaggcaaggacaacgggggcataaccagcctgataagcgctaaaggaaaccgtgggaagtttgggttaggctataaacccacacaagtggacataaagaaaggcattacaggaaggaagagcggaggtcaaggctcgcgattgggacaagaagtcaaaggaggcccgccctgccacatcagtaggagctttataagcacgggtctaggacacgaaggccaagtcgttgcgatatgtgaagatgattcgccaagtgggtcggagttggtacgaccatgccctcctggttttcgactaggaaattggcgagtggaggaacgcccggacatttacgcaacaagcataatgtaa

SEQ ID NO: 41150 - DNA, 609 bp, Glycine max
  Peptide Sequence Number=SeqID_132835
atgaaagcgttaacgaccaggcagcaagaggtgtttgatctcattcgggatcatatcggccagacgggtatgccacccacgcgtgcggaaatcgcgcagcgtctgggcttccgttctccgaatgctgccgaagaacacctgaaagcgctggcgcgtaagggtgtcattgagattgtttcgggcgcgtcacggggtatccgcctgctggtggaagaagagacgggcattccgctgatagggcgtgttgctgccggtgagcctttactggctcagcagcatattgaaggtcactaccaggtcgatcctggcatgttcaaaccgagcgctgacttcctgctgcgcgtcagcggcatgtcgatgaaagacatcggtattcttgatggcgatctgcttgcggtgcataaaacacaggatgtgcgaaacggccaggtggtggtggcgcgcattgatgacgaagtgaccgttaagcgtctgaaaaaacagggtaacagcgtacagttgctgcctgaaaacagcgagttttcacccattgtggtcgatctccgcgaacagaacttctctatcgaaggactggcggtcggggtgattcgcaacggtgaatggctgtaa

SEQ ID NO: 41151 - DNA, 64 bp, Glycine max
  Peptide Sequence Number=SeqID_132836
atggagcttgcatcaagttctttcaaaaggggtgaatcaagtgattctttttacttggaagggg

SEQ ID NO: 41152 - DNA, 348 bp, Glycine max
  Peptide Sequence Number=SeqID_132837
ggggggtacgagcaccctgtaggactgatagaggcccgtaaccagagctggaaaccccagggccctgttggacttttccgggtccactgggcgtcttgtggaatgttgctaagtagcaatgtcatctatatctgtgtaagagtggtcatgttggtgcgcatgatccgcactcgtctctttgcagcggcacgggtgaaatcttgccccggtatgcatagtagttgtgtgatagcctccctctctggttgtactcgcacagttggccctcctccaatatcagtgggtggcccaggaaccgttaaaaggaaaactactggtcccttaaccgggagtgcaagtctcggttaa

SEQ ID NO: 41153 - DNA, 908 bp, Glycine max
  Peptide Sequence Number=SeqID_132838
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatccaaaatgcgcacctgaacaccggatggttcaagaattagttcgagcacaacggttgaattccaaacgccatgagcattttgtccaaaaggtaattgtattgattcaagagatgaaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41154 - DNA, 264 bp, Glycine max
  Peptide Sequence Number=SeqID_132839
atgtcaggatttacacgcgattcccctcaaatttcagccagcccgcatcaattagaccttgcaccttacgcttcaggcccctacaatgctcaatggaatgccccggggcttctccatgacaagcacacgctgcgttcgagtcgtattcttggagaaatggaggttgatgaaccttggttggggctttctcgctgcaaaattcatttcttggttggtgtttttcgtttgtgcttaaggtggtgttcgtcattggaagtgcggtag

SEQ ID NO: 41155 - DNA, 1252 bp, Glycine max
  Peptide Sequence Number=SeqID_132840
ggtaacaggtggcaagcggataattccgttttaacggcgcaacagatagccgcaaggccagaatcctctcttcccgtacaaactggtgaagagcaccaacctcgcgcggatcagttgctcgttgtcgaagagctgcgtgaaaggctggaaaggatcggtggcggccctgagcggctgcacgagaccttgcctttcggcgtggatgccatcgaccatcacctgccgggaggcgggctgaagctcggctgcctgcatgagctgagcggcggcggcaatggtgctgccgatggtgcggcggccgctctctttgcggccggggtggcagcaaggattgccggcaaggttttatggtgcgtcacccggcaggatctgttcatgccggggctgacacaggctggcctgtcgcagaaccggctcatcatcgttgaatgccgtgatgagaaaggcgtgcttgactgtttcgaggagggcttgcgctgcaatggtttcggcgcggtgatgggcgaagtggcgaaactgccgatgaacgcttcgcggcggctgcaactggcggcggaaacttccggcgtgaccggcattgccatccgccgcttccggcgtccggccgatgcggcgctgttcggcgaaccgacggcggccgtcacccgctggcgtcccgctggtttcttgagcttttgcgatgtcgcggcggcgaaagcgccgaatttgaagtggaagcctgtgatgcaaaaggtcgtctcgctctacctgccgacatggccgacggatcgattccggcgtctgtcgggacagaacgcgccgccggttgaaaagccgctggtcatgatcggccgccagggcagccgccggctggcgctggcgctcgacaaggccgcgaaggcggcgggcatccggcctggcacgccggtcagcaaggcgcaggcgctggtgcccggccttctcgtggaagatctggatgcggttggagatgcccgcgcccttgagcagctggcctttcatttcctgcgcatttatgcccccatcgtcgccgccgatgcgccggacgggctggtgctggacacggcgggcgcggatcatctgcacggcaatgagatgctgatgctgagcggcatggtcaaccgcctgcatgccgcaggcttcgccgcccgcgccgccattgccgatagctgggatcagcatcataccgccgggtgggcaacgggtggcgatcagcagcttgccgcttgccgcgctgaggctggaggatcgcatc

SEQ ID NO: 41156 - DNA, 668 bp, Glycine max
  Peptide Sequence Number=SeqID_132841
aagtcgtcagcgaagagaattttgaagcaccggaagaagacaaagaagtccaagctctcaaaagcgagttaggaaaggcaaaacttgccaaggagaagttcaagttggccgctacacacgttcggaaggagtgtgccgggttacgggaagagaatgcaattaccgcaagagcccttgaacaagagaccaagagggcccgcaaggaagagtatggccggaacaaatttcgcggagctctatggggtagcaatagtgaactcaagttgcgaaaggaagaaagggaccagtcgcgggcacatagcatggtccaaaagaagcttgtctcagcgttatgcgagacggagaccaacatgctagctatcattgccaagtaccaagaagagttaggtctagccgcggcccacgagcataggattgtggacgaatatgcccaagtatacgcggaaaaagaggctagaggaagagtgatcgactctttacaccaagaggcaaccatgtggatggatcggtttgctcttaccttgaacgggagtcaagaacttccccgattgttagccaaggccaaggcgatggcagacacctactccgcccccgaagagattcatgggcttctcggctattgtcagcatatgatagacttaatggcccacataattagaaatcgttag

SEQ ID NO: 41157 - DNA, 303 bp, Glycine max
  Peptide Sequence Number=SeqID_132842
atgaggtgtgtgattagcagcgaagtgttgaaggggataatctctgatgtgaaggaggagagggatttgtgtggtgagagtaagaggaaggttgatggagtgtcaaggagcaaatgtgagttggtagaggttcagaatggtgagaaggagaaggagaaaggtggtgaaggggtgcagcatggcaaaaggagaagatcaaaggtgaatctaaggctgagcaatccgccaaaggccgccatggctcactacagtgtgtggggaagcactcggtggctggattctgcgaaaggccgacagctttga

SEQ ID NO: 41158 - DNA, 267 bp, Glycine max
  Peptide Sequence Number=SeqID_132843
atggcagaggtctccacggaggccattgcctccattgcccaatattctgaccagcctttgagtcaaaatctcgacacaggagttagaccgcggaaagcaagtcgaaaatggggtggttggggtaccaagaaaatttttggaagcaaaggcaaaattcttggcaagtcaaggcgaatgggccccattcatggacatcctggcacttttgacattcggggtggtcctctttccaaatgtggatgggttggtggaccgggcagcgattga

SEQ ID NO: 41159 - DNA, 435 bp, Glycine max
  Peptide Sequence Number=SeqID_132844
atgggtgaagcagaggaggtgcaagagaagatgaaggccgacatggaggccatgaaagagcaaatggccacaatgatggaggccatgataagcatgaagaagataatggaagccaatgcggttatagttgccgctactagcgctgtcgctaaggtgaacccgatgctcccatctggcctcaagcaaatgaatcatccaacctcaaatatggagacacatgaaattccccaccacgatctagccaacttcgagccttgcctcggatatgctgctgaagggcaagcagttggtggtatacccctacaaaaccctttggagggccctcagtatcacccacaactgcacctcttgcattccacagcggttaaaaaccctcatgactatggcaggaatgggaaagttggatcatatagaggaaaggctcagggccattga

SEQ ID NO: 41160 - DNA, 759 bp, Glycine max
  Peptide Sequence Number=SeqID_132845
atggtcattgaccagtcccttttccatgacttaaccaaattacccagtgacggtgtaccatttgaaggtacactgaatgacgactggaaatttgatttctctgcccatgatgcccgccagttggtttgcaccaacaatgcggatatgaccggacgtcttcttgtcgggtcattggcttttgaaagctgcatccttcactatttaattgtgcgtattttgcttccacggtcttccaaccttgcccaggtttctgaggaagatctaattatcatgtgggcctttcatacaggacgtcaacttgactgggcacacttagtcagatatcgcatgcataaggcattgcgattaaatgctccactaccatatccacagcttgtcactctctttttccgccattttcaaattcctcttgattctgaaccttatgttccaatcaagcgatcttttttaattggtgctgctgtgattgcttcttttggttaccgcaaagagcgtgatggctcttgggtcaaaaagggtgttccccctgctgatgatgaaggccacataccagttgaagataattccactcttcttcaaaggcttatggacaagtttgatggacttcagaattttgttggtgacaagtttgatgccatggaattgcaagttgacatgcggttcgatgctatggaatcaaggatcactagggttgaagaagatgtctccttcatccgaacttgctttgatccaccaccaccgcctccttcatcctcttag

SEQ ID NO: 41161 - DNA, 253 bp, Glycine max
  Peptide Sequence Number=SeqID_132846
atggcacgcagcgtgtttgcttcgtgcccctattcaagggacctatatgggaggaagctaacaagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaaca

SEQ ID NO: 41162 - DNA, 111 bp, Glycine max
  Peptide Sequence Number=SeqID_132847
atggcacgcagcgtgtttgcttcgtgcccctattcaagggacctatatgggaggaagctaacaaggtctctagaggtatcatccccttcgaagaacatatcgtaccagtag

SEQ ID NO: 41163 - DNA, 441 bp, Glycine max
  Peptide Sequence Number=SeqID_132848
atgggtgaaggagaggagttgcaagagcaaatgaaggccgacatggaggccatgaaaagagcaaatggccacaatgatggaggccatgatgagcatgaaaaaggtaatggaagccatgcggttatagttgccgctaccaacactgttgctaaggtgaacccaatgcccccatctggccttaaccaaatgaatcatccaacctcagatatggtaggcaaagatttgggaagtacgggcggcccccattatgcgcaaattcaaatcaagcatgccttcacgccatatggcttgcctcccaactatacacaacccaatgtggcgtacactcccaataaggatgtcaataactccgttcccatactcattaagagccgacaacctcatcatgtacatgtctctcaacccacggggaggcacatgaaattccccaccacaatctag

SEQ ID NO: 41164 - DNA, 240 bp, Glycine max
  Peptide Sequence Number=SeqID_132849
atgatgaaagattgtgtgaagagcaagattagagacatcaattctttcttacagactaaagatgaatgcgcagttgaggtcgcaaaacccagaaagggtatcaagaagatagtgcaaaagatggttaaggcacaatgggtatcggcactgaatcagtgcgtacttcaacagtgggcaacccccttctctttggtgtatggtatggaacagtaccctgtggaggttgagatgtctcaatga

SEQ ID NO: 41165 - DNA, 185 bp, Glycine max
  Peptide Sequence Number=SeqID_132850
gaacatccagtaaaagtttcaaggtgatccaatggttaacgaattggaacgaagaggattttgctgaggtgggcaactggggatggtgtgcttatgcctggcttgtggaaatgggaaagttgatttgtgccatcgcccgatcgccacctagtaccaaatatgacgggtgccccataatccaataa

SEQ ID NO: 41166 - DNA, 426 bp, Glycine max
  Peptide Sequence Number=SeqID_132851
atgaagcacttcactgacaccctcatcagtgccaacatagtacacttgtcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 41167 - DNA, 1035 bp, Glycine max
  Peptide Sequence Number=SeqID_132852
ggacgatctgtcaagccgtcgctgagattaacattgaggatgataaaaatataaactatataatggtgcaacttccagagactaatattcgcccttgggaagcagactttgatagcttagaaaaagtacttcaacaatctaccacgtcaattaaagatggtcgttctattggtgctggtgctttaattgtttgcttggatgatgaaattacgactgaaacagttgaaggtatcgtcaagctaaaagctgaattagatcctgaaacaacacaagtagtctttaaagatgaaagttttgctgatgaccgagttaagacaaacgcaattcagatcttgaaacaagctaatatcaatgatgttaaaagacaagaaatattccaatcgaatttttctgtttcctctaatgcacttgcgagcgaacaattaggattattttccagaaataatgatattggtgtagcaaatgctcttacccttctacctgaagagctttatgaaaatacacgaaacgttcagcttattaatggattgcctcaaactgaaacgtcaaaacaagctcttccaagcctcgattttactatcgaaatggaaacggggacaggtaaaacctacgtctatcttcgtagtgtattcgagctgaatcagaaatatgggctaaccaagttcatcattgttgttccgtcagttgcgattaaagagggggtctataaatccctgcaaattacagaagagcattttagaaaagaatttaagaacgttcagtatgactactttgtatacgactcttcaaagcgtgagcaagtaagaaacttcgcaacgaatgattatattcagattatggtcatcaacattgacgctttcagtaagtctttcactgatccagagaaagagactactgcaaacttgattcaccgaaccgatgatcgattgaatggtatgaagccgattgagttcattcaagcgactaatcctgttgttttgattgatgaacctcaatctgtaacatctacagctaatcgtaaaaatgctattgcca

SEQ ID NO: 41168 - DNA, 255 bp, Glycine max
  Peptide Sequence Number=SeqID_132853
atgacagaacttgtgagcccggaagatgatgtaaatctccgcgtgtcaacgggcttgtcgcccgcgattgacgaagggcttttcgtcttacagatagcaaaaaagaattatacggataaccactcgggtatcttcgcctgtcagcgtgactcaaaagtcagtatgacagaacttgtgaaagtggccgacaaaagcgaggctcttgctcctacgtatcctccaatgaggaactcagacctacgtagttctggataa

SEQ ID NO: 41169 - DNA, 696 bp, Glycine max
  Peptide Sequence Number=SeqID_132854
atggctccgagaaagctttccgcaaagagatctaggaaggacgccgcggctgaagggactagtgctgctcccgagttcgacaaccatcgtttcaggagcactgagtaccagcagcattttcgaggccatcaagggatggagggcgtgcgggacatgcggtcatgggtaaggggccagtggattccttttaatgcaatgcctcagccagttcctgggagacccgctagtgttagaggagggccaggagtgctagattttgcccagaccgttgccgggagacgggtgcggatcatgcgcatcaacatgactaccttgacccagacgtggatgacgttgttgcacagcaacatcctgcccatcgatcataactccgacctccctctgccgaagtgtatgccgcccaccaggcaccctctagacccagataagtctaatagggccctgggatttccagcgttgatcacgggcctctgccagtcattcggggttcccgtcacacctagcaaggtgattcaaccgccgatcacctgggccttcattgagaagtattgcacgcctagacaggcgcagggtgatgcaccgcaggccactgacgcagcgccaccacctcatcaggctgatccagctgggtcattcagcatggagcagtatttacagcacttggttcgccagcaggcggccaaccacagggggcag

SEQ ID NO: 41170 - DNA, 366 bp, Glycine max
  Peptide Sequence Number=SeqID_132855
atggtgaaagttggaacctcttacgtgccgatcaacgtctcattttcgccaaaagttctgagccctaggttcccgtcacagagcccagctgtccttcctgttcagctactgacggggattggttatcgcgtcacaattccaacaacatacgagccggaagcatacaagtgtagcctggggctgaatcggccaactgttgggaagggatcgaggcggtttgcgtattgcggcgctaaagggggatgtgtcatactggcattactagttggcgtaactgatgaggctgaatatgtacggatatccgcttcctcgctcactgactacgtcggcgaattcggagctgccgagcggaatggcgccgcttag

SEQ ID NO: 41171 - DNA, 274 bp, Glycine max
  Peptide Sequence Number=SeqID_132856
tggcatctcatctctctcttccttctccattcctctgccatttatcttccaagaagcaaaggaatccattgatgaagaagatcctaggcctactaactccaatggagcttacaccacaagggaaaggattgaagttggtttaaagaaagggaagtttgattatgttgcttcgatgaattctggtaataagaggctgagggaaaatggtgtgaagaagaaaaagggagaaacctatgttgtggctgtggttcccacatggccaaacttcccgtaa

SEQ ID NO: 41172 - DNA, 453 bp, Glycine max
  Peptide Sequence Number=SeqID_132857
atgcatgcccttcagctgtatatccgagataaggtccaaaccaaatacagtgtggtctacaggagcttctcgtgcctcctccctagcattagagttataggcttaagtctgatcgggttgagttgggttattcttagtacaaacagcggtaggattggtaatgtttacggtaggtacctctacctcgatcccttcaccatttgcctttttcggcagcttgacttctcgtaccctattctacaaccatcgtggatgctgcctacaacaccagcttctctcttccttaactctttgtctctcctatttggtgagtccctcgcctttctaatttgttggtgcatcctaagatgttcttcgttcaaccctcgagcaatgaacggttggatagcctcatttgaaggcggtccacaaatcgagtatcctaactgcctgatccctaacatagggttatag

SEQ ID NO: 41173 - DNA, 809 bp, Glycine max
  Peptide Sequence Number=SeqID_132858
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcgttgggctcaagtacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41174 - DNA, 447 bp, Glycine max
  Peptide Sequence Number=SeqID_132859
atgaccatgattacgccaagctcgaaattaaccctcactaaagggaacaaaagctgtaaaaggacccaacgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 41175 - DNA, 884 bp, Glycine max
  Peptide Sequence Number=SeqID_132860
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatctgttccaccacaacagattggatgggtcacagatgccatgtcatgttcagaatgcattccacagctaccaaatgaggtgcttcgactgattgcacagtatcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41176 - DNA, 611 bp, Glycine max
  Peptide Sequence Number=SeqID_132861
atgacgttgctcctcagcaacatcctgcccagcgatcataattctgacctccccctgccaaagtgtcagctggtgtacgccatcctgacgcgaatgagcatccatgtggctcagttaatcgctgatgccatctatatttttgcagtccccgttgcacctaccaaggtaattcggccgcccatcacccgggcttttattgagaagtactgcacccagagacaggctcagggtgatgctccacaggccgcaggcgcgccaccaccacctcatcaggctggccaggctggggcatttgacatggagcagtatttacggcatttggttcgccaacaggcggccaaccaccgagcacatgtacagacccatgattgtctgtaccagatgagcctcagcatgcagagccaggacttcgcttctttttcatgctctctccagaccagttcagggcagaggttgcatggcccggagattggcccgaggcccaagcgggagaggcgcccccagaagctcccggcaatggagaagaggcccacgaggacgaggagatggccgatttgcttgacttcttgggagggagtggagatacgtgactgggagatccctagattcat

SEQ ID NO: 41177 - DNA, 647 bp, Glycine max
  Peptide Sequence Number=SeqID_132862
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgaccgtgaaagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 41178 - DNA, 471 bp, Glycine max
  Peptide Sequence Number=SeqID_132863
atgaccatgattacgccaagctcgaaattaaccctcactaaagggaacaaaagctgttaccaaactttgtctcttaagcttaacctttcacggtcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 41179 - DNA, 530 bp, Glycine max
  Peptide Sequence Number=SeqID_132864
tttcatgccctactccagaccagttcagggcagaggtagcgtggcccggagattggcccgaggcccaagcaggagaggcacccccagaagctcccggcgatggagaagaagcccacgaggatgaggagatggctgatttgcttgacttcttgggagggagtggagacaccccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 41180 - DNA, 99 bp, Glycine max
  Peptide Sequence Number=SeqID_132865
atggaagctaaaaatgaatcactttttgtggacgatggagaccttagccggcctacggctggctgccacggcgtaggaaataacaaccctagctactaa

SEQ ID NO: 41181 - DNA, 379 bp, Glycine max
  Peptide Sequence Number=SeqID_132866
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgctcagagcttcgataatcaatttcgagcgtctcgatatattacaggactcagtcagacatccga

SEQ ID NO: 41182 - DNA, 786 bp, Glycine max
  Peptide Sequence Number=SeqID_132867
atggccccgaggaagcttgcctcaaagagatctaggaaggataaagtggctgaaggaaccagttccgctcccgaatatgacagccaccgttttaggagtgctgagcaccagcagcgcttcgaggccatcaaggacgacgagtataccaacttccaggaggagatagttcgccggcggtgggcatcactagttacccccatggccaagttcgacccagacatagtcctcgaattttatgctaatgcttggcctacagaggagggcgtgcgagatatgcgatcctgggtgaggggtcagtggatcccgttcgatgcggatgctctcagccagttcctgggataccctttagtgctggaagagggccaggaatgcgagtatggccagaggaggaaccggtctgatgggttcgatgagaaggccatcgcccagttgctatgtataccggggcaggattttgcccggattgctgctggaagacgggtgcagatcatgcgcaccaacatgaccaccctgactcagatctggatgactttgctgctcagcaacatccagcccagcgatcataattccgacctccccctgccgaagtgtcagctggtgtacgccatcctgacacggatgagcattcacgtggctcagttaatcgctgatgccatctatctatttgcaggtatggcgcctaccaggcaccctctagacccggataactccaacagggccctgggatttcccgccttgatcacaggactctgccagtcgttcggagtccccgtcgcacctagcaag

SEQ ID NO: 41183 - DNA, 746 bp, Glycine max
  Peptide Sequence Number=SeqID_132868
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggtggttaacaaagaagagaaggtggaaaagatcgcaggttcgatccctcatgctaacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41184 - DNA, 243 bp, Glycine max
  Peptide Sequence Number=SeqID_132869
atgcaaggatatgcgctatgctcctcaaaggctgcgcttagcggcaccaacaattcgaaaatttcactaagtattgggagcttagtgagcgaggctcgcttagctcagcggatgccgcaacgaatcacgcttggcctaggaaagctcggcttagcgtacgactatcaacaaaaaaattgtctaagttacctgggcttagcgattcaagctcttttagccacaggtagttcagcaagaggatga

SEQ ID NO: 41185 - DNA, 210 bp, Glycine max
  Peptide Sequence Number=SeqID_132870
atggattatgtcttaaagccttacaccgggggcgtaacaacggtaaagttcacaacaagttcaaaaatcaaagaaaggggcatgattagaagttttcacccaataggttccagctacataggtcatgaccgaaagatcaatggtaccttaatcttacacggggcaatgagcatcgtgcatgagcctcaagtgaacataggaggcaaataa

SEQ ID NO: 41186 - DNA, 252 bp, Glycine max
  Peptide Sequence Number=SeqID_132871
atgacattcttaggagagacttcgtcccagacgatcgtgaactcaaggttggcattcatttttccaaatggaaccgtcattcacaatgagtgtggggtttattttcaaagtgctagtccactcaaagatcaattaaagaacaactcaagtgaattaaagatcaatcaaagcacaactcaagtgaatcaagaacaattcaagaagttcaagataagaatcaagaagaattcgagaatcaagaagaaagtctag

SEQ ID NO: 41187 - DNA, 180 bp, Glycine max
  Peptide Sequence Number=SeqID_132872
atggttgtgagcttgttcttgactcatcttctccttgaagtggtgtctccaatcatctttcttccttctccattctgttgcctcaaacctcaagaagcaaaggatttcattgatgaagaagatacaaggccttcaagctccacatggagctacatcagagatgatgttgatgttgataat

SEQ ID NO: 41188 - DNA, 287 bp, Glycine max
  Peptide Sequence Number=SeqID_132873
aaaacaccgagactttttcaagtctcacaagttatccagaactacgtaggtctgagttcctcattggaggatacgtaggagcaaaagccttgcttttgtcgaccgcgccgctttctgttaccatgacccaagagctggtagctcgcggagacaccttacggttatccgcacccttttgtcatccagaggcggcgggcccgatgacaagcagagacaaaatttggtcattctgcacccttgtgtcatccagaggcggcgggcccgatgatacgtggagataccttaag

SEQ ID NO: 41189 - DNA, 425 bp, Glycine max
  Peptide Sequence Number=SeqID_132874
gtattgcgcctactaggcaccctctggaccaaaataagtccaacagggccctggggtttccggcgctgatcacaggcctctgccagtcctacggagttcccgtcacccacagtaaggtaatccgactgccgatcacccgagccttcatcgagaagtattgcacacctaggcaggcacagggtgacacacatcaagccgcaggcgcaccgccaccacctcgcctcagtcagcaggggcagggtgctgtcccttttgtatgccttaccccagagcagtttggggctgaggtcgcatggcctggagactggctcgatgcccaggcaggggagaagcctgtaggatcccctggtgaggcggatgaatcccatatggatgaagatatgactgacctgctcggtttcttgggagggagcggagccacatga

SEQ ID NO: 41190 - DNA, 330 bp, Glycine max
  Peptide Sequence Number=SeqID_132875
atgcagagtctacaaaactcggtccagcaaaggcctgtgatgagtgttgaggagtttattcagttggtggcctggccaggagtccagccttctccttcgggagggggtgaagcctctatagcctgggagccacaaccagaggtggaggatggcattatcattccaaagcccactccacctgagccgtttacttttgaggctgacacagttattgctcaggaggatgtggcatcaccagagcccttccctcaggcagagccatctccatctccttcgtgcctgaccagtctacctctcaggacatatcatctgcaccggtgttggatctga

SEQ ID NO: 41191 - DNA, 204 bp, Glycine max
  Peptide Sequence Number=SeqID_132876
atgtggttctgtttggaaatcaagatgaccgcgctaagcgcgcctgctgcgcttagcctggcgttcatccctactgatgaaccgctaagcctgacctgtcaggctatgcgccactttgcttctgctaagcacgccttgtgcgctaagcctgagtgtcattctgatgaggttgagctaagcgtgccatgctgtgctaagctctga

SEQ ID NO: 41192 - DNA, 324 bp, Glycine max
  Peptide Sequence Number=SeqID_132877
atgaagctgcctcggtataaacgctgcccagccttcgttaaccgttggatcttctcgaaatttggtttgcaacttcacaagacaatttaccatgatttaaccgttgggatctttgagaaacttaggaaaaatgccatttcttcttctttctttcttccaaatccatttctaaagttccaagtactttctccatcacccacatccaccattagccaccgcaaaccatcattgttcttcattgaaaacccacaccgagaggaacccttcaaccgaagcagaatttacaacttggcttgcggtttcggtagagaacgaaaaccctaa

SEQ ID NO: 41193 - DNA, 201 bp, Glycine max
  Peptide Sequence Number=SeqID_132878
atggaaaaatctgaaaagaaaaatcatagtgagaagaaactaaagaaagcatacatcacatgggatgaaaatgatttggaatcctctgatgattctgaaaatgaagagataaatctttgtcttatggcaaaaagttacgaaagtgatgaagagaagaggacatggcatatcaacttgctacttcaagaaaaattacagtaa

SEQ ID NO: 41194 - DNA, 812 bp, Glycine max
  Peptide Sequence Number=SeqID_132879
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccattgactggtcttgatgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtgggcaggagaaaaaagggctgcaccggtgcgtcagcagaatatgtgatacaggatatattccgcttcctcggctcactgactcgctacgctcggtcgttcgactgcggcgagcggaaatggcttacgaacggggcggagatttcctggaagatgccaggaagatacttaacagggaa

SEQ ID NO: 41195 - DNA, 54 bp, Glycine max
  Peptide Sequence Number=SeqID_132880
atgggacaaacaggctttgtggctgatttaggggtggcctttgtggatgattag

SEQ ID NO: 41196 - DNA, 179 bp, Glycine max
  Peptide Sequence Number=SeqID_132881
gttcttatggattgcttgtctctattgtgttccttgattttggtgcatatagggaatttggaagaggtggtgccatccttgaagtaatattgagtccagaagcaaggggccaccctaagagctacttggataagaaacactccatagtgagtgaatcaacatacataggaaggttgaaa

SEQ ID NO: 41197 - DNA, 474 bp, Glycine max
  Peptide Sequence Number=SeqID_132882
atgaataggaagcctggggcaaatagagaggatgagaaggagggaggaacccatgttgtgactgtagttcctacatggccaaattctccaccggctcaacaatgtcattattcagccaatatcatcccttcttattacccaccaccctatcagccaataatacccaatcaaccacaaaggccacccctaaatcagccacaaggcccgccggccgcacatccaataccaaacaccacccttaacacaaaccaaaacactaaccagggaaggaattttccagcaaaaaagcctgtagaattcaccccaattccagtgtcatatgctaacttgctccctgtcgcaacgtgcccttcgtgggcgagcgagggcaaggctctcgggtgcgctttccaaaggaggaaagatgcacgaagtcgccaccaacgtttatttgtggaaaacgtcgggaaaaccgaaggaaactggtcaaaatga

SEQ ID NO: 41198 - DNA, 552 bp, Glycine max
  Peptide Sequence Number=SeqID_132883
atgatggtagacaccttgccagtgttttactatgagaagttggtaggctacatgccttccagcttcgcagacttggtattcgccggggaaagaattgaagtagggttgaaaagagggaagttcgattacgtttcctccacaagtacccatgctaaaagagtcggagcaactggggcaaaaaggaaggagggagatacccatgccgtcactttggcgcccgcatgggtcaagcccccgcagacctctcatggtacacatcagtatgcgcaacatcatccaagcttttcagctcgcgccgggatctcctccaattcagcacccgttcagcctaaggcacccatccaaagggagaccccccaagctccggctccaaccacgactcgcccggctggcaattccaacgcaatgagggaactttcccccgaagccaattccagaattcaccccactcccaatgacgtacgaagacctcttgccgtcccttatcgccaaccaaatggccgtaataactcccgggaagatctaccaaccccctttcccaaagtggtatga

SEQ ID NO: 41199 - DNA, 225 bp, Glycine max
  Peptide Sequence Number=SeqID_132884
atgaagctacgtaagaaggaacagagccgagaggagaagaaattactacaagataggacaatagcttccattctagaggaagaagctcattcttctaattctacatcatccgactcgccatcatcaagggaatccgcgacatatttaccagaagccgttatcatggctgatgaacaccagcaaagggttacccttgaggactacttaagcagtttagtaccataa

SEQ ID NO: 41200 - DNA, 363 bp, Glycine max
  Peptide Sequence Number=SeqID_132885
agggctacacgccctcgccatcagagggctacacgtccttcaccttcagagggactgacaccctcgaccttcagagggactacacatcctcagccatcagagctacacgtcctcaccatcagaggactgcacgtcctcacctttagagggctgcacgccctcgccttcaaaggactacacgtcctcgcctttagagggctacacgccctcgccttcttgaggactacacgccctcaccttcatagggctgcacgacctcaccttcagaggactacacgtcctcgccacctagagggctacacgtcctcacctttagaggattacatgccttcaccttcagagggctacgccctcgccttctag

SEQ ID NO: 41201 - DNA, 222 bp, Glycine max
  Peptide Sequence Number=SeqID_132886
atgcataccggggcaagatttcgcccagaccgccatagggagacgagtgcggatcatgcgcaccacctcaactttgatctccccctgtcgaagtgtcagttgggtgctcgtcccccccagcaagggatcacacccacaagacacccagtggacccgaagaagtccaacaaggtcctcgggtttccagctctgattacaggcctctgtcaggggatcctctag

SEQ ID NO: 41202 - DNA, 288 bp, Glycine max
  Peptide Sequence Number=SeqID_132887
atgttggtgcgcatggtccgcactcttctctttgcagcggcacaggtgaaatcttgccccagtatgcatagtagctgtgtgatagcctccctctctggttgtgctcgcacagttggccctcctccaatatcagggggtggcccaggaaccgttaaaaggaaactactggcgaggaagtgtagtcctctgaagttgaaggtacatgaccctttgaaggcaaggacgtgtagtcctctgaggtacatgacccttttgaaggcgaggacgtgtagtcctctgaaggtgaag

SEQ ID NO: 41203 - DNA, 696 bp, Glycine max
  Peptide Sequence Number=SeqID_132888
atgacaagcagagaccaagtttggtcattctgcacccttgtgtcatccaaaggcggcgggcccgatgatacgcggagataccttacggttatccgcacccttttgtcatccagaggcggcgggcccgatgatcaagcagagacaaaatttggtcattctgcacccttgtatcatccagaggcggcgggcccgatgacaagcagagaccaatttggtcattctgcacccttgtatcatccagaggcggcgggcccgatgatacgcggagataccttacggttatccgcacccttttgtcatccagaggcggcgggcccgatgacaagcagagacaaaatttggtcattctgcacccttgcatcatctagaggcggcgggcccgatgatacgcggagataccttacggcggcgggcccgatgatacgcggagataccttacggttatccgcacccttttgtcatccagaggcggcgggcccgatgacaagcagagacaaagtttggtcattctgcacccttgtatcatccagaggcggcgggcccgatgatacgcggagataccttacggttattcacgcacccatttgtcatccagaggcggcgggcccgatgacaagcagagaccaagtttggtcattctgcacccttgtatcatccagaggcggcgggcccgatgatacgcggaataccttacga

SEQ ID NO: 41204 - DNA, 284 bp, Glycine max
  Peptide Sequence Number=SeqID_132889
gtatcattctcttcgaagaacatattgcagcagtagggactactagcaacaataagttttcaaagagaaaagctctagatgaggcggagtcgccaactgtcgcaacctacccttcggcgggagggcgacgcgtgactcgcgggatgcgtgttccacgaaaggaatacgcggcggagtcggccaccaacgtttatttgaggaaaacgtcgggaaaaaccggaaaagacgcgatctacgaacttttaagtgaaagggttcgggagttgtatttacgcacggggaag

SEQ ID NO: 41205 - DNA, 1095 bp, Glycine max
  Peptide Sequence Number=SeqID_132890
atggaggtggaaaccttagaggatcgtatcacttgggagttaggatataacgtccgcactaagttcctcggagacgacatggttcttctccctgggatgtccgatgacaaagctaaactcctcattcaatcagagacggaaagcgatgattctctcttttactcactggagaagtggacgccgaaatgtagacccaataacagggttgtttggctccagctgtggggatttccgatacaggtgtgggaaatgaaaaatctcaggagggctgtagctgctattggggatgtcatcgagtcagacgatgacacagaggaccgccgacgattggaccgggctcgagtattggtgcagacaccgcttccgccgttgataaggtcagaggtcatcgtccgtgtgggggagcttgagtatcgggtatggattgtggaagagacaggggttcgaaggtgggtcgaaccggaaaggaagctcgtcgtccgatgggtggtcggagatgataacatcggacgacggtggggagctgccaaccagaaattgtctccgtctcgtacccaacgggcagaaggagggaccgatgtgcgctgctgtgatcttagacccctaggtaatatccaggcagacgttacacccaaagaaaagtcaaaaggcactgtagaaggtatgctaggctctagctttggtaagctcaacctaggggacagcttcgcaggaacagaagaggaagctgctaacaccaaagaggtaacctgctataataccctacaggatgatcaaaggcacaggaatcacatagagggaaagtatttgaatggtggagcgaaagtagctgctgaccagacctttattggggaagaagagggacatgtcacgcagtctctctctccttctttatcgggggagattcaacaaggaattgggccaggttgcattaagggcccaatttcgactccaggagggtgtaataaagaagacatccacccagttgagcttttgggggtgcaagctgtgcaaaatcaaaaagagggtgggctaagtaatgatttaggcccaattttgaaaactgacgggtgccataaggaggaatccctacct

SEQ ID NO: 41206 - DNA, 273 bp, Glycine max
  Peptide Sequence Number=SeqID_132891
atgaagaggagtatgattgatgctgccagtggtggagctcttggtgatatgacccctgctgagaatgctgctagtccaagtaagccatatgttcctcctccaatgcaacaacatcagcagcaacaacaaagacaacaagcaactgagtcccctcctcaaccttccttagaagagttagtgaggcaaatgaccatccagaatatgcaatttcagcaagagacaagagtctccattcagagtttgacaaatcagatggggcagatgactacttag

SEQ ID NO: 41207 - DNA, 432 bp, Glycine max
  Peptide Sequence Number=SeqID_132892
atggatacggagcagcgatgtaactcgatccatcttttgccccaattttttgcaagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 41208 - DNA, 698 bp, Glycine max
  Peptide Sequence Number=SeqID_132893
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcaaagcaatgcacccattgcgccggggcccgcggctggcaagcgccatgtgtgatgggggcgtgatggcaactttgccaacagccagggcaggcggcgcgccatgcgcattgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 41209 - DNA, 390 bp, Glycine max
  Peptide Sequence Number=SeqID_132894
atgagaggtgtgccatcagaggaaaccatcatgccttccatcacacgaggattcaacgaagataatacgaagatacttcaaaagatccataaggcatggaataaagtgggaagaaaagataaggagcttagaggaagaagcaacgatgtcatgggcgactatcacaaatggcggaaatctagagtgcaagggaaagcttggcacaaaaagctagagggtctgaatggggaagagacagaagtgcccgaggaaagtgaagaggtgcaagtcttgaaggctgagttggaaaagacaaaagtagcaaaggagaaactgaaggtggtagtcactagagttaggaaagaatgtgataggctgagagatatcaacatgttcaggatgaagcgctag

SEQ ID NO: 41210 - DNA, 549 bp, Glycine max
  Peptide Sequence Number=SeqID_132895
atgaagcacttcactgacaccctcatcagtgccaacataggaacaaaagctggtaccgggccccccctcgaggtcgacggtatcgataagcttgataagtccgtacatgcgaatggcagcctcatgaacatgcgctggaatctccattccagcggattctgccttgcttttgaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 41211 - DNA, 130 bp, Glycine max
  Peptide Sequence Number=SeqID_132896
gttacaggttgtaccatatgtggtggtactcatgaatccggcctttgcattccttttgaagagtaaacgcaagaggttagctacattgggaatcagcaaaggcagggatacaatcaaggtggattcttag

SEQ ID NO: 41212 - DNA, 50 bp, Glycine max
  Peptide Sequence Number=SeqID_132897
atggcgcttagcttgacaggtgatgcaatcctatcccgcaagggcattgg

SEQ ID NO: 41213 - DNA, 568 bp, Glycine max
  Peptide Sequence Number=SeqID_132898
atgggagtgacaacgttgatcactagaactctattcaggttgaaggaccttcccatcatcttcaataacattgcctatgacttaacgaagatggatgaaaaagacttcaaagatcatgcaattcaacttcatgatatccagaagcctcaaagggagaaattcttctgtcgcgctaagcacgctgaagctgtgcttagtgatgaatgtgcgcttagccccactgatgagctgagctcaactacacttgctagcattgccacaccttttgggcttgagtttattcctcaagtaaagaagttgttggatgagggtttggttcgcaagagcttaaatccttgtgccttgttggtgcccaaaataggggttcccatgaaccctaagagaataaaggtcaatcctgagtggcccactccaccaacatcactcattgagttggtgaggaaccatgttccttcatgggaagatgcccaggaaatgggtgttaacggaaggagcccagagtatgaagaacctcaggatttgaggtcaaatcctttccaaggtgtagggaatgatgcaatcctaacct

SEQ ID NO: 41214 - DNA, 162 bp, Glycine max
  Peptide Sequence Number=SeqID_132899
atgccaatctccccctgcagatgtatcgcaagggcatcaggccccctactaatcgagctttcatcaagaagtactgcgcccccaggcaggcacatggcgaaacaccacagtagcctggggatggccaacagcgggcaacagacgcaccgccatcacctctag

SEQ ID NO: 41215 - DNA, 231 bp, Glycine max
  Peptide Sequence Number=SeqID_132900
atggacaagattctaaaggaaaagggaaaggaagcaatgaagaccctccagaagaagccaaatcaaatgatgaacttccaaaagaatggaaagcctcaaaagatcatcccctcgacaacattattggtgatattcaaaagggaatctttagaacaaattcatattcatggacagattctaaaggaaaagggaaaggaagcaatgaagaccctccagagagcaaatcaatga

SEQ ID NO: 41216 - DNA, 497 bp, Glycine max
  Peptide Sequence Number=SeqID_132901
atgggtgccaagcacctcaaaatgaccaaatacaagttgcatgccaccaagccaaggtccccggacgaaattaggggaagtaaagataagatactaatttcgttcctctcggttgacgagagtcgcgggcttttcgtcttacagatagcaaaaaggaatgtttatacggataaccactcgggtatttccgcccgtcagcgtgactcaaaagtcagtatgacagatcttgtgagcgcggaagatgacacagcaaaaaagaatgtttatacggataaccactcgggtatctccgcccgtcagcgtgactcaaatgtcagtatgacaaatcttgtgagtgcggaagatgacacagcaaaaaagaatgtttatacggataaccactcgggtatctccgcccgtcagcgtgactcaaatgtcagtatgacagatcttgtgagcgcggaagatgacgtaaagctccgcgtgtcaacgggcttgtcggccgcgattgacgaagg

SEQ ID NO: 41217 - DNA, 221 bp, Glycine max
  Peptide Sequence Number=SeqID_132902
atggagaattggcgaacaatcaagcttatcgataccgtcgacctccagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 41218 - DNA, 363 bp, Glycine max
  Peptide Sequence Number=SeqID_132903
atggggcagatggccacccagttgaaccaagctcaatcacaaaactttgacaagctgccttctcaatctatccataatcccaaaaatgtgagtgtcataacattgaggtcgggaaagcagtatcaaggacctcaaccagtagcatcttcctcatccgcaaatgaacctgcccaaattcactctactctagaaaaagatgatgacaaaaatttaaagacagcagcatatccctcttccattctgatgcaatgctaccccgcaagagcattggatagaagactccaagtagattgggccagagatccaagggaaggccctagggttctcatgagccttagggtagattttgagcccatgggctaa

SEQ ID NO: 41219 - DNA, 815 bp, Glycine max
  Peptide Sequence Number=SeqID_132904
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgataacctctggtggggtggagaatgtacttgctgagcacatcaacctttacaacatgggaattggtatccacattaagaccaacactggcagggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41220 - DNA, 489 bp, Glycine max
  Peptide Sequence Number=SeqID_132905
atggtcatttcgaaacgaaatgctaacatccaaaatctcatttatggctatgggggatttcatcagcagactctcctttccctggtagacgcattgtttgtcactcaaaaaaaagggggcatatgctgctctaaatcggttggaatatttgtctctttgctaaagcatgtttgcatttttagtggagaaaacaccgagactttttcaagtctcacaagttatccagaactacgtaggtttgagttcctcattggaggatacgtaggagcaaaagccttgcttttgtcgactgcgccgctttctgttaccatgacccaagagctggtagcccgcggagacaccttacggttatccgcacctcgtcattcagtgaccccaagtgtgattgatgagcagaggccaatgtggtcatctgtgccctttccggagatgtcagcatcttccggtggagactttttcaagtctcacaagttatctagaactacgtag

SEQ ID NO: 41221 - DNA, 549 bp, Glycine max
  Peptide Sequence Number=SeqID_132906
atgaaaagagaaaaacatgcctcctatagtagtcataactcttgcaaaagcctaagtgaagaacttcgtgactattatgaaggaaggcataggtcacatcttagacctcactcccatagaagagaaaaggaaagaaagactcaagaggctaacattaacctcccatacttccatgggaaggacaatgtagaggctaacttagtttgggaaataagggtagagcaacaacttataaagaagtctacatcaaaattttatggctctcactcttatccaaagaaagaccaaggtcaaggcatcttaggggtgacaccttctaagcccaaaggaggacacattacttctcaatgccccaccacaaaaaccatgattatgaggagccaagacatttatagtagccaagatgaggctactacgtcaccttcctctagtgaaagtgaagaagcaaaaggggaagaatctagtgaagaaatctacccccaagaagaaggacaacctttaatggttaaggaggagtgtaaggaggaagtgtctcctccaagaggttag

SEQ ID NO: 41222 - DNA, 231 bp, Glycine max
  Peptide Sequence Number=SeqID_132907
atgggtttcaaaaacaaggtcaaaatcaacattcggggtcaaatatccctgttaaaacataaagggctgagggggtttttcaaaggaagtgtaaaaacaccctattacagtacccaacacataaaagacactaaggaactcaaactagctaggagaaggtttagaagtcaagattacctcaaagaaaatttgaaatggaggattgagggatttcctccatcgaatctttga

SEQ ID NO: 41223 - DNA, 393 bp, Glycine max
  Peptide Sequence Number=SeqID_132908
acttatcaaggtaatccttgtggtgtctacccagacttatcttccttcattggaagtggcgtctacccagacttatcttccttcaccggaagtggcgtctaccctgacttatcttccttcaccggaagtggcgtcatccaaaaactctaccgcctgtatcaagtgatccgccccgtaagtggcgtctacccagacttatcttccttcaccggaagtggcgtctatcctgacttatcttccttcactggaagtggcgtcatccaaaacctccgtagcctgtatcaaacgatccgccccgtaagattcatatcatctggtatcagagcttcggctcttgatacagcctattcaaattctgtttggggtaaaaattgcctaattgctgaatgctaa

SEQ ID NO: 41224 - DNA, 449 bp, Glycine max
  Peptide Sequence Number=SeqID_132909
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgcttctcctgttcctgcctttcggtttaccggtgtcattccgctgttatggccgcgtttgtctcattccacgccctgacactcatttccgg

SEQ ID NO: 41225 - DNA, 357 bp, Glycine max
  Peptide Sequence Number=SeqID_132910
atgacaagcagagaccaagtttggtcattctgcacccttgtatcatccagaggcggcgggcccgatgatacgcggagataccttacggcggcgggcccgatgatacgcggagataccttacggttatccgcacccttttgtcatccagaggcggcgggcccgatgacaagcagagaccaaatttggtcattctgcacccttgtatcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatga

SEQ ID NO: 41226 - DNA, 1047 bp, Glycine max
  Peptide Sequence Number=SeqID_132911
atggtgtcgatgacactatttgcgaaaagtacgacattagcaaggagaagtgacccatttgtcatagccgcaaagacccttcgtgggaggatatgcgaaagaaggcacaagccattcagaaaacaaaacattgtccctcacatgttgtctcgtgggggttatgaatttctagaaaacaagttgatggaggagaagaaaaagaaacaactaaaggaagctgctaaatccagaagcactgacactgtgattgatcctccatctcccatcagacgacacgtgaagtggaagatggctcataccaagaaaactggccaaatgacatctaaggcagcaaagaaaattactgacaagattataaattccttggaggagctggcctcacagggttcctttgtcgctcatggacgtcagtatatactgtatgctaccattgggcgaccaaaacaccatggtcgtgtgcgtgcagctggagccagtgtcacgatcaagcaatacattggatcaactccaaggacctcccgcaagtcttcgtccatggctcccaaagacctggagcaactggcgcaaaaaatcagggaccagctgaaggagtcgatcacagaaaaagtgactcgacaactaatgttatccttcaaccagatgcagtcccagtttcaatcgcagatgcaatcacagggactcatactaccttctaagcctgaggttggtccttcaattgctcatgtcagcacaaaggagagttatgttgatccctcagggaacgatcgagacacgggtgactcagacaaatgcgggttgtacgtcgaagaaagtcctcctcgcctggttgccctaggaagactttgtgaggggtccacaaccgttcacaacattcctttgctccatgaccaagtcaaggttggtgttgaggaggttagagatgtagatgctcccattcctgtacccaatgaagaggctaagttagtgaggcagacacataacaccttccttgcttgggcaagacatcttgtcaagcgtttatcaaaacaagtatttcagttggattaa

SEQ ID NO: 41227 - DNA, 363 bp, Glycine max
  Peptide Sequence Number=SeqID_132912
atgcaacaatcaatacatatgtcactcagagagatgagcatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcgggcgcattaagcgcgggcgggtgtggtggttacgcgcagcggtgaccgctacactttgccagcgctga

SEQ ID NO: 41228 - DNA, 348 bp, Glycine max
  Peptide Sequence Number=SeqID_132913
atgtggaatctcttgtcaatgttaggatttaaacgcgattctcctcaaatttcagccagcccgcatcaattagaccttgcaccttacgcttcagagccctacaatgctcaatggaacgccccggggcttctccgtgacaagcacacgttgcgttcgagtcgtattcttggagaaatggaggttgatgaaccttggctaggggtggtgttcgtcattggagtgcgtaatgacattgttgggtttggtgggaaacttggtcgtataggaatggcagtcacagcatgggtttctccctctttcttaccctcttcatttgccccagttttctcagtcgtcctagtaggatga

SEQ ID NO: 41229 - DNA, 174 bp, Glycine max
  Peptide Sequence Number=SeqID_132914
atgttgtcgcgtttccgtcgcccggcgctgagtgcgctgctggcgcttgctctgcctgccgttgcctgggccgtcacgccggcgccgttgaaggtgatgtcattcaacgtccgtaccccggctgacaccgagccgggcaagcgctggcccgaccgccgtgatgcgatggtcaag

SEQ ID NO: 41230 - DNA, 815 bp, Glycine max
  Peptide Sequence Number=SeqID_132915
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgataaatgaactaagccacttttatgaaactttccaggtcatttgggaagataatgttgatcctgataacatgactcaatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41231 - DNA, 414 bp, Glycine max
  Peptide Sequence Number=SeqID_132916
atggacccttgggtacttgtacctatcaccttgagaggactacatgtcctcgccatcagaggactgcatgtcctcaacttgagaggactacatgtcctcgccatcagaggacctcatgtcctcgccttgagagggctgcacgccctcacctccagaggactacatgtcctcgccttgagagggctacatgccctcaccttggttaccctcactgttgagaggactacacgtcctcgccttgagaggactacacgtccctcaccatcagagggttgcacagccctcaccgtcgagagggctacacgccctcaccttgaaaggactacatgtcctcgccagcagaaggctgcacgccctcatctccagaggactgcacctcctcgccttgagagggctgcacgccctcacctttag

SEQ ID NO: 41232 - DNA, 231 bp, Glycine max
  Peptide Sequence Number=SeqID_132917
atgtgtctatcggggaagaagaaggaaacattgggtccaacaaagataggagaaaatcactcaaagtgtatcaatctcacacagggtaaggattatggcgagttgggattttggctcaaggcttgtagaacggctggtcatgatacatgtcaggatttggccagcggttcggggataaaggggatgtccccacattattcccatgatacacatgcaacaaatgatgattag

SEQ ID NO: 41233 - DNA, 594 bp, Glycine max
  Peptide Sequence Number=SeqID_132918
cctctggtggaggttgaatgtaagcataccggggttgagcagcataatgaacaggttgagcataatgagaggatggaaccacgtactaaacagattgtgcatactgaatctgctgtgagggaagagcaaaagaagtccatggaacagtggacatgggtggaggaagagttggcacatggttctcatcaagacgatgataacaaaaccatgcaccatgtccagtcttgtaacatattgggcactgaacatcggagaaacaatcgttgccaccaccactgcgtcttgaattgcaaccaccacggctatgacggccaaagttccaaccaccacgaccaccgaaaatccatttccagtataatcgttggtggaattgtaactagaagtctgagaagtcaaattgacctcgattaccaagggaaagacattggagttcgttgcgaagctggcgaacacgaggctcaacttgttgaagccatagaagttaatttgtcgcatgtaaattttgagaaatcgaattcgaaaactgcttccaagaagtcaccgacgaggaagatgacagaggggagggagggagagaagaagcggaagacatga

SEQ ID NO: 41234 - DNA, 336 bp, Glycine max
  Peptide Sequence Number=SeqID_132919
atggattcgttctcaaatcaatcgagagggtcgtcgagccaattatctgctcaggatctcaaaaaccagttgaagaaccaacttgccattgagtatgctcaacaatttcttgagcaagggaaacaagcggcatgtgctggtgttttcagagatatgcatggtaggtgggtacttgggtttgtttatgaaaaatctgcaagtgtgattatgtctaagttttggggagtagctacggcgctccaaatggcttggcacagtggcattccgaagttaacagtggaaagtgattccaagattgcatttgaatcattagagaatcctttcttctgtatttga

SEQ ID NO: 41235 - DNA, 591 bp, Glycine max
  Peptide Sequence Number=SeqID_132920
atgagtgcacatgtaggcttggagttgaccgagcctgcctcccccataccttcgcatagcgaagagccttctggccatgggatatccactttggtaatgatactcattgccgacattggaggtttggccttaaccatgttaatcatcatcacctttgctgtgaaggccatcaaccgtgttcatgctgttggatggatttgcgccatttctagcatcgcagtgttcgctgctcccttaagcaaaatgaatttctcccacaagggtgccaggggtagtggacctcttgccaagaacatgaaggccacttttggaacggtttgctcgttgaacattgtgttctgcgatgaagaaaatgatttcaatgatggtggtgcagtcacagataatagtcttgatgatgataatggtgatggaagaattgttgtgattggggtaatcacaggatacagaaaggcctgtaaactgaaagataggttaaggcataagactgcagcaattcctagtgatacaccaaatataaagaagaccaagttataccctttgtttatgttcctatacaagggaccaaagaatgacagagaaactttctga

SEQ ID NO: 41236 - DNA, 2400 bp, Glycine max
  Peptide Sequence Number=SeqID_132921
atggctgatttctttggtaggaggaagctcttcgacaacatcaagtgcttgttcaataccttgccgtttcacaagggtcgagtttcgtccaaggcattgtccatttgtatcaggtttttggggagacaagggagaattaaggaatcactctcactatttgaggaaatggaaactgtctttaggtgtaaacctgataaccttgtgtgtaataacatgctcaatgtgctttgcaagagggaatcatcagtggagatgattgagcttgcactttcaatttttcacaagattgtgctcctgataccttttcctgaaattggagtgcttcatactcattctgcggttaacatgctcattggggagctgtgtttgatgagtgcaaaagaagggtctgttgggaaggtgagagtgaggaatacgcggagaccgtgtactatattagttcctaacattggaggaaatagtggtgcaattcagcctgcaattcaagtgttttgggtagtttgtaattctggcttgttgcctagtgcttttgttgttgtcaaacttatgtctgagttttcttgtttgggtaataaggaagaagctgatcgagtgttgaggattgttgaggaaaggaaactgacttgtgttcaagagggatactctgttgttataacggcattgtgggaatgtggccgagtggaggaggcttgtgatttgtttgggaggatagaacatgatcagttggatcaatgtgttaaattggaaagaaaattggagaaccagaagttgcagaatctgtgtaaaggagatgaactagatgctgcttatgagaaagcacaatcaatgcttggaaagggtattcctttatcagcctatgctagagacatttttcaacaggtgtttcagaagtgtggcaagataaaaatagcacgtcagttactggaaaagactgaaagagttcaggagcctataatgttcaacggagccgcttggtgggttcagattcagaagcagagggagagggtgtttgtgattgcaagtgttggcagctggtgcggtttgtggcctggttccttcaatatggaaactgagttgactattagaggaaagagttttggtggcatttttggctcctctgctaagcctagatcactcagggttcagtcttctgatgaagatgttgaggatcttgtcccctctaatatttcgggcaaaccttctggaactgttctgccctatgttggtgttgcttgccttggagccatgttatttggttatcatcttggggtggtaaatggttctcttgagtaccttgccaaggatcttggaatcacccaaaacactgttatacaaggatggattgtcagtgcactgcttgctggtgctactgttggttcatttaccggtggagcattggctgacaaatttggccggactaggacttttcagttggatgcaatccctttagcaattggaggatttctttgtgctactgctcagagtgttcagacaatgatcatcggtcgcttgctagctggcataggaattggcataacatctgcagttgtaccactttacatatctgagatttctccaaccgaaattcggggtgcacttggatccgttaatcaactttttatatgtattggaattcttgcagcactactggctggaaaaatatctgaagctgaaaaggctgttaaaacactatatggaaaagaaagagtggctttggttatgcatgacttgacagcagcaagtgaaggttcttctgaacctgaagcaggatggtttgatctgtttagtagtcggtataggaaaggggcaacacttttcttgctccagcaattggcaggaataaatgcagtggtctattattcaacttctgttttccgcagtgctggaattgcttctgatgttgcagcaagtgcactggttggtgcatcaaatgtttttggcacaattgttgcttcgtccttgatggacaaaaaaggaaggaaacgtctccttatcacaagctttagtgggatggctgcttctatgttgcttcttttcgtgtctttcacttggaaggtccttgctccatactctggcacccttgcagtccttgggactgtcctctatgtcctatcattctctcttggtgctggtcctgtgcctgcccttcttctaccagagatatttgcatcaagaatcagagcaaaagcaatttctttgtcattaggcacacattggatctccaactttgtcatcgggctctatttcttgagtgtagttaacaagtttggtatcagcatagtgtacttgggcttctcaattgtctgtcttctcactgttgtgtacatagctcgtaacgttgtggaaacaaaaggtcgatcgttggaagaaatagaacgtgcacttagtcctgcaacataa

SEQ ID NO: 41237 - DNA, 258 bp, Glycine max
  Peptide Sequence Number=SeqID_132922
atgacagggctctcagctgttgagattattggttcattccaatctggcaaaacttacaatctcacaggaagtaaatcaccagaaaccaccgatgcagtcaccagaaaccaccgatgcagtcaccagaaaccaccgccggcagctgaacaagtgtggaggtttccggcagaagctgttgcaagagagagaacgaaggattttgaaagaagttgttgcaagagaatgaaagagccagagaatgaaggagccacagaatga

SEQ ID NO: 41238 - DNA, 2946 bp, Glycine max
  Peptide Sequence Number=SeqID_132923
atgcataagaatcccaaatcagtggtcctggcattagttttacttggctacaagtgcattagggaggcttcaactgaggccgagcctgatgatagcgtgttccctctaagagatatgtttagaacttgtctgagtgtagttgctgctctgactaaggattgcattgagggatttcatttgcaggaggttaaaagtttcaaccaacgcaggctaatacacacaaagcttgcattttctcttgaacaaattatatccatttctacactagctcttgaaagtaaatatgccaaagattgtgaagcaaggaactccatctgtgttggtgcagtgagatattgcattcaatgttttcatactgtacttagtgattcaaatatgcaggttcaagtaataggattgcaatttcttaaagccaggattcaaagaggtgtaaatacagaagataactcttttataatgtttcttgttggggagctaattgctgatattttcactttgatccaaaaaatgttgaagaataccataacaagagaatctgtaaccattgctagtgaatgcttgagtctcctggtgctgttacaaaccttgtcaaaaggtgatgactgccagagaagctttatgaacctacttctggaggccattgtcatgattttcttgtcaacagaagacgggatctctcaggaagtcaataatttaagaagcacaactgttaaacttgtttctcgccttgctcaaattccttcatcagccattcatgtcaaggatgttttactatcaatgcctcctcttcaccgccagcaacttcagggtgtaatacgagcttctgtaactcatgataaaaatccaacagatataaaagtaccagttttggacataaaaatgccaaagccatcggaaggaactgaagagaaacataccataccatcatctgctgctgtgatgcagacagatgaaaatgacaaggaagaagatgagtttagtgaagatgattgggatgcatttcagtcgtttcctgtctctaaaagtgaggatgaagatgattcaaaaacagagcatgttgctgaaggcaaggatcctagcacagttaaaatgtcatcagaaatagaaagttctattggaggtgttgagtttcaagatttttttatttccaaatccatcaatagtgaaaaggagctgaaaggtgatgaatgtctggaggctgtcaaagagaaacatgatcaaacttatcctagtactaacaagccacatgataatgagaatcaagagatggagggaaaattgcaaacctcggtggctcgagaaaaggggacatcaatcccaggaagtgaactagtttcttgtgatcagaagcctgaggtagaggctaagatggaggaaaatttgcaaaactcggggcttcaaggagagggggcatcaataccaggaaatgaacgagtttcttgtgatcaaaagcctgaggtagaagccgaggcatcaatccccggaaatgaacgagtttcttgtgatcaaaagcctgaggtagaagctgagatggagaaaaaattgcaaaattcagggcttcaagaagaggggacatcaatcccaggaaatgaactaatttcttgtgatcagaaacgtgaggtagaagctgaaggatcaattgaagaggaagtagtgtcagattctctgacacttcaacagggggtttctgaacagcctaacaggtgtgatgaagatgctgagaaggacagtgttaatgaaaatgagagtcatcacccgcagctagaaatgtctgaaagtccaatagagagtgtacataatagtacaaaatcagaaccatttgctgaagaccataaagaaatgttaagcatgattaaaccagaattcttaccaaatggtcctgatgttgtgattcaagatacagtactgattcatcaacccaaagtccagatcacgtatcacaacattgcaaatgacaagtctcatttttctagtgcctcgggtatccatgttccagcctggttccataaaggtttacttcctacaccatcaccgtcactccccctcatacttgttggacctggaacaggatgtgcacctttttgtggatttgtagaggaaagagcattgcaaagtagaactaattccactgatccaattatttttttctttggctgttggaatgaaaatggtgactttctgtaccgtgacttttggttgagtcattcacagaacaaaggggtgctttcagaagcaaaaggtggaggtttctatgttgcattctctagagaccagccccagaaggtttatgttcaacataagatgagggagcagagccaaaggatctggaacctattagctgagggggctgctgtttatatagcaggtttttcaaggaaaatgcctgcagatgtaacatcagcttttgaggaaattgtatccaaggaaaatgaggtttcaagagaagatgcagttagggcgttgaagcactgcgagaaccacgagtttctctctaagaactcgttcctgggaagctgggatgcgccacgggaccccaaggaggcggaggcgaagctaacgcgtcttcgaagagaatacgcattgcaagtgaaggaggttcggaaggaatacataagagagatggaggtcatgaagattgagaaggagcgcaaggacgaggctcgcagggaagcactcagagtcgccaacgaagagcgcaagaagctcaaggctcaagccgcgcagctcagagcgcaggaacgcgacatcgaacgacaacagtttcgagaaaccctattaaaagaaagagcagagaaacttgaaaactggaagatgaaagtcaaaatgcatgaagagaagaaggctgagaagaaagagtttctgcaccgacaaagttcggcgtggattgaagaaggcaatcttgagaaaaaagttgtggaagctatggttgaaataatgcatctttga

SEQ ID NO: 41239 - DNA, 267 bp, Glycine max
  Peptide Sequence Number=SeqID_132924
atgcttggaggggcttctgccaccgccgcttatgccatgggtatggtttctgatgccctcagctctgttgctttcactacttccgctattgtggtcagtgctgctggagcactagttgtgggctttcccttactttgggactcaccattagttacggtaggatccttgagacttcaggggattagccttttcagaatgttgcaagcttctgctgaaatgtggttgttggagactgggcagatgcaaaataatcctgttctggcctaa

SEQ ID NO: 41240 - DNA, 297 bp, Glycine max
  Peptide Sequence Number=SeqID_132925
atgggttttgataggagaaagtctttagcaaccctcaaaggcttccactactccatatttcagtctagtgaatgtccacaaacatggaggagtagtggaactttgaggcctgctgaagcctttattactgctgctataatgcaaattgaaaatttcaaattaaatggtaatcaagagaagattattatgatcgatcacaaccaactgaaaactcatccagatcagaatcatggtgctaatagttgccctaccgtcatgatcgataaacacctggaaagagttcaagccaaaatttaa

SEQ ID NO: 41241 - DNA, 3153 bp, Glycine max
  Peptide Sequence Number=SeqID_132926
atggcttcatctttggaggagcttcttgcagaggaggggttcaaaggaatcagaagagtgacaaggtctagatcctccttccaccatggtgcttcaagtgagcctctttactctttggatgggagattttctgtatcaagtgaaagagttcgaactcagagaacaaagtctgatgcctcacaatatcaaattacaagtagacagttaaaaaccgacactcatactgctacgaaccggatgtcaagggataatcttttttcgagagacaaaatggatcaacggttaaagaactcttctaccgatacagattcaggcaaaggaattgatatgccaaggaatgagattactgaggtgactgagcaagaagctaacatagttaaagataattattcaaaccaagtttctctaaaaagaggcaaagagaagaatttcaatgaacttgtggaggaggaagatcctgtcaaggatgcaaagatgcacagcagaagttccagtatacatatgcttggacactctagtgaaactagaaagaatataaaaccccagaaggactcatacactagatcaaatagcagcaggaataaagatagcaatcatgctatgcaagctgcttctagtcttgctcttgatcaagttgctgtccaagcagtagtttccattctaaatggctatataaagcgtttctccaaagatgtgaattttcggtcaacattgcgcggcaaatgcttctcctccttgaatttgattgaaatggaagaagagaacattacggagaccaaagtcataagaagtcttgagcaagcaatcgaggccattgatcaaactgctgaggaacctatatctaccatgtatctgaaaagaaccacgatgcaacttagcattattacaggtttgagtttaaatgattttaagtacgagtgtacgtgtgggattccaaattataagttgtcagcctgtgctcatctttacctcagtgtggcacggactgtattgttgcctgaactatgggagcacctattttctccacaattttctcatttgaaggcatggtacatcaaggaagcagaatttctagaagatgcaccaagcaaaacaagaaagctaaaacttcttcaaaaagtgtataatgaacatttggattctggaactcatgtatttgccatatactacaaagattggctcactgaaggagtagaatctccgcctattccttcaattggcattccatcagcttctgtaacgggaagtcaagagggaaattcacttggttattcatttgagtctgctagctccattgacccactctcaccacagccaatggtcagcaagaaactgtatgattctatgtttggtgactctagcaaatccagagtttaccaagtcaaagatattaatgatgatgataacctagacaactgcatgaaaggctcttgtggttcaactattgttagacagacactaacatatgagtctgaaactgttaaatttacagatcaagatattgaagatttctctataggtgtagcaattgatacaatcaagcctcacaatggaaattcaatgacagcttcagaagaatggcagaaaaggaatctagtcgatgacattaataactctttctctatgaaaactaatttaagcagccacagtattgatgctctatcacatgaaaaagctagtgaacttgttcttaaaaagccaaataagacaagttctactcttgaagggtcatattttccaagtattccacatgaatttatttgtcctcttactggagatctctttgaggaaccagtcaccctagagactggtcaaacatttgaaagagaagccatcaaagcatggtttgaaaagggaaatagaacatgcccagtaacaggaaataatttggaatgtgtgaccatgccatttaccaaccttattttgaagcgtttgattgataattggaagtcagaacgtttggattaccttattgatttttcttttcaaacagtggagaatttggaggagcttaagttgaaaaagagggatgaggctgctgttttcaagttagagagtcatttctcctctttgaaagaagaggacaaatcaacttatgctaagcatctcatctctttaggagttcttccatttctttttaggaggtttgaacagggaaatgtgaaagaaaaatcacatgtggtgtcacttttgctaaactgtattcaagtggactctggctgcatatatcagatagcaaggagtgttaacagaaaatgtcttgttgagcttcttcacagtaaggaggctactccgacaacaaatgcaataatattccttactgaacttttatcaatgaagaggagaaaggatgttacctcattcataagtggcttggcgggtgaaaaagtatttaatataatgcatattctgctcatgtatctcaagaatccttctccatttgaaaagcccctaattgctgtccttctgttacactttgatctgctggttgagcctcaaaagtttggcatatacagagaggtggctgtgaatgccattgcagaggcacttgatgccagcttaaatgatgagaagggcagagagaagtgttgcagagcactattaatcttgtgtagccatttttcttcaactggaaagataccaaccatgactagcatcttaaaacaagcaggttataataatgatagcctagaagtgaaacctcctggccatgaagaagagggtcagcagttatatgtaaccatttcagtttcatcggaagatgaagaaaaaaggggtgaagagttgctaaagaagttgttagagtcgttgattggtgatggagaaagcccttttttgaagagcatatctagatgtttagatactaatcacctagatttggtgagaacgtgtctaataactgtgacatggttgagctcctcactatcttcgctatttagtgctggattgcatcttcccgccttcttatccatcatctctcagttgaaaggaatcttggaaaatggagaacttgagctcaagactcttgcttctttgtctttgcttaatttcagtaaaatatcagaagatattgctccccttcttcatggacttgttgatgtagcatggactgcaaaacagctgcatgccattgtgtccagggagaatttgtag

SEQ ID NO: 41242 - DNA, 591 bp, Glycine max
  Peptide Sequence Number=SeqID_132927
atgggggagggatgttgtacgcagccttacccttgcatatgcaaagaggctgtttccggattcgaacccatgaccaacaaggaagggataggaggtagccaagttgatggggttggaggatattgtgggaaagggaaaggcagagatggtattggtggcattgattgcaaaggagggaatggtagtgttcttttgaggtggcttgtaactgaggccactcaagtggagctacttatcaaagttgcttggcagagtgacacaattgttgaaccatccatgcagttaactccatccaccgatggtatgtccaacttgtacactccatattggtctgtggttctgttcactgagaagcttatctgctcgctagtttttggtgaggttgctctaaatctgcacttagctctgtttagagaaagtgctggtggagcaggtatcacaataaacagctcccaccacactgatgtgagagataattggacttggagattgagcaatgagcacaaatgggcaactgaagagagatgtaacaaaaagaagaaggagaataggaaattgatccatgagaatagtgaaggttctaaaaattaa

SEQ ID NO: 41243 - DNA, 318 bp, Glycine max
  Peptide Sequence Number=SeqID_132928
atgttacctgaaatacaacaaaattcttctaagaaaactatagaaatcactcagtggtctctagatcaagtactgaggctgagtacaggagccttgcagctgctacagctgatattttgtggattcaaactttactctgaactcgcagttcctcatctcactcctatggtgctttgtgataattccagtgctgtgctaatggctcataatccagttcttcatgctgaaactaagcatatggagttggatctcttctttgccagagaaaaagtcctgtccaagaagctgattgttcaacatattcctggctatgattag

SEQ ID NO: 41244 - DNA, 2913 bp, Glycine max
  Peptide Sequence Number=SeqID_132929
atgggtatatttgaaccttacagagcaattggatgcatcacaagcagcgtccccttctctgttcaaaggctcggcaccgaaactttccttaccgtcagcgttggaaaggcttttcaggtttttaactgtgcaaagctcaatttggttctcgttggtcctcaactgccgaagaagattagtgctcttgcttcctatcgcgaatacacttttgctgcatatggaaacaacattgctgttttcaagcgtgcacaccaggttgcaacttggagcagccataatgctaaggttaagttgcttctgttgtttggagatcatattgtcagtgttgatgctcgcggcaacatgttcttgtggccatttaagggaattgatgagaacctttttccatttgggcacattatgctggatgagaaatttagccccagctgtataatgcatccggatacttacctaaataaggttcttgttgggagtgagcaaggtcctatgcagctttggaacattagcacaaagaaaaagatttttgagttcaagggatggaattcacctatctcctgttgtgtttcatcccctgccttagatgttgttgcaattggctgtacagatggaaggattcatgttcacaacattcgttatgatgaagagttagttacatttacacattccacacgtggttcagtgactgccttatcttttagcactgatggacagcctcttctagcttcgggaggttcatctggtgttataagcatatggaatctggaaaagaaaaggctccaatcagttgtaagagaggctcatgatagtgtgatcacatccctacatttttttgctaatgaaccagtgctaatgagttcatcagcagacaactcgattaaaatgtggatttttgatacaagtgatggtgatcctcgccttttgcgcttccgaagtgggcatagtgctcctcccctttgcataaagttttatgccaatggaagacatattctttctgcaggtcaggatcgtgcctttcgccttttctctgtagaggatcaacaaagcagggagctttctcaacggcatgtttctaaacgtgctaagaaattgaaattgaaggaggaagaaataaaattgaagcctgtgattgcatttgattgtgctgaaattagagaacgtgattggtgcaatgtggtcacttgtcatatggatactgcccaggcatatgtttggagacttcaaaattttgttcttggtgagcatatcttgaatccatgccctgaaaatccaacacctgtaaaggcttgtgctatcagtgcctgtggaaattttgtctttctagggacagcaggtggatggattgaaaggtttaatcttcaatctggaattcgcaggggtgcttatattgacatttcagaatcaagaaattgtgctcatgatggtgaagtagttggagttgcttgtgactcaacaaatactctcatgataagtgcaggatacaaaggagatataaaggtttggaatttcaaagaacgtgatcttaaaaccagatgggatgttgattgttctattgttaagattgtttaccatcgttataatggtctcctggctacagtagcagatgatttaacaattcaattatttgatgtcgtggctcttagacttgttcgtaaattcgaaggtcacacagatcgtataacagatttgtgcttcagtgaggatgggaagtggctcctgtcatctagtatggatggaagtcttagaatttgggatgtaatcttagcaagacagatagatgcaatacatgttgatgtacctatcacggcattatccctgtccccaaacatggatatattagcaactgcccatgttgatcaaagtggaatatacctgtgggtaaaccaggcaatgttctctagtacttcaaatgtcgattcatacgcaagtggaaaagaggttgtgagtgtcaaattgccgtctatctcttctgcagaacattctcgagatgagcattatgatgagccaatgaatgcatctcaacctaaagatgctctgtatttctcaactcaagataagcaaatacctgaattagttacactttcattgctgcctaagagccagtggctgaacttaatcaacttggacattataaaggttcgcaataagcctattgagcctccaaaaaaacctgaaaaagctccattcttcttgccttcagttccatccctctctggggaaatattgttcgagtctgatgcagcatttactgattatattaaaggattatctccgtcaactctggatatggagcttcgaatgtttcagatcattgatgatgatgatgatcagcaagaagcagagaagagacctgagttggtatccattgaatggcttctggattattttattcatgagctttcctgcagaaataattttgagtttctacaagctgtcatcaggctatttttgaagatccatggtgagacaattcgtcagcagtcatgcttacaagaaaaggcaaggaagcttctagatattcaatgcatggtatggcagagagtagataaattatttcaaagttcgagggttaaaaatcgaacttcatcgttgaccacaatgcacaaaagcaacactctatctccaacatcaaattatgcttctagacttcaaaatcctcaaaccttgggcttctcattcgagcaagatctaaccgtgaaaatcctagcccctacctccatgaatagatcacctaagaggagccaaatcctgaaacaaaaagagaatcacctaagtttgtttggatctggatggagatggtggcatgtggcagatttggttgttggttgtggtgtcagagttgcggcgtgccttggtactgagctagtgttggaagttgggagggaagtagagaggatgagggaggagatgttataa

SEQ ID NO: 41245 - DNA, 939 bp, Glycine max
  Peptide Sequence Number=SeqID_132930
atgagaaagaaacatctgaagatcttatggagactttgtacatttcaacaaccacatgataagtacaaaaaggtatcacgactataccacacaaagagcatggtcacggtgaatggtcagtttacagggccacgcattgtagctagggagggagaccgtcttcttatcaaagtgattaaccatgttcagaacaatatctccatccattggcacggcattcaacagcttcaatcagggtgggctgatggacctgcctatgtgactcagtgccccattcaaataggccaaagttatgtctacaattacaccattggtggccaaagaggcactctcttttggcatgctcacatttcatggttaagatcaactctctgtgatcctatcatcattcttcccaagcatggagttccatatccttttaccaaaccttacaaggaagtttccattatctttggagaatggtggaatgcagatcccgaggcagtcataacacaagcattgcaaataggtggaggaccaaatgtgtctgatgcatacactattaatgatacattcaagctaaaggtcaagccaacgaaaacataccttctcggtttgatcaatgctgcactcaatgataaactcttcttcagcattgcaaatcacaccttcacagtggttgataccatatgcgactggccagggcactctcttcactcaacgtcttcaatcaagaagctttcactcttcaagcccatcctcccttcccttaatgacacttctttctcgacaaacttcgccaacaatcttcgtagcttagcaagtgctcagtttccagccaatgtaccccagaaagttgataggccctttttcttcacagtagaccttggcacaactcctgcccacgaaaccaaacttgtcaaggacccaccaattcaacaaaatttgcagcatcagtga

SEQ ID NO: 41246 - DNA, 543 bp, Glycine max
  Peptide Sequence Number=SeqID_132931
atggggatgctgatcatgaagagcattggagggcacttaatctgttgttgtgtgcttttgcaagttcttgtcgctggaggtgagagtctagaagcaccagagcttaagaaaaactgcacctacgtgatcaccatagaaaccacatgcacatggggagctgaaacctcaaacattgtgagcctaaggtttggggacacaaactcaaatgtcatattggtgaggcacctaaactccaagcacctaaggaaagttgacccattggagccagaggttctcgatgacatgccaagaaaaccattcacagcaccatgtgtaaactccccaatttgttacttgtacctcaagctaattggaaacgatgattggagaccaggttttgcacaaattcaggtgcttgaaggctcacatcttaactccgattacttctattttagaagatttgtgcctagacatgtgtggcatggctcggatgtgtgtgatagtgaggttacgccttttggactaaagaagaagagaaatgtttatgtgaacaatatcccataa

SEQ ID NO: 41247 - DNA, 918 bp, Glycine max
  Peptide Sequence Number=SeqID_132932
atgacaaccaagttcttttggatgtggagaatattcattggccaagttaaggcaggagaaatccaccaaatcaaagaacacaagctggaccactttagaatgactagagccttcaataaggtaattactctgtctatcactggggcgttgaatgcagtcttaactgaagaacatagaaaggaaatatgccgttacctctataatcatcaagtacttggagtttatgaatggtccggaaataatcccctgccccctgagatatggctccttccatacatgcttccatttcatccagtttcatatcgtattaaaattagtttaagagtgcttttatatggtgatgacgacaatggtgatgatagcaacggtgacgatagagatattcgtgatgtttgtggtggcgatgacagtggcattggttgtgttgacggtgacgatgtggtggtggtagcggtgttggtggtgacatctaatgattacggtgttgttgttgttagtggtgacagaggtgatgtttgtgatgattgcgacgacgttgatggtgacagtaacaaatgtggtattagtggtagcaattttagtggtgttagtagtggctatgatggtggtgatgttggtggtggcgatagtgataccagtggttggcaacagagtgtcattatcaaattcagcttgaacattggtaagtctacttatgagactgtaacggttaatagttggttcatgagtggagtcaatagaaacatggtatgttccattcttgacgagacactgcaagcagttggtgctaaagcaatggtggtcggacatactcctcaaactataggtgtaaattgtaaatacaattgtagcatatggctcaaagattgcggaatgtgcagtggagttttgaattcaagaccagaggttcctctataa

SEQ ID NO: 41248 - DNA, 579 bp, Glycine max
  Peptide Sequence Number=SeqID_132933
atgtcaaatcaagagttcttccttctcaccaaagatgatgacaaagaagatttgagcaacttcgagattgtgaagagacacacgttaaccctttcaagcagttccaactctcaacattcacaaaaagaagagaagaaaagcaatcatcaagagatcatagaagagtgtcaacaacagatctgtagaataacaaaagctcatgattcagaatcaagtacttcaaaactcaaagaggaagatgaagaagaagatggattcaaaactccaacatctttggaccacaagattccactagtgccttcacagtgccctcctgcaccaagaaaaaccaaaccttctctgaaaagaaaaacatcttattacaacaaccattgcaactactgcagacacccacttgatctgtcaaaagaggtgttggagagggcgaaccctggtgcagcggtaaagttgtgccttggtgacttgttggtcatgggttcgaatccggaaacagcctccttgcatatgcaaggtttttataatgaaggtgttggactcaataatggaaatacaggaaacaaatacccaaagccgaattag

SEQ ID NO: 41249 - DNA, 279 bp, Glycine max
  Peptide Sequence Number=SeqID_132934
atggcttttcatatttatcaacgaccttatgttttgagcgtcatatgcattgctatgattttcgctgcaggagtagtaacttgttttgagtctccactactaagctgccaggagcgatgcatagatgatccaacgtgcgactttatctgccataaaaagggttttgtcaaagggggatcttttacgatatttatgttacgaaaactttctgtaaatataattaatgaggccacaaattataatctaataagggtgggggcagccagtcaacctgcttga

SEQ ID NO: 41250 - DNA, 348 bp, Glycine max
  Peptide Sequence Number=SeqID_132935
atgacgataatgattctgggaaccttgtactacaagaaagcaccacaggaagcaacatatggaaagtttccagcatccttcaaatgcaatattagccaatatgaagcttttagaactaacaaaggatacatcatacgtgttggagatgacaagcaaggaaatgtcgaacacttttttcgggaagtagaagagattggcttggtagtctatattctgaattcaacagggaattgtgaagagaggttgtggaatggggagaagaaagaatgggcagtcacatggaacagtcatcaattgcatattcatatcatgctgatattggttctatgtcttggggtggcaatctaa

SEQ ID NO: 41251 - DNA, 807 bp, Glycine max
  Peptide Sequence Number=SeqID_132936
atggaatctggaaacaatattgtgtcaccaactgaggatttctctcgtcatactcatgagccatatgcgaaactatgtccagaatcactgcatataccttatgagtttcgttgtccaatttctctagtgataatgaaagatcctgttatcatttgcacagggcagacatcagatgcctcttctgaattaatagatcctgatatcttagtgagcaaactttcttccaatgatatcgaggaactacaatgtgcagtaggggagctccgacttctcaccaagaaaaatggtcaaaatcgaatgctgattgctgaagcgggtgctatcccctgccttgttgatctcctctatgcacttgacacccaaacaacttgtgaaaatgcagcagccacctttttcagcctctctggggtggatgggaacagaattgcaattgggaaggtggatgcggcaaaagcactattgaatctgtgtttatctcaagggaacaaaggacaggcaattacagccagtattgtgcctaagttgatagaaatgctaacagaacctgatggggatatgagggatgaggcattcgcagtaatggctgtagtagctgctggccattccgatggacaagcaacaattggatctatgaatgttgtatccactttggtggaattagtcagtaatggacctcctaggaacaaagagaatgcaacttcagtttcactaggtgtggtcaatcctctcttggacctggcaggaaatggttcagaaagggccaagcgaaaagcttcacagctttttgagttgataggaaaccattga

SEQ ID NO: 41252 - DNA, 282 bp, Glycine max
  Peptide Sequence Number=SeqID_132937
atgcttagaccactggggagctcgtggaaattacgactcttcccttgcttcagatcgtactgggcacgcatcttcttctctctgctcataaccgccgcagtcttcaaattggaacggttcacaaaaaaggagagcatgaccacattgaaggatttcataacaaagcataatgttcctcatgatgtcccagatgagtcattagaagcttcttcagatgatgatgatgctgatgatattcctgagaagcctcaagcgaagtcaaagaaaaccaagttgacttag

SEQ ID NO: 41253 - DNA, 420 bp, Glycine max
  Peptide Sequence Number=SeqID_132938
atggttgatgtaaactcttcgaggaagtttattcctaaacctttggctttggtatcagcaacatatgcttacgctatttttaatctggttcctgcaatcacttttgtcctctccatcttgtgcggctacgaaaacttaaatgtgcgaaccgcagcaggaaaggctaaggtgttaggaacgatactgggaattaacgggtcaatgctgccctcattttttaaaggggtgaaaattaatatttggaactttcacattaatcttttgcatagtcatctaggaatgcaaactccaaaaacagaatggctgcagggaactgtgacctctggatttgtgattattgccacaacagggtgtgtaaggaagagaggtccattgtatgcatctgttttcaaccccctttaccttgtgctcgtggcttag

SEQ ID NO: 41254 - DNA, 288 bp, Glycine max
  Peptide Sequence Number=SeqID_132939
atggagaatgagtcttctagccatgggtccacattgatcctagggagaccattcttgatgacagccaagaccaaaattgatgtgcatgttggaactttttccatagagtttggtgacgatgttgtgcattctaacatttatgaggccatgagacatcttgaaaaagagcattctattttccttgtagatatcattggtcgatgcaatcctaccccccaagggtattggatagaagactccaagaggcttgggctagagctactaaagaaggccctagggttttcatga

SEQ ID NO: 41255 - DNA, 222 bp, Glycine max
  Peptide Sequence Number=SeqID_132940
atgtcgaaacatatttggacctatgaaatcacccaatcaatgctaggggcaccatatccactggggattggtgataagtatatcgttcagccttggtataaattccttcaagaaggtgattttagccatggagacgaactgtcattctactataggcgtgacgaaaaaatatgggaagttgttattagacgcgcaatagattgggacgacaacgacatgtag

SEQ ID NO: 41256 - DNA, 878 bp, Glycine max
  Peptide Sequence Number=SeqID_132941
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcagatctacgtgcatcaactctcattgatcctgctactccacctgtctggacgagcaagcacacaaacactatcaaaatagatgacgattgcaagatcattgatctggatcaagcttatcgataccgtcgacctcgagggggggcccgggaccagcttttggtccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41257 - DNA, 739 bp, Glycine max
  Peptide Sequence Number=SeqID_132942
atggcctcggcttcgctgaagttcgaacctgccttgcaggccagcagggcctccagcgttgcggtgccggcgggggcgatggcaggcggggctgcgtgggtagccgagctcgcggccagagcggtcatgaccacggcgaacgcggtgtttctggttctcattgcaggtccttctatcggatgcgcgacgaaggcgcagcgaccttgccgggccgctgcgccatgccatcagttgctggccgccttcaccgcttctgcggcgtcgacaatgcctggcccgcaaccccccgggcagtttgctgcggcgatcgggcgcgcagtcgactctgaggatgtccttgacctggtctggctgtgggcccgtgtcgccctgctgcatcagcgggaccgggacgtgggcgccgccatcgaggtgccggaagagtcgaaggacgttgtctgccccggttttgaggcatacgccctgtccgccggactgctggctgtagcgcagggtcatgcgttacggcgcgatctggcttcagcggcaggaataaccttcgtaatcgtcaccggcaatcaccggctcttcggtgttggcgtattcgttgaccgtggtcaccgaccaggtcttggcgaggcgcttcggatcgacaccgttcaagtagacgaagacgctcttctcgccctcggcgacgttcacatcggcatgggtgacggtatcgccgaacagggcgactggcgtggtttccggctcgaac

SEQ ID NO: 41258 - DNA, 792 bp, Glycine max
  Peptide Sequence Number=SeqID_132943
atggcgatgacggagccgcgcatggcatcgccgaagggcagctggaaccacatggcgaagctggcccagatcgcaaagacaagggtgaatagaatgaagacgaatttgcctgcgatgcggacgggagccgatttcaggagagaagacatatgcattccgtattcgtcagttgccgccgccgggaactattccgtgtgcggaaatcgcggcgatactgacatgatttgcatcgtcatgtcatgggggcttgcggttgcgggcgtgcggacgcaccagacgccacagcagcagcgcgccgacgatcccggcatagatgaccggttcggcaggccagcttttcaccgacatgatgaaatggatcgcgccgcccgcgattgccagatagaccagcttgtgcaggctgttccagcgccgcccgagcttgcggatcgaccagttgttggaggtaagcgccagcggcaccagcagaacaaggctgatcatgccgatggtgatgaagggccgccgcacgatatcggtgacgatggcggaaatattcaggccctgatccagcagcatgtaggtggcgaagtgcatcagcgcataatagaaggcgaggagaccgagcgcccggcggtagcgcagcagcgcaatgccggtcaggtcgcggatcggcgtgaccatgagggtgagaatgaggaagcgcagcgcccacaggccgagcgtgtgttcaaaggtcttgaccggatcggcgccgagattgccgcttgcgcccagatagaaagtccagacagccgggacgagaccgaccgc

SEQ ID NO: 41259 - DNA, 275 bp, Glycine max
  Peptide Sequence Number=SeqID_132944
atgctttcagcagttatccgctccgcacttggctacccagcgtttaccgtgggcacgataactggcacaccagagttacggccgccgttcaccggggcttcggtcgtcggctcccctgtcatcagtcgcccgggcctggtcactgcgaccccctttgtgaggaggcaccccttctcccgaagttacggggctattttgccgacgttccttagagagagttgtctcgcgcctctaggtattctctacctacccacctgtgtcggtttcgggtacag

SEQ ID NO: 41260 - DNA, 791 bp, Glycine max
  Peptide Sequence Number=SeqID_132945
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgccgcggatctccacccggcgcgccagcttgaccagggccgcaaacgggttgatgcgggccaggtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41261 - DNA, 693 bp, Glycine max
  Peptide Sequence Number=SeqID_132946
atggcagagccaccaaagaagagaaagggatcatcctccaccactaccgctgctgcccatcgccgtcacggcccatccggaggacgcacaacacctattcctccttctttgtcatctccaagatcatcaacactgttttcatctgatgatcaacgtctacggtacctttctcagttttcttctagaataatcttagatcctaagtacctagacgtagagttctttaatgatgaaacgtttgattgctatcaagtgtttcaaaattctggtcttgttgatttcatgtcattaaaattgtcatattatcctgaacttgttaaggtcttctactgcaatttaaaaattcaggatggtattattatgtctgaggtgcatggtacttctatggtcattgatcagtcacttttcttttctttgactcatttacccagtcaaggtgcaccttttgagggcaccattgttgatgactggaaattcgattattcaagtcataatgctcgtcgcatggtctgcaatgatcaagctgaaatgaccgtgacctcctttgggtatcgtaaagatcggaatggacaatggctgaagaaggatgcactccctcctcaagatgaacgtactccttcacctccccctcaacgtgaagattccgcactcatgaatgaagtcctctccgaattatggggtcttcgttcttaa
